United States Patent
Friedland et al.

(10) Patent No.: US 11,001,844 B2
(45) Date of Patent: May 11, 2021

(54) CRISPR/CAS-RELATED METHODS AND COMPOSITIONS FOR TREATING HERPES SIMPLEX VIRUS

(71) Applicant: EDITAS MEDICINE, INC., Cambridge, MA (US)

(72) Inventors: Ari E. Friedland, Boston, MA (US); Penrose O'Donnell, Yarmouth, ME (US); David A. Bumcrot, Belmont, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 0 days.

(21) Appl. No.: 15/966,897

(22) Filed: Apr. 30, 2018

(65) Prior Publication Data

US 2018/0251770 A1   Sep. 6, 2018

Related U.S. Application Data

(63) Continuation of application No. PCT/US2016/059502, filed on Oct. 28, 2016.

(60) Provisional application No. 62/249,159, filed on Oct. 30, 2015, provisional application No. 62/249,071, filed on Oct. 30, 2015.

(51) Int. Cl.
  *C12N 15/113*  (2010.01)
  *C12N 9/22*    (2006.01)
  *C12N 15/10*   (2006.01)

(52) U.S. Cl.
  CPC ............ *C12N 15/1133* (2013.01); *C12N 9/22* (2013.01); *C12N 15/102* (2013.01); *C12N 2310/10* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| 8,999,641 B2 * | 4/2015 | Zhang ............... C12N 9/22 |
|---|---|---|
| | | 424/94.1 |
| 9,963,719 B1 * | 5/2018 | Friedland ........... C12N 9/22 |
| 10,006,054 B1 * | 6/2018 | Friedland ........... C12N 9/22 |
| 10,071,098 B2 * | 9/2018 | Clifford ......... A61K 31/4184 |

FOREIGN PATENT DOCUMENTS

| WO | WO 2015/070083 A  | 5/2015 |
|---|---|---|
| WO | WO 2015/126927 A2 | 8/2015 |
| WO | WO 2015/153789 A1 | 10/2015 |
| WO | WO 2015/153791 A1 | 10/2015 |
| WO | WO 2015/153889 A2 | 10/2015 |
| WO | WO 2016/115355 A1 | 7/2016 |

OTHER PUBLICATIONS

Kang et al (Virology, 2003, p. 233-244).*
Nishimasu (Cell, Aug. 2015, p. 1113-1126).*
International Search Report dated Mar. 22, 2017 in International Application No. PCT/US2016/059502.
Kleinstiver et al., "Engineered CRISPR-Cas9 nucleases with altered PAM specificities," Nature, 523(7561):481-485 (2015).
Nishiyama et al., "Function of Herpes Simplex Virus Gene Products," Virus 51(1):29-36 (2001) [with full English translation].

* cited by examiner

*Primary Examiner* — Agnieszka Boesen
(74) *Attorney, Agent, or Firm* — Baker Botts L.L.P.

(57) ABSTRACT

CRISPR/CAS-related systems, compositions and methods for editing RS1, RL2, and/or LAT genes in human cells are described, as are cells and compositions including cells edited according to the same.

26 Claims, 31 Drawing Sheets

Specification includes a Sequence Listing.

*Streptococcus thermophilus*
a) Structure (See, e.g., Karvelis et al. RNA Biology. 2013; 10 (5): 841-851)

```
                    Targeting      First Complementarity
                    Domain         Domain
                    ⌢⎯⎯⎯⎯⎯⎯⌢      ⌢⎯⎯⎯⎯⎯⎯⌢
5'-NNNNNNNNNNNNNNNNNNNNGUUUUAGAGCUGUGUUGUUUCG-3'    (SEQ ID NO: 45)
                                    ||||||||||||
                   CAACUCAUGCCUGAUUCGGAAUAAAAUU CGACACAACAAAGCGGG-5'  (SEQ ID NO: 46)
                   ⌣⎯⎯⎯⎯⌣           GAG        ⌣⎯⎯⎯⌣
                   Proximal              Second     5' Extension
                   Domain                Complementarity  Domain
                                         Domain
AGCCACGGUGGAAAAGUUC
|||||||
U   UCGGUGUUUU-3'
⌣⎯⎯⎯⌣
Tail
Domain
```

FIG. 1F

Alignment

S. pyogenes      5'-NNNNNNNNNNNNNNNNNNNNGUUUUAGAGCUAUGCUGUUUUG-3'   (SEQ ID NO: 39)
S. thermophilus  5'-NNNNNNNNNNNNNNNNNNNNGUUUUAGAGCUGUGUUGUUUCG-3'   (SEQ ID NO: 45)
                    *******************   *****  *

S. pyogenes      5'-GAACCAUUCAAAACAGCAUAGCAAGUUAAAAUAAGGC-UAGUCCGUUAUCAACUUGAAAAAGUGGCACCGAGUCGGUGCUUUUUUU-3' (SEQ ID NO: 47)
S. thermophilus  5'-------GGGCGAAACAACAACACAGGCGAGUUAAAAUAAGGCUUAGUCCGUACUCAACUUGAAAAGGUGGCACCGAUUCGGUGUUUUU---3' (SEQ ID NO: 46)
                           * ***   * *************** *****  *************** ***** **

FIG. 1G (SEQ ID NO: 42)

CLUSTAL format alignment by MAFFT (v7.058b)

```
SM      MKKPYSIGLDIGTNSVGWAVITDDYKVPAKKMKVLGNTDKSHIEKNLLGALLFDSGMTAED
SP      MDKKYSIGLDIGTNSVGWAVITDEYKVPSKKFKVLGNTDRHSIKKNLIGALLFDSGETAEA
ST      MTKPYSIGLDIGTNSVGWAVITDNYKVPSKKMKVLGNTSKKYIKNLLGVLLFDSGITAEG
LI      MKKPYTTGLDIGTNSVGWAVITDQYDLVKRKMKIAGDSEKKQIKGFWGVRLFDEGQTAAD
        *:****  ********** :    ::***:    ::*::  *:   *** *  **
Motif:  M-K-Y*IGLDIGTNSVGWAV-TD-Y-*-*K*K*-G*****-I*KN*-G--LFD-G-TA--

SM      RRLKRTARRRYTRRRNRILYLQEIFSEEMGKVDDSFFHRLEDSFLVTEDKRGERHPIFGN
SP      TRLKRTARRRYTRRKNRICYLQEIFSNEMAKVDDSFFHRLEESFLVEEDKKHERHPIFGN
ST      RRLKRTARRRYTRRRNRILYLQEIFSTEMATLDDAFFQRLDDSFLVPDDKRDSKYPIFGN
LI      RRMARTARRPIERRRNRISYLQGIFAEEMSKTDANFFCRLSDSFYVDMEKRNSRHPFFAT
        *: *****  *:*::*** :**  * :  *:  ..*  **  **.  :  .    *  
Motif:  -R*-RTARRR--RP*NRI-YLQ-IF*-EM---D--FF-RL--SF-V-**K*-*P*F--

SM      LEEEVKYHERFPTIYHLRQYLADNPEKVDLRLVYLALAHIIKFRGHFLIEGKFDTRNMDV
SP      IVDEVAYHEKYPTIYHLRKKLVDSTDKADLRLIYLALAHMIKFRGHFLIEGDLANPDMSDV
ST      LVEEKAYHDEFPTIYHLRKYLADSTKKADLRLVYLALAHMIKYRGHFLIEGEFNSKDMDI
LI      IEEEVEYHKNYPTIYHLREELVNSSEKADLRLVYLALAHIIKYRGNFLIEGALDTQNTSV
        : :*  *E--YH-**PTIYHLR*-L-*---K-DLRL*YLALAH*IK*RGNFLIEG-**-*
Motif:  *-*E--YH-**PTIYHLR*-L-*---K-DLRL*YLALAH*IK*RGNFLIEG-**--N--*
```

FIG. 2A

```
SM      QRLFQEFLAVYDNTFENSS------LQEQNVQVEEILTDKISKSAKKDRVLKLFPNEKSN
SP      DKLFIQLVQTYNQLFEENP------INASGVDAKAILSARLSKSRRLENLIAQLPGEKKN
ST      QKNFQDFLDTYNAIFESDL------SLENSKQLEEIVKDKISKLEKKDRILKLFPGEKNS
LI      DGIYKQFIQTYNQVFASGIEDGSLKKLEDNKDVAKILVEKVTRKEKLERILKLYPGEKSA
         :  : ::: .*:  *  ..         ..  :   *:   ::::   :  :.::    *.**.
Motif:  *--*-***--Y*--f----------------*---I*--****--*-*-**---P-EK--

SM      GRPAEFLKLIVGNQADFKKHPELEEKAPLQFSKDTYEEELEVLLAQIGDNYAELFLSAKK
SP      GLFGNLIALSLGLTPNFKSNFDLAEDAKLQLSKDTYDDDLDNLLAQIGDQYADLFLAAKN
ST      GIFSEFLKLIVGNQADFRKCFNLDEKASLHFSKESYDEDLETLLGYIGDDYSDVPLKAKK
LI      GNFAQFISLIVGSKGNFQKPFDLIEKSDIECAKDSYEEDLESLLALIGDEYAELFVAAKN
         * *.::;  *  :*     :*:.  *:*  *.:  :. :*::*:::*;  **. ***:*:::*;  **;
Motif:  G-F-***-L-*G---*F---*L-E-*-*---KY*L*-LL--IGD*Y***F*-AK*

SM      LYDSILLSGILTVTDVGTKAPLSASMIQRYNEHQMDLAQLKQFIRQKLSDKYNEVFSDVS
SP      LSDAILLSDILRVNTEITKAPLSASMIKRYDEHHQDLTLLKALVRQQLPEKYKEIFFDQS
ST      LYDAILLSGFLTVTDNETEAPLSSAMIKRYNEHKEDLALLKEYIRNISLKTYNEVFKDDT
LI      AYSAVVLSSIITVAETETNAKLSASMIERFDTHEEDLGELKAFIKLHLPKHYEEIFSNTE
         .:::**.::  *   *:*  **::**:*::  *.  **  **   ::    . *:*:*  :
Motif:  ---****LS-**-V----T*A-LS**MI*R**-H--DL--LK--**------Y*E*F-*--

SM      KDGYAGYIDGKTNQEAFYKYLKGLLNKIEGSGYFLDKIEREDFLRKQRTFDNGSIPHQIH
SP      KNGYAGYIDGGASQEEFYKFIKPILEKMDGTEELLVKLNREDLLRKQRTFDNGSIPHQIH
ST      KNGYAGYIDGKTNQEDFYVYLKKLLAEFEGADYFLEKIDREDFLRKQRTFDNGSIPYQIH
LI      KNGYAGYIDGKTKQADFYKYMKNTLENIEGADYPIAKIEKENFLRKQRTFDNGAIPHQLH
        *.********  :.*   **  **  ::*   *  :::*:   ::  *:::******** :**;*:*
Motif:  K-GYAGYIDG-*-Q--FY-K--L-*G*----K*E**LRKQRTFDNG*IP*Q*H
```

FIG. 2B

```
SM      LQEMRAIIRRQAEFYPFLADNQDRIEKLLTFRIPYYVGPLARGKSDFAWLSRKSADKITP
SP      LGELHAILRRQEDFYPFLKDNREKIEKILTFRIPYYVGPLARGNSRFAWMTRKSEETITP
ST      LQEMRAILDKQAKFYPFLAKNKERIEKILTFRIPYYVGPLARGNSDFAWSIRKRNEKITP
LI      LEELEAILHQQAKYYPFLKENYDKIKSLVTFRIPYFVGPLANGQSEFAWLTRKADGEIRP
         * *:;**; :*  .:****  .*  ::*:.::*******;*****.*:*  ***   **      * *
Motif:  L-E*-AI*-*Q--*YPFL--N-**I*-**TFRIPY*VGPLA-G*S-FAW--RK----I-P SM      WNFDEIVDKESSAEAFINRMTNYDLYLPNQKVLPKHSLLYEKFTVYNELTKVKYKTE-QG
SP      WNFEEVVDKGASAQSFIERMTNFDKNLPNEKVLPKHSLLYEYFTVYNELTKVKYVTEGMR
ST      WNFEDVIDKESSAEAFINRMTSFDLYLPEEKVLPKHSLLYETFNVYNELTKVRFIAESMR
LI      WNIEEKVDFGKSAVDFIEKMTNKDTYLPKENVLPKHSLCYQKYLVYNELTKVRYIND-QG
        **:;;  :*     **    **:;**. *    **;;;*******  *;  ;  ********;;   :
Motif:  WN***-*D---SA--FI**MT--D--LP***VLPKHSL-Y*-*-VYNELTKV**--*---

SM      KTAFFDANMKQEIFDGVPKVYRKVTKDKLMDFLEKEFDEFRIVDLTGLDKENKVFNASYG
SP      KPAFLSGEQKKAIVDLLFKTNRKVTVKQLKEDYFKKIECFDSVEISGVEDR---FNASLG
ST      DYQFLDSKQKKDIVRLYFKDKRKVTDKDIIEYL-HAIYGYDGIELKGIEKQ---FNSSLS
LI      KTSYFSGQEKEQIFNDLFKQKRKVKKKDLELFL-RNMSHVESPTIEGLEDS---FNSSYS
          .  ;;..; *; *. ** ***. ..;     ;;          ; *;;.       **;* .
Motif:  ---*--*-K*-I----FK--RKV----*------*-*--------*-G**------FN*S--

SM      TYHDLCKIL-DKDFLDNSKNEKILEDIVLTLTLFEDREMIRKRLENYSDLLTKEQVKKLE
SP      TYHDLLKIIKDKDFLDNEENEDILEDIVLTLTLFEDREMIEERLKTYAHLFDDKVMKQLK
ST      TYHDLLNIIINDKEFLDDSSNEAIIEEIIHTLTIFEDREMIKQRLSKFENIFDKSVLKKLS
LI      TYHDLLKVGIKQEILDNPVNTEMLENIVKILTVFEDKRMIKEQLQQFSDVLDGVVLKKLE
        ***** ;;  .;;;**;   *   ;;*;*;   **;***;.**.;;*.  ;  .;;     ;*;*.
Motif:  TYHDL-**----***LD*--N--**E*I*--LT*FED*-MI-**L--*--**----*K*L-
```

```
SM      GNSDK--LIPRKTKFYWDTKKYGGFDSPIVAYSILVIADIEKGKSKLLKTVKALVGVTIM
SP      RMSDK--LIARKKD---WDPKKYGGFDSPTVAYSVLVVAKVEKGKSKLLSVKELLGITIM
ST      PNSNENLVGAKEY---LDPKKYGGYAGISNSFTVLVKGTIEKGAKKKITMVLEFQGISIL
LI      GNSSK--LIPRKTN---WDPMKYGGLDSPMMAYAVVI--EYAKGKN-KLVFEKKIRVTIM
        **.:  *:   *    :  ****  .*     .     :   :      :: :**:
Motif:  --NS---L*--*--K------D--KYGG----*-*******---*---KG---K*-----*--*--*I*

SM      EKMTFERDPVAFLERKGYRNVQEENIIKLPKYSLEKLELENGRKLLAS------ARELQK
SP      ERSSFEKMPIDFLEAKGYKEVKKDLIIKLPKYSLFELENGRKRMLAS-------AGELQK
ST      DRINYRIDKLNFLLEKGYKDI--ELIIELPKYSLFELSDGSRRMLASILSTNNKRGEIHK
LI      ERKAFEKDEKAFLEEQGYRQP--KVLAKLPKYTLYECEEGRRMLAS--------AMEAQK
         : :::   **  : ****   .  :  :*****:: .:   :*:***        * :*
Motif:  **-------*--*--*--FL--*GY*---*--*LPKY*L**--*G--*R*LAS------E--*K SM      GNEIVLPMHLGTLLYHAKNIHKV-----DEPKHLDYVDKHKDEFKELLDVVSNFSKKYT
SP      GNELALPSKYVMFLYLASHYEKLKGSPEDMEQKQL-FVEQHKHYLDEIIEQISEFSKRVI
ST      GNQIFLSQKFVKLLYHAKRISNT-----INEMHRKYVENHKKEFEELFYYILEFNENYV
LI      GMQQVLPMHLVTLLHHAAWCEVS-----DGKSLDYIESNREMFAELLAHVSEFAKRYT
        *:  :::  :  ** :::::: :        . :*::*:: : *.*   ::
Motif:  GM*---L*--*--A---------*L*--*-------------E---*-------*F--*---

SM      LAEGNLEKIKELYAQMNGEDLKELASSFI------NLLTFTAIGAPATFKFFDKMIDR
SP      LADAMLDKVLSAYNKHRDKPIREQAENII------HLFTLTNLGAPAAFKYFDTTIDR
ST      GAKKNGKLLMNSAFQSWQMHSIDELCSSFIGPTGSERKGLFELTSRGSAADFEFLGVKIPR
LI      LAEAMLNKINQLFEQMKEGDIKATAQSFV------DLMAPNAMGAPASFKFFETTIER
         * : :.*: : :    : .  : ::.*:       * :  :. .*:::*::*  :
Motif:  --A--M------*----*----*----*--**---------L*--*--G**-A-F***--I-R
```

FIG. 2F

```
SM      KR-YTSTTEILMATLIHQSITGLYETRIDLNKLGGD    (SEQ ID NO:1)
SP      KR-YTSTKEVLDATLIHQSITGLYETRIDLSQLGGD    (SEQ ID NO:2)
ST      YRDYTPSSLLKDATLIHQSVTGLYETRIDLAKLGEG    (SEQ ID NO:4)
LI      KR-YNNLKELLNSTIYQSITGLYESRKRLD----D     (SEQ ID NO:5)
         *  .  :  ::  ::***:*******:*:  *

Motif:  -R-Y-----*-**T*I-QS*TGLYE*R--L------    (SEQ ID NO:14)
```

FIG. 2G

Alignment of the N terminal RuvC-like Domains disclosed in Chylinski et al.
(excluding sequence outliers).
(CLUSTAL format alignment by MAFFT (v7.058b))

```
1, 12   DIGTNSVGWAVT    (SEQ ID NO:120)
3, 20   DVGTNSVGWAVT    (SEQ ID NO:121)
15      DMGTNSVGWAVT    (SEQ ID NO:122)
4       DVGTSSVGWAVT    (SEQ ID NO:123)
7       DIGTASVGWAVT    (SEQ ID NO:52)
6       DVGTGSVGWAVT    (SEQ ID NO:53)
9       DIGTNSVGWAVV    (SEQ ID NO:54)
10      DIGTNSVGWAVI    (SEQ ID NO:55)
11      DIGTNSVGWAVL    (SEQ ID NO:56)
42      DLGTNSIGWAVL    (SEQ ID NO:57)
48      DLGTNSIGWAVV    (SEQ ID NO:58)
43      DLGTNSIGWAI-    (SEQ ID NO:59)
2       DLGTNSIGWALV    (SEQ ID NO:60)
14      DIGTNSVGWCVT    (SEQ ID NO:61)
5       DIGTNSVGYAVT    (SEQ ID NO:62)
16      DMGTGSLGWAVT    (SEQ ID NO:63)
8       DLGTSSVGWAAI    (SEQ ID NO:64)
22      DLGTGSVGWAVV    (SEQ ID NO:65)
23      DLGVGSVGWAIV    (SEQ ID NO:66)
24      DLGIASIGWAII    (SEQ ID NO:67)
25      DLGIASVGWAIV    (SEQ ID NO:68)
26      DLGVASVGWSIV    (SEQ ID NO:69)
28      DIGIASVGWAIL    (SEQ ID NO:70)
32      DLGISSVGMSVI    (SEQ ID NO:71)
33      DLGIASVGWSVI    (SEQ ID NO:72)
39      DWGISIGWAVI     (SEQ ID NO:73)
34      DLGVGSIGWAVI    (SEQ ID NO:74)
47      DLGVGSIGFAIV    (SEQ ID NO:75)
50      DTGTNSLGWAIV    (SEQ ID NO:76)
49      DLGTNSIGWCLL    (SEQ ID NO:77)
18      DIGTDSLGWAVF    (SEQ ID NO:78)
41      DIGSNSIGFAVV    (SEQ ID NO:79)
45      DLGVGSIGVAVA    (SEQ ID NO:80)
        DLGIASGWGVV
```

FIG. 3A

| | | |
|---|---|---|
| 21 | DLGIASVGWCLT | (SEQ ID NO:81) |
| 27 | DIGIGSVGVGIL | (SEQ ID NO:82) |
| 29 | DIGITSVGYGLI | (SEQ ID NO:83) |
| 30 | DIGITSVGFGII | (SEQ ID NO:84) |
| 31 | DVGITSTGYAVL | (SEQ ID NO:85) |
| 40 | DLGITSFGYAIL | (SEQ ID NO:86) |
| 17 | DIGNASVGWSAP | (SEQ ID NO:87) |
| 19 | DVGTNSCGWVAM | (SEQ ID NO:88) |
| 35 | DVGERSIGLAAV | (SEQ ID NO:89) |
| 36 | DVGLMSVGLAAV | (SEQ ID NO:90) |
| 37 | DVGLMSVGLAAI | (SEQ ID NO:91) |
| 38 | DVCTFSVGLAAI | (SEQ ID NO:92) |
| 13 | DICTGSVGYACM | (SEQ ID NO:92) |
| 44 | DLGTTSIGFAHI | (SEQ ID NO:94) |
| 46 | DLGTNSIGSSVR | (SEQ ID NO:95) |
| | * * * * | |

FIG. 3B

Alignment of the N terminal RuvC-like Domains disclosed in Chylinski et al.
(CLUSTAL format alignment by MAFFT (v7.058b))

```
1,12   D----IGTNSVGWAVT  (SEQ ID NO:120)
3,20   D----VGTNSVGWAVT  (SEQ ID NO:121)
15     D----MGTNSVGWAVT  (SEQ ID NO:122)
4      D----VGTSSVGWAVT  (SEQ ID NO:123)
7      D----IGTASVGWAVT  (SEQ ID NO:52)
6      D----VGTGSVGWAVT  (SEQ ID NO:53)
9      D----IGTNSVGWAVV  (SEQ ID NO:54)
10     D----IGTNSVGWAVI  (SEQ ID NO:55)
52     D----IGTNSVGWAVI  (SEQ ID NO:96)
11     D----IGTNSVGWAVL  (SEQ ID NO:56)
42     D----IGTNSVGWAVV  (SEQ ID NO:57)
48     D----LGTNSIGWAI-  (SEQ ID NO:58)
43     D----LGTNSIGWAIV  (SEQ ID NO:59)
2      D----IGTNSVGWCVI  (SEQ ID NO:60)
14     D----IGTNSVGIAVT  (SEQ ID NO:61)
5      D----MGTGSIGWAVT  (SEQ ID NO:62)
16     D----IGTSSVGWAAI  (SEQ ID NO:63)
8      D----LGTGSVGWAVV  (SEQ ID NO:64)
22     D----LGVGSVGWAIV  (SEQ ID NO:65)
23     D----LGIASIGWAII  (SEQ ID NO:66)
24     D----LGIASVGWAIV  (SEQ ID NO:67)
68     D----LGIASVGWAVV  (SEQ ID NO:97)
25     D----LGVASVGWSIV  (SEQ ID NO:68)
26     D----IGIASVGWAIL  (SEQ ID NO:69)
66     D----IGIASVGWAVL  (SEQ ID NO:98)
59     D----IGIASIGWAII  (SEQ ID NO:99)
61     D----IGIASVGWAII  (SEQ ID NO:100)
64     D----IGIASVGWAVI  (SEQ ID NO:101)
62     D----VGIASVGWAL-  (SEQ ID NO:102)
67     D----IGIASVGWAMV  (SEQ ID NO:103)
32     D----IGIASVGWSVI  (SEQ ID NO:71)
28     D----LGISSVGWSVI  (SEQ ID NO:70)
63     D----IGITSVGWAVI  (SEQ ID NO:104)
```

FIG. 4A

```
33   D-----VGIGSIGWAVI
57   D-----LGISSLGWAIV
39   D-----LGVGSIGFAIV
34   D-----IGYASIGWAVI
50   D-----LGTNSIGWCLL
54   D-----LGTNSIGWGLL
47   D-----TGTNSLGWAIV
49   D-----IGTDSLGWAVF
51   D-----LGSTSLGWAIP
58   D-----IGISSIGWAPS
21   D-----LGIASVGWCLT
45   D-----LGIASCGWGVV
18   D-----LGSNSIGFAVV
65   D-----IGTTSIGFSVI
29   D-----IGITSVGYGLI
30   D-----IGITSVGPGII
44   D-----LGTTSIGPAHI
27   D-----IGIGSVGVGIL
41   D-----LGVGSIGVAVA
31   D-----VGITSTGYAVL
40   D-----LGITSPGYAIL
53   D-----IGTSSIGWWLY
55   D-----LGSNSLGWFVT
56   D-----LGANSLGWFVV
17   D-----IGMASVGWNSAP
19   D-----VGTNSCGWVAM
35   D-----VGERSIGLAAV
36   D-----VGLNSVGLAAV
37   D-----VGLMSVGLAAI
38   D-----VGTFSVGLAAI
13   D-----IGTGSVGYACM
46   D-----LGTNSIGSSVR
60   DIGLRIGITSCGWSI-
69   D-----MGAKYTGVFYA
73   D-----LGGKNTGFFSF
74   D-----LGVKNTGVFSA
70   D-----LGAKFTGVALY
71   D-----LGGKFTGVCLS
72   D-----LGGTYTGTFIT
```

FIG. 4B

Alignment of the HNH-like Domains disclosed in Chylinski et al.
(CLUSTAL format alignment by MAFFT (v7.058b))

```
1   YDIDHIYPRS-LTKD------DSP-DMLVLCERTAN  (SEQ ID NO:196)
2   -DIDHIYPRSKVID------DSP-DMLVLVLKNEN  (SEQ ID NO:197)
3   -DRDHIYPQS-KIKD------DSI-DMLVLVNKTYN  (SEQ ID NO:198)
4   -DIDHIYPQS-KIKD------DSI-TNRVLVEKQIN  (SEQ ID NO:195)
6   -DIDHIYPQS-KIKD------DSI-SNRVLVCSSCN  (SEQ ID NO:124)
5   -DIDHIYPQS-KTMD------DSL-NNRVLVKDNYN  (SEQ ID NO:125)
7   -DQDHIYPKS-KIYD------DSL-ENRVLVKKNLN  (SEQ ID NO:126)
8   -QIDHIVPQS-LVKD------DSP-DMRVLVVPSEN  (SEQ ID NO:127)
9   -DIDHIIPQA-PIKD------NSI-DMRVLTSSKEN  (SEQ ID NO:128)
12  -DIDHIIPQA-FLKD------NSI-DMKVLVSSASN  (SEQ ID NO:129)
16  -DIDHIIPQA-YTKD------NSL-DMRVLVSNITN  (SEQ ID NO:130)
11  -DIDHIVPQS-FITD------NSI-DMLVLTSSAGN  (SEQ ID NO:131)
10  -DVDHIVPQS-FLKD------DSI-DMKVLTRSDKN  (SEQ ID NO:132)
14  -NIDHIYPOS-MVKD------DSL-DMKVLVQSEIN  (SEQ ID NO:133)
18  -DIDHILPQS-LIKD------DSL-DMRVLVNATIN  (SEQ ID NO:134)
19  -DIDHILPQS-PIKD------DSL-EMRVLVKKAVN  (SEQ ID NO:135)
13  -EVDHIIPRS-FIKD------DSI-DMKVLVIKKMN  (SEQ ID NO:136)
15  -EVDHIIPRS-YIKD------DSP-ENKVLVYREEN  (SEQ ID NO:137)
17  -DIDHIIPQA-VTQN------DSI-DMRVLVARAEN  (SEQ ID NO:138)
22  -EIDHIIPYS-ISPD------DSS-SNKLLVLABSN  (SEQ ID NO:139)
24  -EIDHIIPYS-LCPD------DSS-ANKVLVHKQSN  (SEQ ID NO:140)
32  -DIDHIIPYS-RSMD------DSY-SNKVLVLSGEN  (SEQ ID NO:141)
63  -DIDHIIPYS-KSMD------DSF-NNKVLCLABEN  (SEQ ID NO:142)
59  -DIDHIIPYS-RSMD------DSY-MNKVLVFTKQN  (SEQ ID NO:143)
65  -QIDHIYPYS-RSPD------DSY-MNKVLVLTDEN  (SEQ ID NO:144)
64  -EIDHIIPRS-RSPD------DSL-SNKILVLGSEN  (SEQ ID NO:145)
68  -EIDHIIPFS-RTMD------DSP-MNKVLVLABSN  (SEQ ID NO:146)
69  -EIDHALPFS-RTMD------DSP-MNKVLVLGSEN  (SEQ ID NO:147)
28  -EIDHIIPIS-ISLD------DSI-TNKVLVTHREN  (SEQ ID NO:148)
30  -EVDHIIPIS-ISLD------DSI-TNKVLVTHREN  (SEQ ID NO:149)
62  -QVDHALPYS-RSYD------DSK-NNKVLVLTHEN  (SEQ ID NO:150)
27  -EVDHILPLS-ITPD------DSL-ANKVLVVATAN  (SEQ ID NO:151)
26  -EIDHIIPRS-ISPD------DAR-SNKVLVYRSEN  (SEQ ID NO:152)
```

FIG. 5A

```
29  :EVDHILPRS-VSFD------NSY-HNKVLVKQSEN  (SEQ ID NO:153)
67  :DIDHILPYS-ITFD------DSP-RNKVLVTSQEN  (SEQ ID NO:154)
58  :EIDHILPRS-RSAD------DSP-ANKVLCLARAN  (SEQ ID NO:155)
51  :EIEHILPFS-LTLD------DSM-ANKTVCFRQAN  (SEQ ID NO:156)
55  :DIDHILPFS-VSLD------DSA-ANKVVCLREAN  (SEQ ID NO:157)
57  :DIDHILPFS-ISWD------DSA-ANKVVCMRYAN  (SEQ ID NO:158)
56  :DIDHILPVA-MTLD------DSP-ANKIIOMRYAN  (SEQ ID NO:159)
54  :DVDHILPYS-RTLD------DSP-PNRTLCLREAN  (SEQ ID NO:160)
52  :EIEHILPFS-RTLD------DSL-MNRTVAMRRAN  (SEQ ID NO:161)
31  :EVDHIIPYS-ISWD------DSY-TNKVLTSAKCN  (SEQ ID NO:162)
45  :QVDHILPWS-RPGD------DSY-LNKTLCTARSN  (SEQ ID NO:163)
53  :QVDHILPFS-KTLD------DSP-ANKVLAQHDAN  (SEQ ID NO:164)
60  :QIDHAPPLS-RSLD------DSQ-SNKVLCITSSN  (SEQ ID NO:165)
21  :DIDHIVPRS-ISPD------DSP-SNLIVNKLDN   (SEQ ID NO:166)
23  :EIEHIIPYS-MSYD------NSQ-ANKILTEKAEN  (SEQ ID NO:167)
25  :EIDHVIPYS-KSAD------DSW-FNKLLVKKSTN  (SEQ ID NO:168)
49  :EMDHILPYS-RSLD------NGW-HNRVLVHGKDN  (SEQ ID NO:169)
33  :EVDHIVPYS-LILD------NTI-MNKALVYAEEN  (SEQ ID NO:170)
42  :EIEHIVPQS-LYFD------DSP-SNKVICEAEVN  (SEQ ID NO:171)
43  :DIEHIVPQA-RLFD------DSP-SNKTLEARSVN  (SEQ ID NO:172)
44  :EIEHIVPKA-RVFD------DSP-SNKTLTFHRIN  (SEQ ID NO:173)
20  :DKDHIIPQS-MKKD------DSIMNLVLVNKNAN   (SEQ ID NO:174)
66  :EVEHIWPRS-RSPD------NSD-RNKTLCRKDVN  (SEQ ID NO:175)
61  :IVNHIIPIN-RSPD------DTY-HNRVLTLTETK  (SEQ ID NO:176)
46  :DMEHIIPKS-ISPD------NSD-QMLTLCESYYN  (SEQ ID NO:177)
47  :DIEHIIPRS-AGGD------STK-MNLUTLCSSRFN (SEQ ID NO:178)
48  :DIEHTIPRS-ISQD------NSQ-MNKTLCSLKFN  (SEQ ID NO:179)
50  :DIDHVIPLA-RGGR------DSL-DNMVLCQSDAN  (SEQ ID NO:180)
39  :DIEHIPPIA-ESED------NGR-MNLVISHSACN  (SEQ ID NO:181)
41  :DVDHIVPRD-DTAD------NSY-GNKVVAHRQCN  (SEQ ID NO:182)
40  :DIEHIVPQS-LGGL------STD-YNTIVTLKSVN  (SEQ ID NO:183)
35  :ELDHIVPRT-DCGS------NRH-ENLAITCGACN  (SEQ ID NO:184)
36  :EMDHIVPRKGVGST------NTR-TNFAAVCAECN  (SEQ ID NO:185)
37  :EMDHIVPRKGVGST------NTR-VNLAAACAACN  (SEQ ID NO:186)
38  :EMDHIVPRAGQGST------NTR-ENLVAVCHRCN  (SEQ ID NO:187)
70  :EIDHIIPRS-LIKDARGIVFMAE-PMLIYASSRGN  (SEQ ID NO:188)
71  :ELDHIIPRS-LTGRTKKTVPNSE-ANLIYCSSKGN  (SEQ ID NO:189)
73  :EIDHIIPRS-LTLKKSESIYNSE-VNLIFVSAQGN  (SEQ ID NO:190)
```

FIG. 5B

```
72  -EIDHIYPRS-LSKKHPGVIFNSE-VNLIYCSSQGN  (SEQ ID NO:191)
74  -EIDHILPRS-HTLKIYGTVPNPE-GNLIYVHQKCN  (SEQ ID NO:192)
75  -ELDHIIPRS-HKKY---GTLNDE-ANLICVTRGDN  (SEQ ID NO:193)
34  -BLEHIVPHS-PRQS-------NAL--SSLVLTWPGVN  (SEQ ID NO:194)
         :*        *              :
```

FIG. 5C

Alignment of the HNH-like Domains disclosed in Chylinski et al. (excluding sequence outliers). (CLUSTAL format alignment by MAFFT (v7.058b))

```
1   YDIDHIYPRS-LTKDDS-FDMLVLCERTAN   (SEQ ID NO:196)
2   -DIDHIYPRSKVIKDDS-FDMLVLVLKNEN   (SEQ ID NO:197)
3   -DRDHIYPQS-KIKDDS-IDMLVLVNKTTN   (SEQ ID NO:198)
4   -DIDHIYPRS-KIKDDS-ITNRVLVBKDIN   (SEQ ID NO:195)
6   -DIDHIYPQS-KIKDDS-ISNRVLVCSSCN   (SEQ ID NO:124)
5   -DIDHIYPQS-KTMDDS-LNMRVLVKKNTN   (SEQ ID NO:125)
7   -DQDHIYPKS-KIYDDS-LENRVLVKKQLN   (SEQ ID NO:126)
8   -QIDHIVPQS-LVKDDS-FDMRVLVVPSEN   (SEQ ID NO:127)
9   -DIDHIIPQA-FIKDNS-IDMRVLTSSKEN   (SEQ ID NO:128)
12  -DIDHIIPQA-FLKDNS-IDMKVLVSSASN   (SEQ ID NO:129)
16  -DIDHIIPQA-YTKDNS-LDMRVLVSNITN   (SEQ ID NO:130)
11  -DIDHIVPQS-FITDNS-IDMLVLTSSAGN   (SEQ ID NO:131)
10  -DVDHIVPQS-FLKDDS-IDMKVLTRSDKN   (SEQ ID NO:132)
14  -NIDHIYPQS-MVKDDS-LDMKVLVQSEIN   (SEQ ID NO:133)
18  -DIDHIVPQS-LIKDDS-LDMKVLVMATIN   (SEQ ID NO:134)
19  -DIDHILPQS-FIKDDS-LENRVLVMKAVN   (SEQ ID NO:135)
13  -EVDHIIPRS-FIKDDS-LDMKVLVIKKMN   (SEQ ID NO:136)
15  -EVDHIIPRS-YIKDDS-FEMKVLVYREEN   (SEQ ID NO:137)
17  -DIDHIIPQA-VTQNDS-IDMKVLVARAEN   (SEQ ID NO:138)
21  -DIDHIIPRS-ISFDDS-FSNLJVIVMKLDN  (SEQ ID NO:166)
22  -EIDHIIPYS-ISFDDS-SSMKLIVTLAESN  (SEQ ID NO:139)
24  -EIDHIIPYS-LCFDDS-SAMKVLVHKQSN   (SEQ ID NO:140)
28  -EIDHIIPIS-ISLDDS-INMKVLVLSKAN   (SEQ ID NO:148)
20  -EVDHIIPIS-ISLDDS-ITNKVLVTHREN   (SEQ ID NO:149)
27  -EVDHIIPLS-ITFDDS-LANKVLVYATAN   (SEQ ID NO:151)
26  -EIDHIIPRS-ISFDDA-RSMKVLVTRSEN   (SEQ ID NO:152)
29  -EVDHIIPRS-VSPDNS-YHMKVLVKQSEN   (SEQ ID NO:153)
31  -EVDHIIPYS-ISWDDS-YTNKVLTSAKCN   (SEQ ID NO:162)
32  -EIDHIIPYS-LILDNT-INMKALVYAEEN   (SEQ ID NO:141)
23  -EIEHIIPYS-MSYDNS-QANKILTEKAEN   (SEQ ID NO:167)
33  -EVDHIVPYS-LILDNT-INMKALVYAEEN   (SEQ ID NO:170)
25  -EIDHVIPYS-KSADDS-WFMKLLVKKSTN   (SEQ ID NO:168)
49  -EMDHIIPYS-RSLDNG-WHNRVLVHGKDN   (SEQ ID NO:169)
42  -EIEHVIPQS-LYFDDS-FSMKVICEAEVN   (SEQ ID NO:171)
43  -DIEHIIPQA-RLFDDS-PSMKTLEARSVN   (SEQ ID NO:172)
```

FIG. 6A

| | | |
|---|---|---|
| 44 | -EIEHIVPKA-RVFDDS-FSNKTLTFHRIN | (SEQ ID NO:173) |
| 20 | -DKDHIIPQS-MKKDDSIINNLVLVNKNAN | (SEQ ID NO:174) |
| 45 | -QVDHILPWS-RFGDDS-YLNKTLCTARSN | (SEQ ID NO:163) |
| 50 | -DIDHVIPLA-RGGRDS-LDNMVLCQSDAN | (SEQ ID NO:180) |
| 46 | -DMEHTIPKS-ISFDNS-DQNLTLCESYYN | (SEQ ID NO:177) |
| 47 | -DIEHTIPRS-AGGDST-KMNLTLCSSRFN | (SEQ ID NO:178) |
| 48 | -DIEHTIPRS-ISQDNS-QMNKTLCSLKFN | (SEQ ID NO:179) |
| 39 | -DIEHLFPIA-ESEDNG-RNNLVISHSACN | (SEQ ID NO:181) |
| 41 | -DVDHIFPRD-DTADNS-YGNKVVAHRQCN | (SEQ ID NO:182) |
| 40 | -DIEHIVPQS-LGGLST-DYNTIVTLKSVN | (SEQ ID NO:183) |
| 35 | -ELDHIVPRT-DGGSNR-HENLAITCGACN | (SEQ ID NO:184) |
| 36 | -EMDHIVPRKGVGSTNT-RTNFAAVCAECN | (SEQ ID NO:185) |
| 37 | -EMDHIVPRKGVGSTNT-RVNLAAACAACN | (SEQ ID NO:186) |
| 38 | -EMDHIVPRAGQGSTNT-RENLVAVCHRCN | (SEQ ID NO:187) |
| 34 | -ELEHIVPHS-FRQSNA-LSSLVLTWPGVN | (SEQ ID NO:194) |

FIG. 6B

CRISPR/CAS-RELATED METHODS AND COMPOSITIONS FOR TREATING HERPES SIMPLEX VIRUS

CROSS-REFERENCES TO RELATED APPLICATIONS

This application is a Continuation of International Patent Application No. PCT/US16/59502, filed Oct. 28, 2016, which claims priority to U.S. Provisional Application No. 62/249,071, filed Oct. 30, 2015 and U.S. Provisional Application No. 62/249,159, filed Oct. 30, 2015, the contents of each of which are hereby incorporated by reference in their entirety herein, and to each of which priority is claimed.

STATEMENT OF GOVERNMENT INTEREST

This invention was made with government support under Grant No. 1R43AI120302-01 awarded by the National Institutes of Health. The government has certain rights in the invention.

SEQUENCE LISTING

The present specification makes reference to a Sequence Listing (submitted electronically as a .txt file named "0841770175SL.txt" on Apr. 30, 2018). The 0841770175SL.txt file was generated on Apr. 30, 2018 and is 11,189,371 bytes in size. The entire contents of the Sequence Listing are hereby incorporated by reference.

FIELD OF THE INVENTION

The disclosure relates to CRISPR/CAS-related methods, compositions and genome editing systems for editing of a target nucleic acid sequence, e.g., editing a RS1, RL2, and/or LAT gene, and applications thereof in connection with herpes simplex virus (HSV).

BACKGROUND

Herpes simplex virus (HSV), e.g., herpes simplex virus type 1 (HSV-1) and herpes simplex virus type 2 (HSV-2), is a ubiquitous and highly contagious pathogen. HSV-1 generally causes intermittent, painful blistering of the mouth and mucous membranes. HSV-2 generally causes intermittent, painful blistering in the genital region. HSV can cause lifelong, recurring bouts of viral reactivity.

The majority of the population develops HSV-1 infection during childhood. By adulthood, up to 80% of the population in the U.S. is infected with HSV-1. New HSV-1 infections occur at a rate of 1.6 cases per 100 person years (Langenberg et al., 1999; New England Journal of Medicine 341:1432-1438). The most severe manifestations of HSV-1 infection include, e.g., keratitis, encephalitis, and meningitis.

More than 500 million people are infected with HSV-2 worldwide. Up to 23 million individuals are infected for the first time each year. In the U.S., approximately 1 in 5 adults is seropositive for HSV-2 infection (Xu et al., Abstract 739 in 42nd Annual Meeting of the Infectious Diseases Society of America; Sep. 30, 2004). The incidence of HSV-2 is increasing: since 1976, there has been a 30% increase in the presence of HSV-2 seropositivity in adults in the U.S. (Fleming et al., New England Journal of Medicine 1997; 337:1105-11). Infection with HSV-2 increases the risk of acquiring HIV infection, especially among patients with active lesions.

Infection with HSV-1 and/or HSV-2 is permanent. After initial infection with HSV-1 or HSV-2, the virus establishes latent infection that lasts for the lifetime of the host. Initial infection with HSV-1 generally causes painful blistering of the mucous membranes of the mouth, including the lips, mouth and nose. HSV-1 initial infection less commonly affects the anogenital region, causing painful blistering of the mucous membranes of the genital and anal region. Initial infection with HSV-2 generally causes painful blistering of the mucous membranes of the anogenital region. HSV-2 initial infection less commonly affects the mouth, causing painful blistering of the mucous membranes of the lips, mouth and nose.

After initial infection, HSV-1 and HSV-2 establish latent infection in all subjects. Following establishment of latent infection, reactivation of HSV-1 or HSV-2 can occur at any point during the lifetime of the subject. Reactivation of HSV-1 or HSV-2 is more likely to occur in the elderly and in immunocompromised individuals, including in those who have cancer, those who have HIV/AIDs and in those who have undergone solid organ or hematopoietic stem cell transplant.

HSV-1 and HSV-2 both cause ocular herpes. Historically, HSV-1 has been the causative agent in the majority of ocular herpes infections. However, HSV-2 related ocular infections have been increasing in incidence worldwide over the recent years.

Ocular infection with HSV-1 or HSV-2 can affect the epithelium of the eye, causing keratitis. Keratitis is the most common form of ocular herpes. HSV-related keratitis is the most common cause of infectious blindness in the developed world (Dawson et. al., Suvey of Ophthalmology 1976; 21(2): 121-135). Worldwide, there are approximately 1.5 million cases of HSV-related ophthalmologic disease and 40,000 cases of HSV-related blindness or severe monocular visual impairment annually (Krawczyk et. al., Public Library of Science One 2015; 10(1): e0116800. Farooq and Shukla 2012; Survey of Ophthalmology 57(5): 448-462). The incidence of ocular HSV infection appears to be increasing in the U.S. (Liesegang et al. 1989, Archives of Ophthalmology 107:1155-1159. Baratz et al. 2009, Investigations in Ophthalmologic Visual Science 50 e-abstract5044). There are 15.6 cases of epithelial keratitis per 100,000 person-years, or approximately 50,000 cases per year in the U.S. (Farooq and Shukla 2012; Survey of Ophthalmology 57(5): 448-462).

Ocular herpes may also affect the retina, causing retinitis. HSV-related retinitis occurs less frequently than HSV-related keratitis but carries a much greater risk of permanent visual damage. HSV-related retinitis most often affects adults and can cause acute retinal necrosis (ARN). ARN causes permanent visual damage in more than 50% of subjects (Roy et al., Ocular Immunology and Inflammation 2014; 22(3):170-174).

Newborns are a population at particular risk for developing severe HSV-1 and HSV-2 infections. The disease is transmitted from the mother to the fetus during childbirth. The chance of maternal-fetal transmission is highest in cases where the mother developed primary HSV-1 or HSV-2 infection during pregnancy. The incidence of neonatal herpes is approximately 4-30 per 100,000 births (Brown Z A, et al., 2003; Journal of the American Medical Association; 289(2): 203-209. Dinh T-H, et al., 2008; Sexually Transmitted Disease; 35(1): 19-21). Neonates may develop severe HSV-related keratitis, retinitis, encephalitis and/or meningitis. Neonatal ocular herpes can result in immediate, permanent vision loss. Ocular HSV puts neonates at risk for later developing ARN. There are no curative or preventative treatments for HSV-1 or HSV-2. Therapy is primarily given during acute infection. Primary HSV-1 or HSV-2 infections can be treated with antiviral therapy, including acyclovir, valacyclovir and famciclovir. These therapies may reduce viral shedding, decrease pain and improve healing time of lesions. Re-activated, latent infections may resolve without treatment (may be self-limiting) or may be treated with anti-viral therapy. Antiviral therapy may be given prophylactically in certain situations, including during childbirth in a mother with a recent HSV-1 or HSV-2 infection or reactivation.

Vaccines are in development for the prevention of HSV-1 and HSV-2 infections. However, in controlled clinical trials, vaccination efficacy has been limited. A recent vaccine for both HSV-1 and HSV-2 infections was only 35% effective in preventing HSV-1 infections (Belshe et al., 2012; New England Journal of Medicine 366(1): 34-43).

Despite advances in antiretroviral therapies, there remains a need for the treatment, prevention and/or reduction of HSV-1 and HSV-2 infections, particularly the treatment, prevention and/or reduction of HSV-1 and HSV-2 associated ocular infections, including keratitis and retinitis. A therapy that can cure, prevent, or treat HSV-1 and HSV-2 ocular infections would be superior to the current standard of care.

SUMMARY OF THE DISCLOSURE

Methods, genome editing systems, and compositions discussed herein provide for the treatment, prevention and/or reduction of herpes simplex virus (HSV) infections, e.g., ocular infections.

Methods, genome editing systems, and compositions discussed herein can be used to provide for treatment, prevention and/or reduction of herpes simplex virus ocular infections, including ocular infections caused by herpes simplex type 1 (HSV-1) and/or herpes simplex type 2 (HSV-2), or symptoms thereof, e.g., by altering (e.g., knocking out and/or knocking down) one or more of the HSV-1 or HSV-2 viral genes, e.g., by knocking out and/or knocking down one, two, or three of RS1, RL2, and/or LAT gene(s). RL2 comprises an open chromatin region, which is associated with the LAT gene and regulation of HSV-1 virus gene expression during latency, reactivation, and lytic infection (J. Gen. Virol. 2008 January; 89(Pt 1): 68-77).

Methods, genome editing systems, and compositions discussed herein provide for treatment, prevention and/or reduction of herpes simplex virus ocular infections, including ocular infections caused by HSV-1 and/or HSV-2, or its symptoms thereof, by knocking out the RS1, RL2, and/or LAT gene(s). Methods, genome editing systems, and compositions discussed herein provide for treatment, prevention and/or reduction of herpes simplex virus ocular infections, including ocular infections caused by HSV-1 and/or HSV-2, or its symptoms thereof, by knocking down the RS1, RL2, and/or LAT gene(s). Methods, genome editing systems, and compositions discussed herein provide for treatment, prevention and/or reduction of herpes simplex virus ocular infections, including ocular infections caused by HSV-1 and/or HSV-2, or its symptoms thereof, by concomitantly knocking out and knocking down the RS1, RL2, and/or LAT gene(s).

Methods, genome editing systems, and compositions discussed herein provide for treatment, prevention and/or reduction of herpes simplex virus (HSV) ocular infections, including ocular infections caused by HSV-1 and/or HSV-2, or its symptoms thereof, by alteration of one or more positions within the RS1, RL2, or LAT gene leading to its destruction and/or elimination from infected cells.

In one aspect, methods, genome editing systems, and compositions discussed herein may be used to alter, e.g., knock out or knock down expression of, one, two, or three of RS1, RL2, and/or LAT gene(s) to treat, prevent and/or reduce HSV-1 or HSV-2 infections by targeting the gene, e.g., the non-coding or coding regions of the gene.

In certain embodiments, the coding sequence, e.g., a coding region (also referred to as coding sequence herein), of one, two, or three of RS1, RL2, and/or LAT gene(s), is targeted for alteration and knock out and/or knock down of expression. In certain embodiments, the coding region is an early coding region, e.g., one, two, or three of RS1, RL2, and/or LAT gene(s). For example, and not by way of limitation, the methods, genome editing systems, and compositions discussed herein are used to alter one, two, or three of RS1, RL2, and/or LAT gene(s) to treat, prevent and/or reduce HSV-1 or HSV-2 infections by targeting a coding sequence, e.g., an intronic or exonic sequence, of one, two, or three of RS1, RL2, and/or LAT gene(s). In certain embodiments, the gene, e.g., the coding sequence of one, two, or three of RS1, RL2, and/or LAT gene(s), are targeted to knockout and/or knock down one, two, or three of RS1, RL2, and/or LAT gene(s), e.g., to eliminate expression of one, two, or three of RS1, RL2, and/or LAT gene(s); and/or to knockout one or more copies of one, two, or three of RS1, RL2, and/or LAT gene(s), e.g., by introduction of an alteration comprising a mutation (e.g., an insertion or deletion) in one, two, or three of RS1, RL2, and/or LAT gene(s). In certain embodiments, the methods, genome editing systems, and compositions provides an alteration that comprises an insertion or deletion in one, two, or three of RS1, RL2, and/or LAT gene(s).

In certain embodiments, an early coding sequence of one, two, or three of RS1, RL2, and/or LAT gene(s) is targeted to knockout or knockdown one, two, or three of RS1, RL2, and/or LAT gene(s). In certain embodiments, targeting affects one or more copies of the RS1, RL2, and/or LAT gene(s). In certain embodiments, a targeted knockout or targeted knockdown approach reduces or eliminates expression of one, two, or all functional RS1, RL2, and/or LAT gene product(s). In certain embodiments, the methods, genome editing systems, and compositions provide an alteration that comprises an insertion or deletion in one, two, or three of RS1, RL2, and/or LAT gene(s).

In another aspect, the methods, genome editing systems, and compositions the RS1, RL2, and/or LAT gene(s), e.g., a promoter, an enhancer, an intron, 5' UTR, 3'UTR, polyadenylation signal and/or an open chromatin region. In certain embodiments, the gene, e.g., the non-coding sequence of the RS1, RL2, and/or LAT gene(s), is targeted to knock out the gene, e.g., to eliminate expression of the gene, e.g., to knock out one or more copies of the RS1, RL2, and/or LAT gene(s), e.g., by induction of an alteration comprising a mutation (e.g., an insertion or deletion) in the RS1, RL2, and/or LAT gene(s). In certain embodiments, the methods, genome editing systems, and compositions provide an alteration that comprises an insertion or deletion in the RS1, RL2, and/or LAT gene(s).

In certain embodiments, altering (e.g., knocking out or knocking down) the RS1 gene refers to (1) reducing or eliminating RS1 gene expression, (2) interfering with the activity and/or function of the protein that is encoded by the RS1 gene, Transcriptional regulator ICP4, or (3) reducing or eliminating the intracellular, serum and/or intra-parenchymal levels of Transcriptional regulator ICP4 protein.

In certain embodiments, altering (e.g., knocking out or knocking down) the RL2 gene refers to (1) reducing or eliminating RL2 gene expression, (2) interfering with activity and/or function of ICP0 protein, which is encoded by the RL2 gene, and/or (3) reducing or eliminating the intracellular, serum and/or intra-parenchymal levels of ICP0 protein.

In certain embodiments, altering (e.g., knocking out or knocking down) the LAT gene refers to (1) reducing or eliminating LAT gene expression, (2) interfering with activity and/or function of the protein that is encoded by the LAT gene, and/or (3) reducing or eliminating the intracellular, serum and/or intra-parenchymal levels of the protein that is encoded by the LAT gene.

In certain embodiments, the methods, genome editing systems, and compositions of the present disclosure provide an alteration that comprises disrupting the RS1, RL2, and/or LAT gene(s) by the insertion or deletion of one or more nucleotides mediated by a Cas9 molecule (e.g., enzymatically active Cas9 (eaCas9), e.g., Cas9 nuclease or Cas9 nickase) or Cas9-fusion protein as described below. This type of alteration is also referred to as "knocking out" the RS1, RL2, and/or LAT gene(s). In certain embodiments, knocking out the RS1, RL2, and/or LAT gene(s) comprises knocking out one or more copies of the RS1, RL2, and/or LAT gene(s), e.g., by introduction of an alteration comprising a mutation (e.g., an insertion or deletion) in the RS1, RL2, and/or LAT gene(s). In certain embodiments, the alteration comprises an insertion or deletion in the RS1, RL2, and/or LAT gene(s). In certain embodiments, a targeted knockout approach is mediated by non-homologous end joining (NHEJ), e.g., using a CRISPR/Cas system comprising a Cas9 molecule (e.g., an eaCas9 molecule) or a Cas9-fusion protein. In certain embodiments, the Cas9 molecule or Cas9-fusion protein is a Cas9 variant, e.g., a *S. pyogenes* Cas9 variant or a *S. aureus* Cas9 variant. In certain embodiments, the *S. pyogenes* Cas9 variant is the EQR variant. In certain embodiments, the *S. pyogenes* Cas9 variant is the VRER variant. In certain embodiments, a targeted knockout approach reduces or eliminates expression of a functional RL2 gene product. In certain embodiments, a targeted knockout approach reduces or eliminates expression of a functional LAT gene product. In certain embodiments, a targeted knockout approach reduces or eliminates expression of a functional RS1 gene product.

In certain embodiments, the methods, genome editing systems, and compositions of the present disclosure provide an alteration of the expression of the RS1, RL2, and/or LAT gene(s) that does not comprise nucleotide insertion or deletion in the RS1, RL2, and/or LAT gene(s). This type of alteration is also referred to as "knocking down" the expression of the RS1, RL2, and/or LAT gene(s). In certain embodiments, this approach gives rise to a reduction, decrease, repression, or elimination of the expression of the RS1, RL2, and/or LAT gene(s). In certain embodiments, a targeted knockdown approach is mediated by a CRISPR/Cas system comprising a Cas9 molecule (e.g., an enzymatically inactive Cas9 (eiCas9) molecule) or a Cas9-fusion protein (e.g., an eiCas9 fusion protein (e.g., an eiCas9 fused to a transcription repressor domain or chromatin modifying protein)) to alter transcription (e.g., to block, reduce, or decrease transcription) of the RS1, RL2, and/or LAT gene(s). In certain embodiments, a non-coding region (e.g., an enhancer region, a promoter region, 5' UTR, 3'UTR, polyadenylation signal and/or open chromatin region) of the RS1, RL2, and/or LAT gene(s) is targeted to alter the expression of the RS1, RL2, and/or LAT gene(s). In certain embodiments, the open chromatin region of the RL2 gene is targeted to alter the expression of the RL2 gene. In certain embodiments, a transcriptional regulatory region, e.g., a promoter region (e.g., a promoter region that controls the transcription of the RS1, RL2, and/or LAT gene(s)) is targeted to alter (e.g., knockdown) the expression of the RS1, RL2, and/or LAT gene(s). In certain embodiments, one or more gRNA molecules comprise a targeting domain are configured to target an eiCas9 molecule or an eiCas9 fusion protein sufficiently close to the transcriptional regulatory region, e.g., a promoter region (e.g., a promoter region that controls the transcription of the RS1, RL2, and/or LAT gene(s)) to reduce, decrease or repress expression of the RS1, RL2, and/or LAT gene(s). In certain embodiments, the coding region of the RL2 gene is targeted to alter (e.g., knockdown) the expression of the RL2 gene. In certain embodiments, the coding region of the RS1 gene is targeted to alter (e.g., knocking down) the expression of the RS1 gene. In certain embodiments, the coding region of the LATgene is targeted to alter (e.g., knockdown) the expression of the LAT gene. In certain embodiments, the eiCas9 molecule is a Cas9 variant, e.g., a *S. pyogenes* Cas9 variant or a *S. aureus* Cas9 variant. In certain embodiments, the *S. pyogenes* Cas9 variant is the EQR variant. In certain embodiments, the *S. pyogenes* Cas9 variant is the VRER variant In certain embodiments, a targeted knockdown approach reduces or eliminates expression of a functional RL2 gene product. In certain embodiments, a targeted knockdown approach reduces or eliminates expression of a functional LAT gene product. In certain embodiments, a targeted knockdown approach reduces or eliminates expression of a functional RS1 gene product.

In certain embodiments, knocking down the RS1, RL2, and/or LAT gene(s) cures HSV infections. In certain embodiments, the knocking down the R RS1, RL2, and/or LAT gene(s) provide a functional cure of HSV infections. In certain embodiments, knocking down the RS1, RL2, and/or LAT gene(s) leads to a sustained virologic response to HSV infections.

In certain embodiments, a region of the RS1, RL2, and/or LAT gene(s) that is known to be integrated into the subject genome is targeted for knockdown. In certain embodiments, a region of the RS1, RL2, and/or LAT gene(s) that is known not to be integrated into the subject genome is targeted for knockout. In certain embodiments, the method comprises knocking out a region of the RS1, RL2, and/or LAT gene(s) that is not integrated into the subject genome.

Knockout, knockdown, and concomitant knockout and knockdown of the RS1, RL2, and/or LAT gene(s) can reduce HSV infectivity, replication, packaging and can therefore treat, prevent and/or reduce HSV infection. Knockout, knockdown, and concomitant knockout and knockdown of the expression of the RS1, RL2, and/or LAT gene(s) may cause any of the following, singly or in combination: decreased HSV DNA production, decreased viral infectivity, decreased packaging of viral particles, decreased viral shedding, and/or decreased production of viral proteins encoded by the RS1, RL2, and/or LAT gene(s), e.g., ICP0 and/or ICP4 proteins. In certain embodiments, the method comprises concomitant 1) knocking out and 2) knocking down of two distinct regions of the RS1, RL2, and/or LAT gene, e.g., 1) knocking down of a region of the RS1, RL2, or LAT gene that is integrated into the subject genome and 2) knocking out of a different region of the RS1, RL2, or LAT gene that is not integrated into the subject genome.

The presently disclosed subject matter provides a genome editing system comprising: a gRNA molecule comprising a targeting domain that is complementary with a target sequence of a Herpes simplex virus (HSV) viral gene selected from the group consisting of a RS1 gene, a RL2 gene, and a LAT gene; and a Cas9 molecule. In certain embodiments, the targeting domain is configured to form a double strand break or a single strand break within about 500 bp, about 450 bp, about 400 bp, about 350 bp, about 300 bp, about 250 bp, about 200 bp, about 150 bp, about 100 bp, about 50 bp, about 25 bp, or about 10 bp of an HSV target position, thereby altering said HSV viral gene. In certain embodiments, altering said HSV viral gene comprises knockout of said HSV viral gene, knockdown of said HSV viral gene, or concomitant knockout and knockdown of said HSV viral gene.

In certain embodiments, the targeting domain is configured to target a coding region or a non-coding region of the HSV viral gene, wherein the non-coding region comprises a promoter region, an enhancer region, an intron, the 3' UTR, the 5' UTR, or a polyadenylation signal region of said HSV viral gene; and said coding region comprises an early coding region of said HSV viral gene.

In certain embodiments, the targeting domain comprises a nucleotide sequence that is identical to, or differs by no more than 3 nucleotides from, a nucleotide sequence selected from SEQ ID NOS: 208 to 58749.

In certain embodiments, the Cas9 molecule is an S. pyogenes Cas9 molecule, said genome editing system knocks out the HSV-1 RS1 gene, and the targeting domain comprises a nucleotide sequence that is identical to, or differs by no more than 3 nucleotides from, a nucleotide sequence selected from the group consisting of: SEQ ID NOS: 208 to 2509.

In certain embodiments, the Cas9 molecule is an S. pyogenes Cas9 molecule, said genome editing system knocks out the HSV-2 RS1 gene, and said targeting domain comprises a nucleotide sequence that is identical to, or differs by no more than 3 nucleotides from, a nucleotide sequence selected from the group consisting of: SEQ ID NOS: 7098 to 9292.

In certain embodiments, the Cas9 molecule is an S. pyogenes Cas9 molecule, said genome editing system knocks out said HSV-1 RL2 gene, and said targeting domain comprises a nucleotide sequence that is identical to, or differs by no more than 3 nucleotides from, a nucleotide sequence selected from the group consisting of: SEQ ID NOS: 21324 to 22744.

In certain embodiments, the Cas9 molecule is an S. pyogenes Cas9 molecule, said genome editing system knocks out said HSV-2 RL2 gene, and said targeting domain comprises a nucleotide sequence that is identical to, or differs by no more than 3 nucleotides from, a nucleotide sequence selected from the group consisting of: SEQ ID NOS: 26613 to 28037.

In certain embodiments, the Cas9 molecule is an S. pyogenes Cas9 molecule, said genome editing system knocks out said HSV-1 LAT gene, and said targeting domain comprises a nucleotide sequence that is identical to, or differs by no more than 3 nucleotides from, a nucleotide sequence selected from the group consisting of: SEQ ID NOS: 31730 to 32746.

In certain embodiments, the Cas9 molecule is an S. pyogenes Cas9 molecule, said genome editing system knocks out said HSV-2 LAT gene, and said targeting domain comprises a nucleotide sequence that is identical to, or differs by no more than 3 nucleotides from, a nucleotide sequence selected from the group consisting of: SEQ ID NOS: 35617 to 36926.

In certain embodiments, the Cas9 molecule is an S. aureus Cas9 molecule, said genome editing system knocks out said HSV-1 RS1 gene, and said targeting domain comprises a nucleotide sequence that is identical to, or differs by no more than 3 nucleotides from, a nucleotide sequence selected from the group consisting of: SEQ ID NOS: 2510 to 7073.

In certain embodiments, the Cas9 molecule is an S. aureus Cas9 molecule, said genome editing system knocks out said HSV-2 RS1 gene, and said targeting domain comprises a nucleotide sequence that is identical to, or differs by no more than 3 nucleotides from, a nucleotide sequence selected from the group consisting of: SEQ ID NOS: 9293 to 13614.

In certain embodiments, the Cas9 molecule is an S. aureus Cas9 molecule, said genome editing system knocks out said HSV-1 RL2 gene, and said targeting domain comprises a nucleotide sequence that is identical to, or differs by no more than 3 nucleotides from, a nucleotide sequence selected from the group consisting of: SEQ ID NOS: 22745 to 26601.

In certain embodiments, the Cas9 molecule is an S. aureus Cas9 molecule, said genome editing system knocks out said HSV-2 RL2 gene, and said targeting domain comprises a nucleotide sequence that is identical to, or differs by no more than 3 nucleotides from, a nucleotide sequence selected from the group consisting of: SEQ ID NOS: 28038 to 31720.

In certain embodiments, the Cas9 molecule is an S. aureus Cas9 molecule, said genome editing system knocks out said HSV-1 LAT gene, and said targeting domain comprises a nucleotide sequence that is identical to, or differs by no more than 3 nucleotides from, a nucleotide sequence selected from the group consisting of: SEQ ID NOS: 32747 to 35600.

In certain embodiments, the Cas9 molecule is an S. aureus Cas9 molecule, said genome editing system knocks out said HSV-2 LAT gene, and said targeting domain comprises a nucleotide sequence that is identical to, or differs by no more than 3 nucleotides from, a nucleotide sequence selected from the group consisting of: SEQ ID NOS: 36927 to 40871.

In certain embodiments, the Cas9 molecule is an S. pyogenes Cas9 molecule, said genome editing system knocks down said HSV-1 RS1 gene, and said targeting domain comprises a nucleotide sequence that is identical to, or differs by no more than 3 nucleotides from, a nucleotide sequence selected from the group consisting of: SEQ ID NOS: 13637 to 14794.

In certain embodiments, the Cas9 molecule is an S. pyogenes Cas9 molecule, said genome editing system knocks down said HSV-2 RS1 gene, and said targeting domain comprises a nucleotide sequence that is identical to, or differs by no more than 3 nucleotides from, a nucleotide sequence selected from the group consisting of: SEQ ID NOS: 17753 to 18784.

In certain embodiments, the Cas9 molecule is an S. pyogenes Cas9 molecule, said genome editing system knocks down said HSV-1 RL2 gene, and said targeting domain comprises a nucleotide sequence that is identical to, or differs by no more than 3 nucleotides from, a nucleotide sequence selected from the group consisting of: SEQ ID NOS: 40886 to 42078.

In certain embodiments, the Cas9 molecule is an S. pyogenes Cas9 molecule, said genome editing system knocks down said HSV-2 RL2 gene, and said targeting domain comprises a nucleotide sequence that is identical to, or differs by no more than 3 nucleotides from, a nucleotide sequence selected from the group consisting of: SEQ ID NOS: 49498 to 50652.

In certain embodiments, the Cas9 molecule is an *S. pyogenes* Cas9 molecule, said genome editing system knocks down said HSV-1 LAT gene, and said targeting domain comprises a nucleotide sequence that is identical to, or differs by no more than 3 nucleotides from, a nucleotide sequence selected from the group consisting of: SEQ ID NOS: 45340 to 46479.

In certain embodiments, the Cas9 molecule is an *S. pyogenes* Cas9 molecule, said genome editing system knocks down said HSV-2 LAT gene, and said targeting domain comprises a nucleotide sequence that is identical to, or differs by no more than 3 nucleotides from, a nucleotide sequence selected from the group consisting of: SEQ ID NOS: 53858 to 55056.

In certain embodiments, the Cas9 molecule is an *S. aureus* Cas9 molecule, said genome editing system knocks down said HSV-1 RS1 gene, and said targeting domain comprises a nucleotide sequence that is identical to, or differs by no more than 3 nucleotides from, a nucleotide sequence selected from the group consisting of: SEQ ID NOS: 14795 to 17741.

In certain embodiments, the Cas9 molecule is an *S. aureus* Cas9 molecule, said genome editing system knocks down said HSV-2 RS1 gene, and said targeting domain comprises a nucleotide sequence that is identical to, or differs by no more than 3 nucleotides from, a nucleotide sequence selected from the group consisting of: SEQ ID NOS: 18785 to 21311.

In certain embodiments, the Cas9 molecule is an *S. aureus* Cas9 molecule, said genome editing system knocks down said HSV-1 RL2 gene, and said targeting domain comprises a nucleotide sequence that is identical to, or differs by no more than 3 nucleotides from, a nucleotide sequence selected from the group consisting of: SEQ ID NOS: 42079 to 45315.

In certain embodiments, the Cas9 molecule is an *S. aureus* Cas9 molecule, said genome editing system knocks down said HSV-2 RL2 gene, and said targeting domain comprises a nucleotide sequence that is identical to, or differs by no more than 3 nucleotides from, a nucleotide sequence selected from the group consisting of: SEQ ID NOS: 50653 to 53824.

In certain embodiments, the Cas9 molecule is an *S. aureus* Cas9 molecule, said genome editing system knocks down said HSV-1 LAT gene, and said targeting domain comprises a nucleotide sequence that is identical to, or differs by no more than 3 nucleotides from, a nucleotide sequence selected from the group consisting of: SEQ ID NOS: 46480 to 49479.

In certain embodiments, the Cas9 molecule is an *S. aureus* Cas9 molecule, said genome editing system knocks down said HSV-2 LAT gene, and said targeting domain comprises a nucleotide sequence that is identical to, or differs by no more than 3 nucleotides from, a nucleotide sequence selected from the group consisting of: SEQ ID NOS: 55057 to 58731.

In certain embodiments, the *S. pyogenes* Cas9 molecule recognizes a Protospacer Adjacent Motif (PAM) of NGG.

In certain embodiments, the *S. aureus* Cas9 molecule recognizes a PAM of either NNGRRT (SEQ ID NO: 204) or NNGRRV (SEQ ID NO: 205).

The presently disclosed subject matter provides a gRNA molecule, e.g., an isolated or non-naturally occurring gRNA molecule, comprising a targeting domain which is complementary to a target domain (also referred to as "target sequence") of a RS1, RL2, or LAT gene. The presently disclosed subject matter provides a composition comprising such gRNA molecule. Furthermore, the presently disclosed subject matter provides a vector comprising such gRNA molecule. In addition, the presently disclosed subject matter provides cells comprising a presently disclosed genome editing system, vector, or composition. In certain embodiments, the cell is selected from the group consisting of an epithelial cell, a neuronal cell, and an optic cell.

In certain embodiments, the targeting domain of the gRNA molecule is configured to provide a cleavage event, e.g., a double strand break or a single strand break, sufficiently close to an HSV RS1 target position, an HSV RL2 target position, or an HSV LAT target position to allow an alteration, e.g., an alteration associated with NHEJ, of an HSV RS1 target position, an HSV RL2 target position, or an HSV LAT target position. In certain embodiments, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150 or 200 nucleotides of an HSV RS1 target position, an HSV RL2 target position, or an HSV LAT target position. The break, e.g., a double strand or single strand break, can be positioned upstream or downstream of an HSV RS1 target position, an HSV RL2 target position, or an HSV LAT target position. In certain embodiments, the targeting domain of the gRNA molecule is configured to provide a cleavage event selected from a double strand break and a single strand break, within 500 (e.g., within 500, 400, 300, 250, 200, 150, 100, 80, 60, 40, 20, or 10) nucleotides of an HSV RS1 target position, an HSV RL2 target position, or an HSV LAT target position.

In certain embodiments, a second gRNA molecule comprising a second targeting domain is configured to provide a cleavage event, e.g., a double strand break or a single strand break, sufficiently close to an HSV RS1 target position, an HSV RL2 target position, or an HSV LAT target position, to allow alteration, e.g., alteration associated with NHEJ, of an HSV RS1 target position, an HSV RL2 target position, or an HSV LAT target position, either alone or in combination with the break positioned by the first gRNA molecule. In certain embodiments, the targeting domains of the first and second gRNA molecules are configured such that a cleavage event, e.g., a double strand or single strand break, is positioned, independently for each of the gRNA molecules, within 1, 2, 3, 4, 5, 10, 15, 20, 25, 30, 35, 40, 45, 50, 60, 70, 80, 90, 100, 150 or 200 nucleotides of the target position. In certain embodiments, the breaks, e.g., double strand or single strand breaks, are positioned on both sides of an HSV RS1 target position, an HSV RL2 target position, or an HSV LAT target position. In certain embodiments, the breaks, e.g., double strand or single strand breaks, are positioned on one side, e.g., upstream or downstream, of an HSV RS1 target position, an HSV RL2 target position, or an HSV LAT target position. In certain embodiments, the targeting domain of the first and/or second gRNA molecule is configured to provide a cleavage event selected from a double strand break and a single strand break, within 500 (e.g., within 500, 400, 300, 250, 200, 150, 100, 80, 60, 40, 20, or 10) nucleotides of an an HSV RS1 target position, an HSV RL2 target position, or an HSV LAT target position.

In certain embodiments, a single strand break is accompanied by an additional single strand break, positioned by a second gRNA molecule, as discussed below. For example, the targeting domains are configured such that a cleavage event, e.g., the two single strand breaks, are positioned within 1, 2, 3, 4, 5, 10, 15, 20, 25, 30, 35, 40, 45, 50, 60, 70, 80, 90, 100, 150 or 200 nucleotides of an HSV RS1 target position, an HSV RL2 target position, or an HSV LAT target position. In certain embodiments, the first and second gRNA molecules are configured such, that when guiding a Cas9 molecule or Cas9-fusion protein, e.g., a Cas9 nickase, a single strand break is accompanied by an additional single strand break, positioned by a second gRNA molecule, sufficiently close to one another to result in alteration of an HSV RS1 target position, an HSV RL2 target position, or an HSV LAT target position. In certain embodiments, the first and second gRNA molecules are configured such that a single strand break positioned by the second gRNA is within 10, 20, 30, 40, or 50 nucleotides of the break positioned by the first gRNA molecule, e.g., when the Cas9 molecule or Cas9-fusion protein is a nickase. In certain embodiments, the two gRNA molecules are configured to position cuts at the same position, or within a few nucleotides of one another, on different strands, e.g., essentially mimicking a double strand break.

In certain embodiments, a double strand break can be accompanied by an additional double strand break, positioned by a second gRNA molecule, as is discussed below. For example, the targeting domain of a first gRNA molecule is configured such that a double strand break is positioned upstream of an HSV RS1 target position, an HSV RL2 target position, or an HSV LAT target position, e.g., within 1, 2, 3, 4, 5, 10, 15, 20, 25, 30, 35, 40, 45, 50, 60, 70, 80, 90, 100, 150 or 200 nucleotides of the target position; and the targeting domain of a second gRNA molecule is configured such that a double strand break is positioned downstream of an HSV RS1 target position, an HSV RL2 target position, or an HSV LAT target position, e.g., within 1, 2, 3, 4, 5, 10, 15, 20, 25, 30, 35, 40, 45, 50, 60, 70, 80, 90, 100, 150 or 200 nucleotides of the target position.

In certain embodiments, a double strand break can be accompanied by two additional single strand breaks, positioned by a second gRNA molecule and a third gRNA molecule. For example, the targeting domain of a first gRNA molecule is configured such that a double strand break is positioned upstream of an HSV RS1 target position, an HSV RL2 target position, or an HSV LAT target position, e.g., within 1, 2, 3, 4, 5, 10, 15, 20, 25, 30, 35, 40, 45, 50, 60, 70, 80, 90, 100, 150 or 200 nucleotides of the target position; and the targeting domains of a second and third gRNA molecule are configured such that two single strand breaks are positioned downstream of an HSV RL2 target position or HSV LAT target position or HSV RS1 target position, e.g., within 1, 2, 3, 4, 5, 10, 15, 20, 25, 30, 35, 40, 45, 50, 60, 70, 80, 90, 100, 150 or 200 nucleotides of the target position.

In certain embodiments, the targeting domain of the first, second and third gRNA molecules are configured such that a cleavage event, e.g., a double strand or single strand break, is positioned, independently for each of the gRNA molecules.

In certain embodiments, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of an HSV RS1 target position, an HSV RL2 target position, or an HSV LAT target position, e.g., within 1, 2, 3, 4, 5, 10, 15, 20, 25, 30, 35, 40, 45, 50, 60, 70, 80, 90, 100, 150 or 200 nucleotides of the target position; and the targeting domains of a third and fourth gRNA molecule are configured such that two single strand breaks are positioned downstream of an HSV RS1 target position, an HSV RL2 target position, or an HSV LAT target position, e.g., within 1, 2, 3, 4, 5, 10, 15, 20, 25, 30, 35, 40, 45, 50, 60, 70, 80, 90, 100, 150 or 200 nucleotides of the target position. In certain embodiments, the targeting domain of the first, second, third, and/or fourth gRNA molecule is configured to provide a cleavage event selected from a double strand break and a single strand break, within 500 (e.g., within 500, 400, 300, 250, 200, 150, 100, 80, 60, 40, 20, or 10) nucleotides of an HSV RS1 target position, an HSV RL2 target position, or an HSV LAT target position.

In certain embodiments, when multiple gRNAs are used to generate (1) two single stranded breaks in close proximity, (2) two double stranded breaks, e.g., flanking an HSV RS1 target position, an HSV RL2 target position, or an HSV LAT target position (e.g., to remove a piece of DNA, e.g., to create a deletion mutation) or to create more than one indel in the gene, e.g., in a coding region, e.g., an early coding region, (3) one double stranded break and two paired nicks flanking an HSV RS1 target position, an HSV RL2 target position, or an HSV LAT target position (e.g., to remove a piece of DNA, e.g., to insert a deletion) or (4) four single stranded breaks, two on each side of a position, that they are targeting the same HSV RL2 target position or HSV LAT target position or HSV RS1 target position. In certain embodiments, multiple gRNAs may be used to target more than one HSV RS1 target position, HSV RL2 target position, or HSV LAT target position.

In certain embodiments, the targeting domain of the first gRNA molecule and the targeting domain of the second gRNA molecules are complementary to opposite strands of the target nucleic acid molecule. In certain embodiments, the gRNA molecule and the second gRNA molecule are configured such that the PAMs are oriented outward.

In certain embodiments, the targeting domain of a gRNA molecule is configured to avoid unwanted target chromosome elements, including, but not limited to, repeat elements, e.g., Alu repeats, in the target domain. The gRNA molecule may be a first, second, third and/or fourth gRNA molecule, as described herein.

In certain embodiments, the targeting domain of a gRNA molecule is configured to position a cleavage event sufficiently far from a preselected nucleotide, e.g., the nucleotide of a coding region, such that the nucleotide is not altered. In certain embodiments, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In certain embodiments, the targeting domain of a gRNA molecule targeting an HSV1 RS1 target knockout position comprises a nucleotide sequence that is identical to, or differs by no more than 1, no more than 2, no more than 3, no more than 4, or no more than 5 nucleotides from, a nucleotide sequence selected from SEQ ID NOS: 208 to 2509 and 2510 to 7073.

In certain embodiments, the targeting domain of a gRNA molecule targeting an HSV2 RS1 target knockout position comprises a nucleotide sequence that is identical to, or differs by no more than 1, no more than 2, no more than 3, no more than 4, or no more than 5 nucleotides from, a nucleotide sequence selected from SEQ ID NOS: 7098 to 9292 and 9293 to 13614.

In certain embodiments, the targeting domain of a gRNA molecule targeting an HSV1 RL2 target knockout position comprises a nucleotide sequence that is identical to, or differs by no more than 1, no more than 2, no more than 3, no more than 4, or no more than 5 nucleotides from, a nucleotide sequence selected from SEQ ID NOS: 21324 to 22744 and 22745 to 26601.

In certain embodiments, the targeting domain of a gRNA molecule targeting an HSV2 RL2 target knockout position comprises a nucleotide sequence that is identical to, or differs by no more than 1, no more than 2, no more than 3, no more than 4, or no more than 5 nucleotides from, a nucleotide sequence selected from SEQ ID NOS: 26613 to 28037 and 28038 to 31720.

In certain embodiments, the targeting domain of a gRNA molecule targeting an HSV1 LAT target knockout position comprises a nucleotide sequence that is identical to, or differs by no more than 1, no more than 2, no more than 3, no more than 4, or no more than 5 nucleotides from, a nucleotide sequence selected from SEQ ID NOS: 31730 to 32746 and 32747 to 35600.

In certain embodiments, the targeting domain of a gRNA molecule targeting an HSV2 LAT target knockout position comprises a nucleotide sequence that is identical to, or differs by no more than 1, no more than 2, no more than 3, no more than 4, or no more than 5 nucleotides from, a nucleotide sequence selected from SEQ ID NOS: 35617 to 36926 and 36927 to 40871.

In certain embodiments, the targeting domain of a gRNA molecule targeting an HSV1 RS1 target knockdown position comprises a nucleotide sequence that is identical to, or differs by no more than 1, no more than 2, no more than 3, no more than 4, or no more than 5 nucleotides from, a nucleotide sequence selected from SEQ ID NOS: 13637 to 14794 and 14795 to 17741.

In certain embodiments, the targeting domain of a gRNA molecule targeting an HSV2 RS1 target knockdown position comprises a nucleotide sequence that is identical to, or differs by no more than 1, no more than 2, no more than 3, no more than 4, or no more than 5 nucleotides from, a nucleotide sequence selected from SEQ ID NOS: 17753 to 18784 and 18785 to 21311.

In certain embodiments, the targeting domain of a gRNA molecule targeting an HSV1 RL2 target knockdown position comprises a nucleotide sequence that is identical to, or differs by no more than 1, no more than 2, no more than 3, no more than 4, or no more than 5 nucleotides from, a nucleotide sequence selected from SEQ ID NOS: 40886 to 42078 and 42079 to 45315.

In certain embodiments, the targeting domain of a gRNA molecule targeting an HSV2 RL2 target knockdown position comprises a nucleotide sequence that is identical to, or differs by no more than 1, no more than 2, no more than 3, no more than 4, or no more than 5 nucleotides from, a nucleotide sequence selected from SEQ ID NOS: 49498 to 50652 and 50653 to 53824.

In certain embodiments, the targeting domain of a gRNA molecule targeting an HSV1 LAT target knockdown position comprises a nucleotide sequence that is identical to, or differs by no more than 1, no more than 2, no more than 3, no more than 4, or no more than 5 nucleotides from, a nucleotide sequence selected from SEQ ID NOS: 45340 to 46479 and 46480 to 49479.

In certain embodiments, the targeting domain of a gRNA molecule targeting an HSV2 LAT target knockdown position comprises a nucleotide sequence that is identical to, or differs by no more than 1, no more than 2, no more than 3, no more than 4, or no more than 5 nucleotides from, a nucleotide sequence selected from SEQ ID NOS: 53858 to 55056 and 55057 to 58731.

In certain embodiments, the gRNA molecule is a unimolecular or chimeric gRNA molecule.

In certain embodiments, the targeting domain of a presently disclosed gRNA molecule is 16, 17, 18, 19, 20, 21, 22, 23, 24, 25 or 26 nucleotides in length.

In certain embodiments, the gRNA molecule comprises from 5' to 3': a targeting domain (comprising a "core domain", and optionally a "secondary domain"); a first complementarity domain; a linking domain; a second complementarity domain; and a proximal domain. In certain embodiments, the gRNA molecule further comprises a tail domain. In certain embodiments, the proximal domain and tail domain are taken together as a single domain.

In certain embodiments, a gRNA molecule comprises a linking domain of no more than 25 nucleotides in length; a proximal and tail domain, that taken together, are at least 20, 30, 35, or 40 nucleotides in length; and a targeting domain equal to or greater than 16, 17, 18, 19, 20, 21, 22, 23, 24, 25 or 26 nucleotides in length.

A cleavage event, e.g., a double strand or single strand break, can be generated by a Cas9 molecule or Cas9-fusion protein. The Cas9 molecule or Cas9-fusion protein may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule). In certain embodiments, the eaCas9 molecule can be a Cas9 variant. For example, and not by way of limitation, the Cas9 variant can be a *S. pyogenes* Cas9 variant or a *S. aureus* Cas9 variant. In certain embodiments, the *S. pyogenes* Cas9 variant is the EQR variant. In certain embodiments, the *S. pyogenes* Cas9 variant is the VRER variant. In addition to Cas9 molecules or Cas9-fusion proteins, other nucleases, disclosed herein, can be used to generate a cleavage event.

In certain embodiments, the eaCas9 molecule or eaCas9-fusion protein catalyzes a double strand break.

In certain embodiments, the eaCas9 molecule or eaCas9-fusion protein comprises HNH-like domain cleavage activity but has no, or no significant, N-terminal RuvC-like domain cleavage activity. In this case, the eaCas9 molecule or eaCas9-fusion protein is an HNH-like domain nickase, e.g., the eaCas9 molecule or eaCas9-fusion protein comprises a mutation at D10, e.g., D10A. In certain embodiments, the eaCas9 molecule or eaCas9-fusion protein comprises N-terminal RuvC-like domain cleavage activity but has no, or no significant, HNH-like domain cleavage activity. In certain embodiments, the eaCas9 molecule or eaCas9-fusion protein is an N-terminal RuvC-like domain nickase, e.g., the eaCas9 molecule comprises a mutation at H840, e.g., H840A. In certain embodiments, the eaCas9 molecule or eaCas9-fusion protein is an N-terminal RuvC-like domain nickase, e.g., the eaCas9 molecule or eaCas9-fusion protein comprises a mutation at N863, e.g., N863A.

In certain embodiments, a single strand break is formed in the strand of the target nucleic acid to which the targeting domain of the gRNA molecule is complementary. In certain embodiments, a single strand break is formed in the strand of the target nucleic acid other than the strand to which the targeting domain of the gRNA molecule is complementary.

Furthermore, the presently disclosed subject matter provides a nucleic acid composition, e.g., an isolated or non-naturally occurring nucleic acid composition, e.g., DNA, that comprises (a) a first nucleotide sequence that encodes a presently disclosed gRNA molecule, e.g., a gRNA molecule comprising a targeting domain that is complementary with a target sequence of a RS1, RL2, or LAT gene, e.g., at an HSV RS1 target position, an HSV RL2 target position, or an HSV LAT target position.

In certain embodiments, the nucleic acid composition further comprises (b) a second nucleotide sequence that encodes a Cas9 molecule or Cas9-fusion protein as described herein. In certain embodiments, the Cas9 molecule is an eiCas9 molecule. In certain embodiments, the Cas9 molecule is an eaCas9 molecule. In certain embodiments, the Cas9 molecule, e.g., an eiCas9 molecule or an eaCas9 molecule, can be a Cas9 variant, e.g., an *S. pyogenes* Cas9 variant or an *S. aureus* Cas9 variant.

The Cas9 molecule or Cas9-fusion protein may be a nickase molecule, an enzymatically activating Cas9 (eaCas9) molecule or eaCas9-fusion protein, e.g., an eaCas9 molecule or eaCas9-fusion protein that forms a double strand break in a target nucleic acid and/or an eaCas9 molecule or eaCas9-fusion protein that forms a single strand break in a target nucleic acid. In certain embodiments, a single strand break is formed in the strand of the target nucleic acid to which the targeting domain of the gRNA molecule is complementary. In certain embodiments, a single strand break is formed in the strand of the target nucleic acid other than the strand to which to which the targeting domain of said gRNA molecule is complementary.

In certain embodiments, the nucleic acid composition further comprise (c)(i) a third nucleotide sequence that encodes a second gRNA molecule described herein having a targeting domain that is complementary to a second target sequence of the RS1, RL2, or LAT gene, and optionally, (c)(ii) a sequence that encodes a third gRNA molecule described herein having a targeting domain that is complementary to a third target sequence of the RS1, RL2, or LAT gene; and optionally, (c)(iii) a sequence that encodes a fourth gRNA molecule described herein having a targeting domain that is complementary to a fourth target sequence of the RS1, RL2, or LAT gene. In certain embodiments, (a) and (b) are present on the same nucleic acid molecule, e.g., the same vector, e.g., the same viral vector, e.g., the same adeno-associated virus (AAV) vector or Lentiviral (LV) vector. In certain embodiments, the nucleic acid molecule is an LV vector. In certain embodiments, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector. In certain embodiments, the Cas9 molecule is an eiCas9 molecule. In certain embodiments, the Cas9 molecule is an eaCas9 molecule. In certain embodiments, the Cas9 molecule, e.g., an eiCas9 molecule or an eaCas9 molecule, can be a Cas9 variant, e.g., a *S. pyogenes* Cas9 variant or a *S. aureus* Cas9 variant.

In certain embodiments, (a) is present on a first nucleic acid molecule, e.g. a first vector, e.g., a first viral vector, e.g., a first AAV vector or a first LV vector; and (b) is present on a second nucleic acid molecule, e.g., a second vector, e.g., a second vector, e.g., a second AAV vector or a second LV vector. The first and second nucleic acid molecules may be AAV vectors. In certain embodiments, the first and second nucleic acid molecules can be LV vectors.

In certain embodiments, (a) and (c)(i) are present on one nucleic acid molecule, e.g., one vector, e.g., one viral vector, e.g., one AAV vector or LV vector. In certain embodiments, the nucleic acid molecule is an AAV vector. In certain embodiments, the nucleic acid molecule is an LV vector. In certain embodiments, (a) and (c)(i) are on different vectors.

In certain embodiments, (a) is present on a first nucleic acid molecule, e.g. a first vector, e.g., a first viral vector, e.g., a first AAV vector or LV vector; and (c)(i) is present on a second nucleic acid molecule, e.g., a second vector, e.g., a second vector, e.g., a second AAV vector or second LV vector. In certain embodiments, the first and second nucleic acid molecules are AAV vectors. In certain embodiments, the first and second nucleic acid molecules are LV vectors.

In certain embodiments, each of (a), (b), and (c)(i) are present on one nucleic acid molecule, e.g., one vector, e.g., one viral vector, e.g., an AAV vector or LV vector. In certain embodiments, the nucleic acid molecule is an AAV vector. In certain embodiments, the nucleic acid molecule is an LV vector. In certain embodiments, one of (a), (b), and (c)(i) is encoded on a first nucleic acid molecule, e.g., a first vector, e.g., a first viral vector, e.g., a first AAV vector or LV vector; and a second and third of (a), (b), and (c)(i) is encoded on a second nucleic acid molecule, e.g., a second vector, e.g., a second vector, e.g., a second AAV vector or LV vector. The first and second nucleic acid molecule may be AAV vectors or LV vectors.

In certain embodiments, (a) is present on a first nucleic acid molecule, e.g., a first vector, e.g., a first viral vector, a first AAV vector or LV vector; and (b) and (c)(i) are present on a second nucleic acid molecule, e.g., a second vector, e.g., a second vector, e.g., a second AAV vector or LV vector. The first and second nucleic acid molecule may be AAV vectors or LV vectors.

In certain embodiments, (b) is present on a first nucleic acid molecule, e.g., a first vector, e.g., a first viral vector, e.g., a first AAV vector or LV vector; and (a) and (c)(i) are present on a second nucleic acid molecule, e.g., a second vector, e.g., a second vector, e.g., a second AAV vector or LV vector. The first and second nucleic acid molecule may be AAV vectors or LV vectors.

In certain embodiments, (c)(i) is present on a first nucleic acid molecule, e.g., a first vector, e.g., a first viral vector, e.g., a first AAV vector or LV vector; and (b) and (a) are present on a second nucleic acid molecule, e.g., a second vector, e.g., a second vector, e.g., a second AAV vector or LV vector. The first and second nucleic acid molecule may be AAV vectors. In certain embodiments, the first and second nucleic acid molecule may be LV vectors.

In certain embodiments, each of (a), (b) and (c)(i) are present on different nucleic acid molecules, e.g., different vectors, e.g., different viral vectors, e.g., different AAV vector or LV vector. For example, (a) may be on a first nucleic acid molecule, (b) on a second nucleic acid molecule, and (c)(i) on a third nucleic acid molecule. The first, second and third nucleic acid molecules may be AAV vectors. In certain embodiments, the first, second and third nucleic acid molecules may be LV vectors.

In certain embodiments, when a third and/or fourth gRNA molecule are present, each of (a), (b), (c)(i), (c)(ii) and (c)(iii) may be present on one nucleic acid molecule, e.g., one vector, e.g., one viral vector, e.g., an AAV vector or LV vector. In certain embodiments, the nucleic acid molecule is an AAV vector. In certain embodiments, the nucleic acid molecule is an LV vector. In certain embodiments, each of (a), (b), (c)(i), (c)(ii) and (c)(iii) may be present on the different nucleic acid molecules, e.g., different vectors, e.g., the different viral vectors, e.g., different AAV vectors or different LV vectors. In a further embodiment, each of (a), (b), (c)(i), (c)(ii) and (c)(iii) may be present on more than one nucleic acid molecule, but fewer than five nucleic acid molecules, e.g., AAV vectors or LV vectors.

In certain embodiments, the second gRNA molecule is configured to provide a cleavage event, e.g., a double strand break or a single strand break, sufficiently close to an HSV RS1 target position, an HSV RL2 target position, or an HSV LAT target position, to allow alteration, e.g., alteration associated with NHEJ, of an HSV RS1 target position, an HSV RL2 target position, or an HSV LAT target position, either alone or in combination with the break positioned by the first gRNA molecule.

In certain embodiments, the third gRNA molecule is configured to provide a cleavage event, e.g., a double strand break or a single strand break, sufficiently close to an HSV RS1 target position, an HSV RL2 target position, or an HSV LAT target position to allow alteration, e.g., alteration associated with NHEJ, of an HSV RS1 target position, an HSV RL2 target position, or an HSV LAT target position, either alone or in combination with the break positioned by the first and/or second gRNA molecule.

In certain embodiments, the fourth gRNA molecule is configured to provide a cleavage event, e.g., a double strand break or a single strand break, sufficiently close to an HSV RS1 target position, an HSV RL2 target position, or an HSV LAT target position to allow alteration, e.g., an alteration associated with NHEJ, of an HSV RS1 target position, an HSV RL2 target position, or an HSV LAT target position, either alone or in combination with the break positioned by the first gRNA molecule, the second gRNA molecule and/or the third gRNA molecule.

In certain embodiments, the second gRNA is selected to target the same HSV RS1 target position, HSV RL2 target position, or HSV LAT target position as the first gRNA molecule. In certain embodiments, the third gRNA molecule and the fourth gRNA molecule are selected to target the same HSV RS1 target position, HSV RL2 target position, or HSV LAT target position as the first and second gRNA molecules.

The targeting domain of the second, third and fourth gRNA molecules can be independently selected from the nucleotide sequences set forth in SEQ ID NOS: 208 to 58749. The second, third or fourth gRNA molecules can be a modular gRNA molecule or a chimeric gRNA molecules.

One or more nucleic acids present within a nucleic acid composition and/or a nucleic acid composition described herein may comprise a promoter operably linked to the nucleotide sequence that encodes the gRNA molecule of (a), e.g., a promoter described herein. The nucleic acid and/or a nucleic acid composition may further comprise a second promoter operably linked to the nucleotide sequence that encodes the second, third and/or fourth gRNA molecule of (c), e.g., a promoter described herein. The promoter and second promoter differ from one another. In certain embodiments, the promoter and second promoter are the same.

The nucleic acid compositions described herein may further comprise a promoter operably linked to the nucleotide sequence that encodes the Cas9 molecule or a Cas9-fusion protein of (b), e.g., a promoter described herein.

The presently disclosed subject matter further provides a composition comprising (a) a presently disclosed gRNA molecule, e.g., a gRNA molecule comprising a targeting domain that is complementary with a target sequence of a RS1, RL2, or LAT gene. In certain embodiments, the composition further comprises (b) a Cas9 molecule (e.g., an eaCas9 molecule or an eiCas9 molecule) or a Cas9-fusion protein, as described herein. In certain embodiments, the Cas9 molecule, e.g., eaCas9 molecule or eiCas9 molecule, can be a Cas9 variant. For example, and not by way of limitation, the Cas9 variant can be a *S. pyogenes* Cas9 variant or an *S. aureus* Cas9 variant. In certain embodiments, the *S. pyogenes* Cas9 variant is the EQR variant. In certain embodiments, the *S. pyogenes* Cas9 variant is the VRER variant. In certain embodiments, the composition further comprises (c) a second, third and/or fourth gRNA molecule, e.g., a second, third and/or fourth gRNA molecule, as described herein. In certain embodiments, the composition is a pharmaceutical composition. The compositions described herein, e.g., pharmaceutical compositions described herein, can be used in treating, preventing, and/or reducing HSV-1 or HSV-2 infections in a subject, e.g., in accordance with a method disclosed herein.

The presently disclosed subject matter further provides a method of altering a HSV viral gene selected from the group consisting of a RS1 gene, a RL2 gene, and a LAT gene e in a cell, comprising administering to said cell one of:

(i) a genome editing system comprising a gRNA molecule comprising a targeting domain that is complementary with a target sequence of said HSV viral gene, and at least a Cas9 molecule;

(ii) a vector comprising a polynucleotide encoding a gRNA molecule comprising a targeting domain that is complementary with a target sequence of said HSV viral gene, and a polynucleotide encoding a Cas9 molecule; or (iii) a composition comprising a gRNA molecule comprising a targeting domain that that is complementary with a target sequence of said HSV viral gene, and at least a Cas9 molecule.

In another aspect, disclosed herein is a method of altering a RS1, RL2 or LAT gene a cell, e.g., altering the structure, e.g., altering the sequence, of a target nucleic acid of a cell, comprising contacting said cell with: (a) a presently disclosed gRNA molecule; and (b) a Cas9 molecule (e.g., an eaCas9 molecule) or a Cas9-fusion protein, e.g., a Cas9 molecule as described herein; and optionally, (c) a second, third and/or fourth gRNA molecule that targets the RS1, RL2 or LAT gene, e.g., a second, third and/or fourth gRNA molecule, as described herein. In certain embodiments, the Cas9 molecule can be a Cas9 variant.

In certain embodiments, the method comprises contacting a cell from a subject suffering from or likely to develop HSV-1 and/or HSV-2. The cell may be from a subject that would benefit from having a mutation at an HSV RS1 target position, an HSV RL2 target position, or an HSV LAT target position.

In certain embodiments, the contacting step may be performed in vivo.

In certain embodiments, the method of altering a cell as described herein comprises acquiring knowledge of the sequence of an HSV RS1 target position, an HSV RL2 target position, or an HSV LAT target position in said cell, prior to the contacting step. Acquiring knowledge of the sequence of an HSV RS1 target position, an HSV RL2 target position, or an HSV LAT target position in the cell may be by sequencing one or more of the RS1, RL2 or LAT gene, or a portion of the RS1, RL2 or LAT gene.

In certain embodiments, the contacting step of the method comprises contacting the cell with a nucleic acid composition, e.g., a vector, e.g., an AAV vector or LV vector, that expresses at least one of (a), (b), and (c). In certain embodiments, the contacting step of the method comprises contacting the cell with a nucleic acid composition, e.g., a vector, e.g., an AAV vector or an LV vector, that expresses each of (a), (b), and (c). In certain embodiments, the contacting step of the method comprises delivering to the cell a Cas9 molecule or a Cas9-fusion protein of (b) and a nucleic acid composition which encodes a gRNA molecule of (a) and optionally, a second gRNA molecule (c)(i), and further optionally, a third gRNA molecule (c)(ii) and/or fourth gRNA molecule (c)(iii).

In certain embodiments, the contacting step comprises contacting the cell with a nucleic acid composition, e.g., a vector, e.g., an AAV vector or LV vector, that expresses at least one of (a), (b), (c) and (d). In certain embodiments, the contacting step of the method comprises contacting the cell with a nucleic acid composition, e.g., a vector, e.g., an AAV vector, that expresses each of (a), (b), and (c). In certain embodiments, the contacting step of the method comprises delivering to the cell a Cas9 molecule or a Cas9-fusion protein of (b), a nucleic acid composition which encodes a gRNA molecule of (a) and a template nucleic acid of (d), and optionally, a second gRNA molecule (c)(i), and further optionally, a third gRNA molecule (c)(iv) and/or fourth gRNA molecule (c)(iii).

In certain embodiments, the contacting step comprises contacting the cell with a nucleic acid composition, e.g., a vector, e.g., an AAV vector, e.g., an AAV2 vector, a modified AAV2 vector, an AAV3 vector, a modified AAV3 vector, an AAV6 vector, a modified AAV6 vector, an AAV8 vector or an AAV9 vector, as described herein. In certain embodiments, the vector is an LV vector.

In certain embodiments, contacting comprises delivering to the cell a Cas9 molecule or a Cas9-fusion protein of (b), as a protein or an mRNA, and a nucleic acid composition which encodes a gRNA molecule of (a) and optionally a second, third and/or fourth gRNA molecule of (c).

In certain embodiments, the contacting step comprises delivering to the cell a Cas9 molecule or Cas9-fusion protein of (b), as a protein or an mRNA, said gRNA molecule of (a), as an RNA, and optionally said second, third and/or fourth gRNA molecule of (c), as an RNA.

In certain embodiments, contacting comprises delivering to the cell a gRNA molecule of (a) as an RNA, optionally the second, third and/or fourth gRNA molecule of (c) as an RNA, and a nucleic acid composition that encodes the Cas9 molecule or a Cas9-fusion protein of (b).

The presently disclosed subject matter further provides a method of treating, preventing, and/or reducing a subject suffering from or likely to develop HSV-1 and/or HSV-2, e.g., by altering the structure, e.g., sequence, of a target nucleic acid of the subject, comprising contacting the subject (or a cell from the subject) with:

(a) a present disclosed gRNA molecule, e.g., a gRNA molecule that targets the RS1, RL2 or LAT gene;

(b) a Cas9 molecule (e.g., an eaCas9 molecule or an eiCas9 molecule) or Cas9-fusion protein, e.g., a Cas9 molecule disclosed herein; and optionally, (c)(i) a second gRNA molecule that targets the RS1, RL2 or LAT gene, e.g., a second gRNA molecule disclosed herein, and further optionally, (c)(ii) a third gRNA molecule, and still further optionally, (c)(iii) a fourth gRNA that targets the RL2 or LAT or RS1 gene, e.g., a third and fourth gRNA molecule disclosed herein.

In certain embodiments, the method comprises introducing a mutation at an HSV RS1 target position, an HSV RL2 target position, or an HSV LAT target position, e.g., by NHEJ.

In certain embodiments, a cell of the subject is contacted in vivo (e.g., by intravenous delivery) with (a), (b) and optionally (c)(i), further optionally (c)(ii), and still further optionally (c)(iii).

In certain embodiments, the contacting step comprises contacting the subject with a nucleic acid composition, e.g., a vector, e.g., an AAV vector or an LV vector, described herein, e.g., a nucleic acid composition that encodes at least one of (a), (b), and optionally (c)(i), further optionally (c)(ii), and still further optionally (c)(iii).

In certain embodiments, the contacting step comprises delivering to said subject said Cas9 molecule or Cas9-fusion protein of (b), as a protein or mRNA, and a nucleic acid composition which encodes (a), and optionally (c)(i), further optionally (c)(ii), and still further optionally (c)(iii).

In certain embodiments, the contacting step comprises delivering to the subject the Cas9 molecule or Cas9-fusion protein of (b), as a protein or mRNA, the gRNA molecule of (a), as an RNA, and optionally the second gRNA of (c)(i), further optionally (c)(ii), and still further optionally (c)(iii), as an RNA.

In certain embodiments, the contacting step comprises delivering to the subject the gRNA molecule of (a), as an RNA, optionally said second gRNA of (c)(i), further optionally (c)(ii), and still further optionally (c)(iii), as an RNA, a nucleic acid composition that encodes the Cas9 molecule or Cas9-fusion protein of (b).

When the method comprises (1) introducing a mutation at an HSV RS1 target position, an HSV RL2 target position, or an HSV LAT target position by NHEJ or (2) knocking down expression of one or more of the RS1, RL2 and/or LAT gene(s), e.g., by targeting the promoter region, a Cas9 molecule or Cas9-fusion protein of (b) and at least one gRNA molecule, e.g., a gRNA molecule of (a) are included in the contacting step.

The presently disclosed subject matter provides a reaction mixture comprising a gRNA molecule, a nucleic acid composition, or a composition described herein, and a cell, e.g., a cell from a subject having, or likely to develop HSV-1 and/or HSV-2, or a subject which would benefit from a mutation at an HSV RL2 target position or HSV LAT target position or HSV RS1 target position.

The presently disclosed subject matter provides a kit comprising, (a) a gRNA molecule described herein, or nucleic acid composition that encodes the gRNA molecule, and one or more of the following:

(b) a Cas9 molecule (e.g., an eaCas9 molecule or an eiCas9 molecule) or Cas9-fusion protein, e.g., a Cas9 molecule described herein, or a nucleic acid or mRNA that encodes the Cas9;

(c)(i) a second gRNA molecule, e.g., a second gRNA molecule described herein or a nucleic acid that encodes (c)(i);

(c)(ii) a third gRNA molecule, e.g., a third gRNA molecule described herein or a nucleic acid that encodes (c)(ii); or (c)(iii) a fourth gRNA molecule, e.g., a fourth gRNA molecule described herein or a nucleic acid that encodes (c)(iii). In certain embodiments, the Cas9 molecule can be a Cas9 variant. For example, and not by way of limitation, the Cas9 variant can be an S. pyogenes Cas9 variant or an S. aureus Cas9 variant. In certain embodiments, the S. pyogenes Cas9 variant is the EQR variant. In certain embodiments, the S. pyogenes Cas9 variant is the VRER variant.

In certain embodiments, the kit comprises nucleic acid, e.g., an AAV vector or LV vector, that encodes one or more of (a), (b), (c)(i), (c)(ii), and (c)(iii).

The presently disclosed subject matter provides a gRNA molecule, e.g., a gRNA molecule described herein, for use in treating, preventing, reducing, or delaying the onset or progression of HSV-1 and/or HSV-2 infection in a subject, e.g., in accordance with a method of treating, preventing, reducing, or delaying the onset or progression of HSV-1 and/or HSV-2 infection as described herein.

In certain embodiments, the gRNA molecule is used in combination with a Cas9 molecule (e.g., an eaCas9 molecule or an eiCas9 molecule) or Cas9-fusion protein, e.g., a Cas9 molecule described herein. For example, and not by way of limitation, the Cas9 molecule or Cas9-fusion protein is a Cas9 variant. For example, and not by way of limitation, the Cas9 variant can be a S. pyogenes Cas9 variant or a S. aureus Cas9 variant. In certain embodiments, the S. pyogenes Cas9 variant is the EQR variant. In certain embodiments, the S. pyogenes Cas9 variant is the VRER variant. Additionally or alternatively, in certain embodiments, the gRNA molecule is used in combination with a second, third and/or fourth gRNA molecule, e.g., a second, third and/or fourth gRNA molecule described herein.

The presently disclosed subject matter provides use of a gRNA molecule, e.g., a gRNA molecule described herein, in the manufacture of a medicament for treating, or delaying the onset or progression of HSV-1 and/or HSV-2 in a subject, e.g., in accordance with a method of treating, preventing, reducing, or delaying the onset or progression of HSV-1 and/or HSV-2 as described herein.

In certain embodiments, the medicament comprises a Cas9 molecule (e.g., an eaCas9 molecule or an eiCas9 molecule) or Cas9-fusion protein, e.g., a Cas9 molecule described herein. Additionally or alternatively, in certain embodiments, the medicament comprises a second, third and/or fourth gRNA molecule, e.g., a second, third and/or fourth gRNA molecule described herein. In certain embodiments, the Cas9 molecule can be a Cas9 variant. For example, and not by way of limitation, the Cas9 variant can be a S. pyogenes Cas9 variant or a S. aureus Cas9 variant. In certain embodiments, the S. pyogenes Cas9 variant is the EQR variant. In certain embodiments, the S. pyogenes Cas9 variant is the VRER variant.

The gRNA molecules, genome editing systems, methods, compositions, reaction mixtures and kits, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

FIGS. 1A-1I are representations of several exemplary gRNAs. FIG. 1A depicts a modular gRNA molecule derived in part (or modeled on a sequence in part) from *Streptococcus pyogenes* (*S. pyogenes*) as a duplexed structure (SEQ ID NOs:39 and 40, respectively, in order of appearance); FIG. 1B depicts a unimolecular gRNA molecule derived in part from *S. pyogenes* as a duplexed structure (SEQ ID NO:41); FIG. 1C depicts a unimolecular gRNA molecule derived in part from *S. pyogenes* as a duplexed structure (SEQ ID NO:42); FIG. 1D depicts a unimolecular gRNA molecule derived in part from *S. pyogenes* as a duplexed structure (SEQ ID NO:43); FIG. 1E depicts a unimolecular gRNA molecule derived in part from *S. pyogenes* as a duplexed structure (SEQ ID NO:44); FIG. 1F depicts a modular gRNA molecule derived in part from *Streptococcus thermophilus* (*S. thermophilus*) as a duplexed structure (SEQ ID NOs:45 and 46, respectively, in order of appearance); and FIG. 1G depicts an alignment of modular gRNA molecules of *S. pyogenes* and *S. thermophilus* (SEQ ID NOs:39, 45, 47, and 46, respectively, in order of appearance). FIGS. 1H-1I depicts additional exemplary structures of unimolecular gRNA molecules. FIG. 1H shows an exemplary structure of a unimolecular gRNA molecule derived in part from *S. pyogenes* as a duplexed structure (SEQ ID NO:42). FIG. 1I shows an exemplary structure of a unimolecular gRNA molecule derived in part from *S. aureus* as a duplexed structure (SEQ ID NO:38).

Figure 2D:
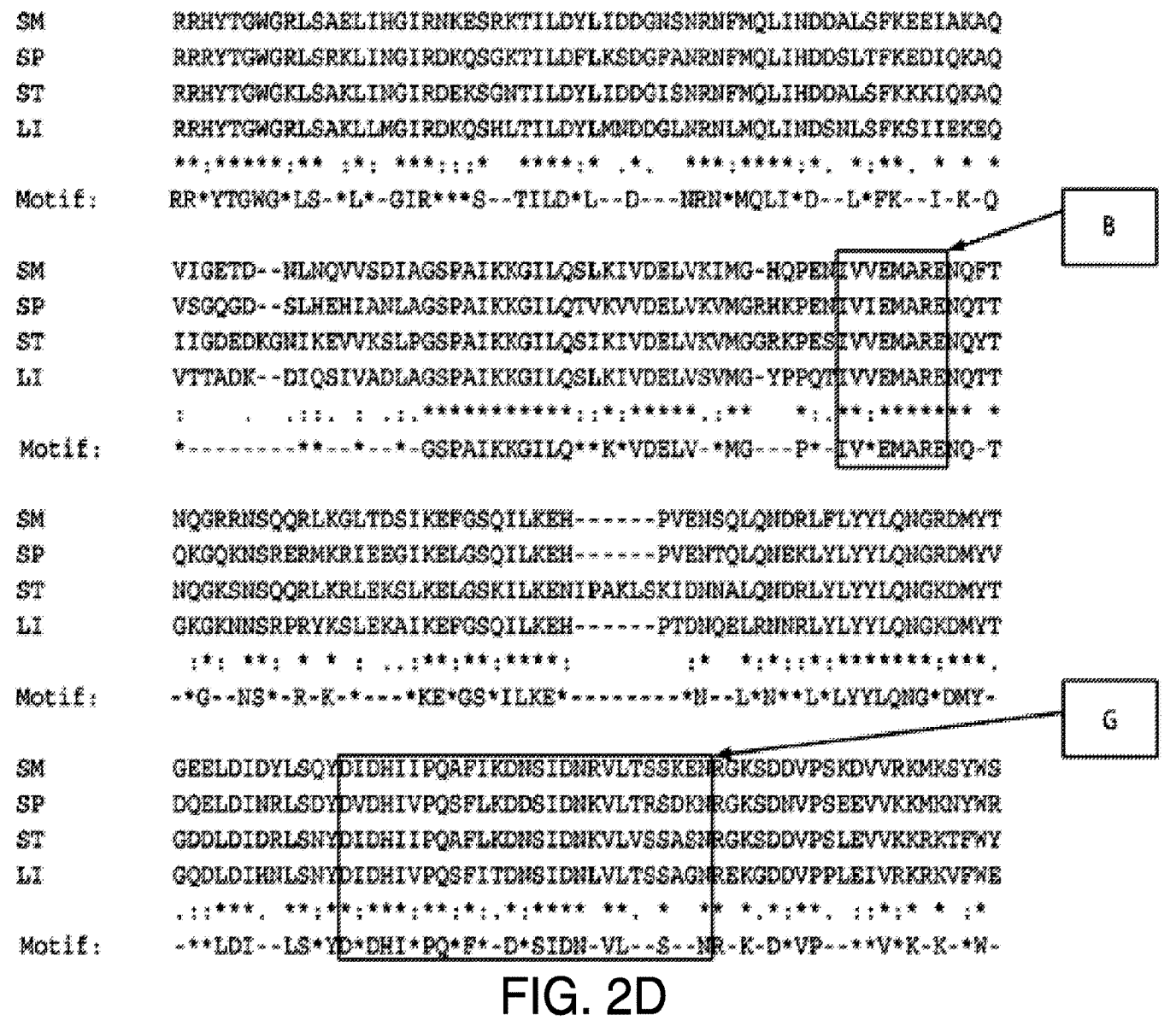
Figure 2E:
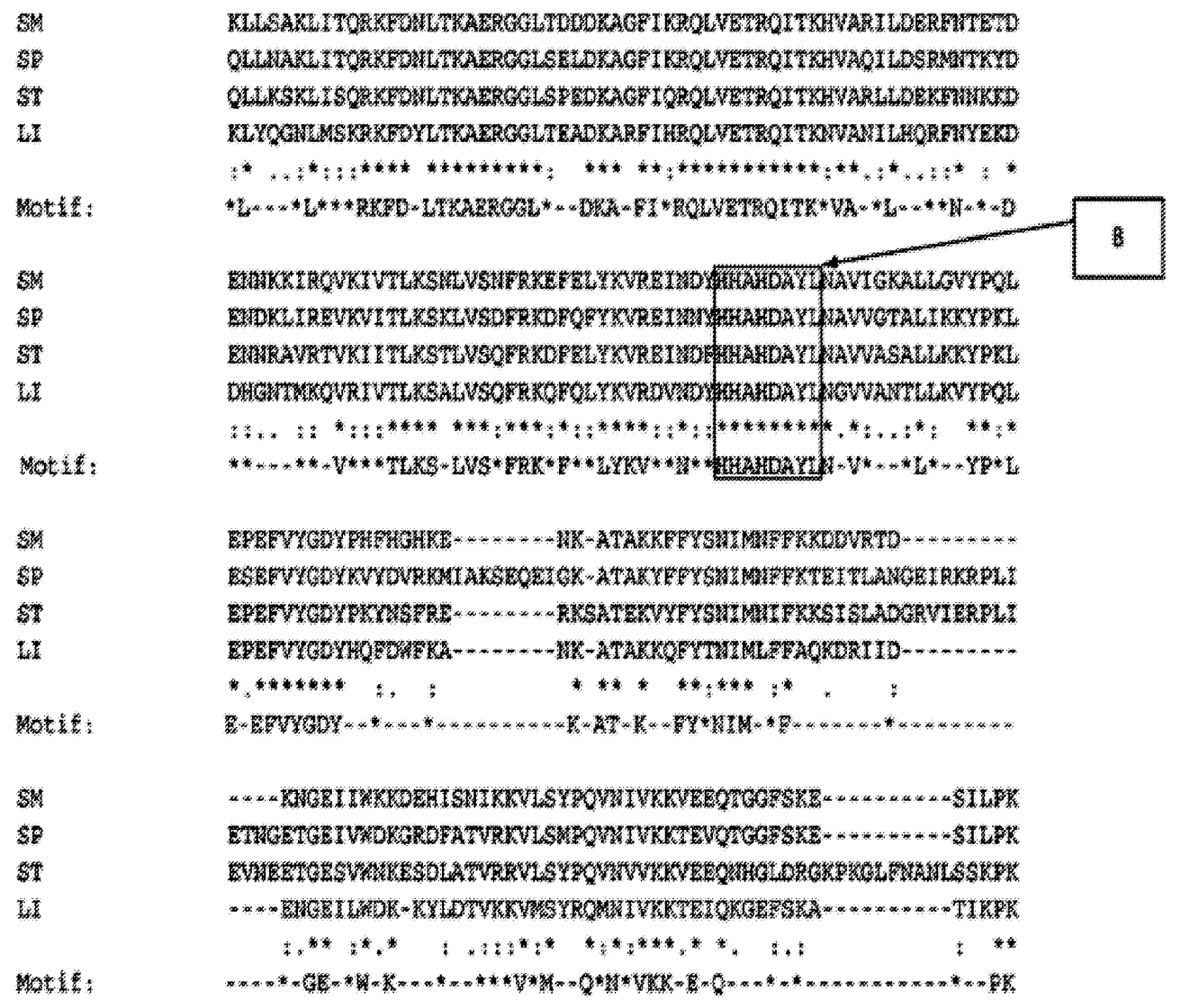

FIGS. 2A-2G depict an alignment of Cas9 sequences (Chylinski 2013). The N-terminal RuvC-like domain is boxed and indicated with a "Y." The other two RuvC-like domains are boxed and indicated with a "B." The HNH-like domain is boxed and indicated by a "G." Sm: *S. mutans* (SEQ ID NO:1); Sp: *S. pyogenes* (SEQ ID NO:2); St: *S. thermophilus* (SEQ ID NO:4); and Li: *L. innocua* (SEQ ID NO:5). "Motif" (SEQ ID NO:14) is a consensus sequence based on the four sequences. Residues conserved in all four sequences are indicated by single letter amino acid abbreviation; "*" indicates any amino acid found in the corresponding position of any of the four sequences; and "-" indicates absent.

FIGS. 3A-3B show an alignment of the N-terminal RuvC-like domain from the Cas9 molecules disclosed in Chylinski 2013 (SEQ ID NOs:52-95, 120-123). The last line of FIG. 3B identifies 4 highly conserved residues.

FIGS. 4A-4B show an alignment of the N-terminal RuvC-like domain from the Cas9 molecules disclosed in Chylinski 2013 with sequence outliers removed (SEQ ID NOs:52-123). The last line of FIG. 4B identifies 3 highly conserved residues.

FIGS. 5A-5C show an alignment of the HNH-like domain from the Cas9 molecules disclosed in Chylinski 2013 (SEQ ID NOs:124-198). The last line of FIG. 5C identifies conserved residues.

FIGS. 6A-6B show an alignment of the HNH-like domain from the Cas9 molecules disclosed in Chylinski 2013 with sequence outliers removed (SEQ ID NOs:124-141, 148, 149, 151-153, 162, 163, 166-174, 177-187, 194-198). The last line of FIG. 6B identifies 3 highly conserved residues.

FIG. 8A shows the organization of the Cas9 domains, including amino acid positions, in reference to the two lobes of Cas9 (recognition (REC) and nuclease (NUC) lobes). FIG. 8B shows the percent homology of each domain across 83 Cas9 orthologs.

Figure 1A:
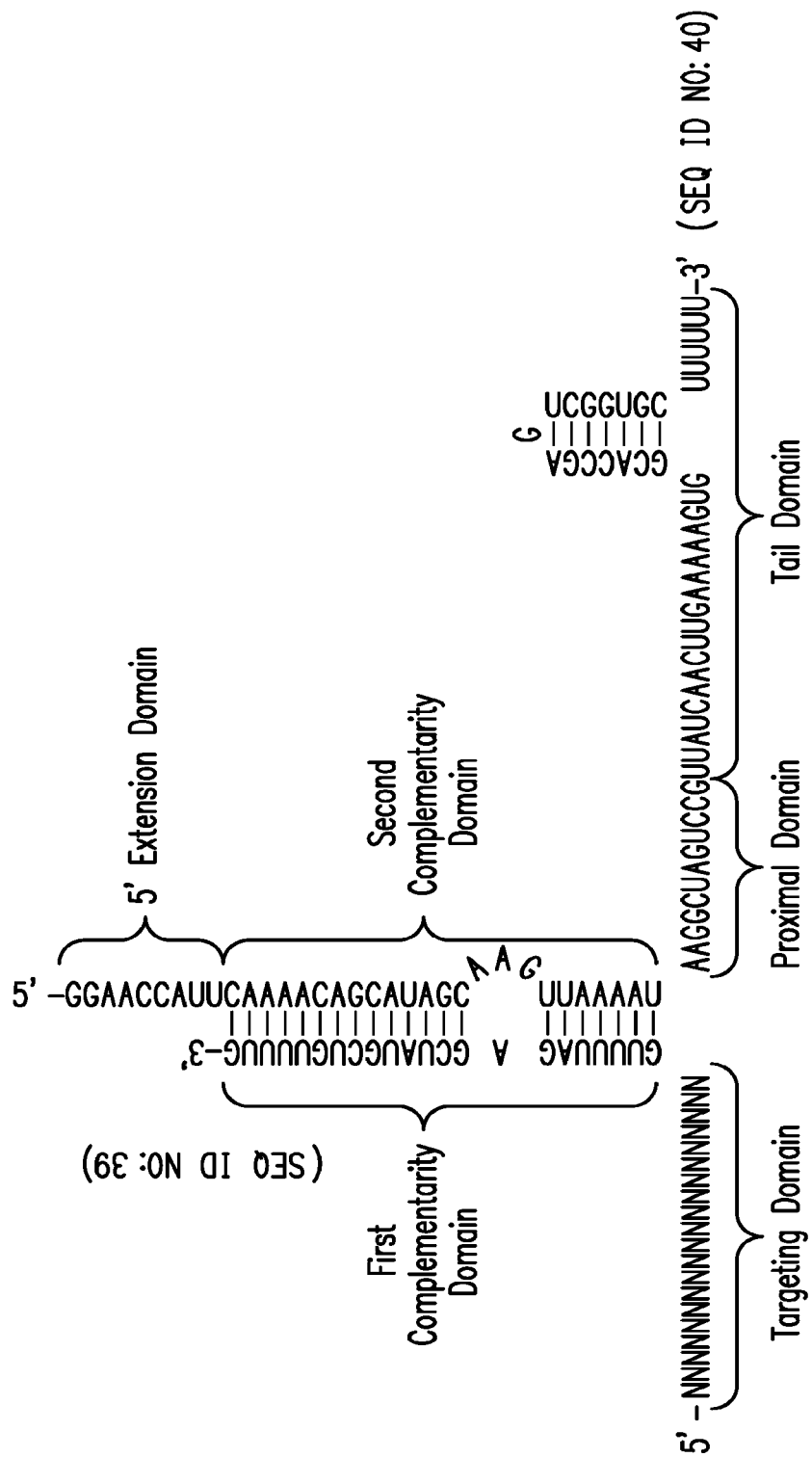
Figure 1B:
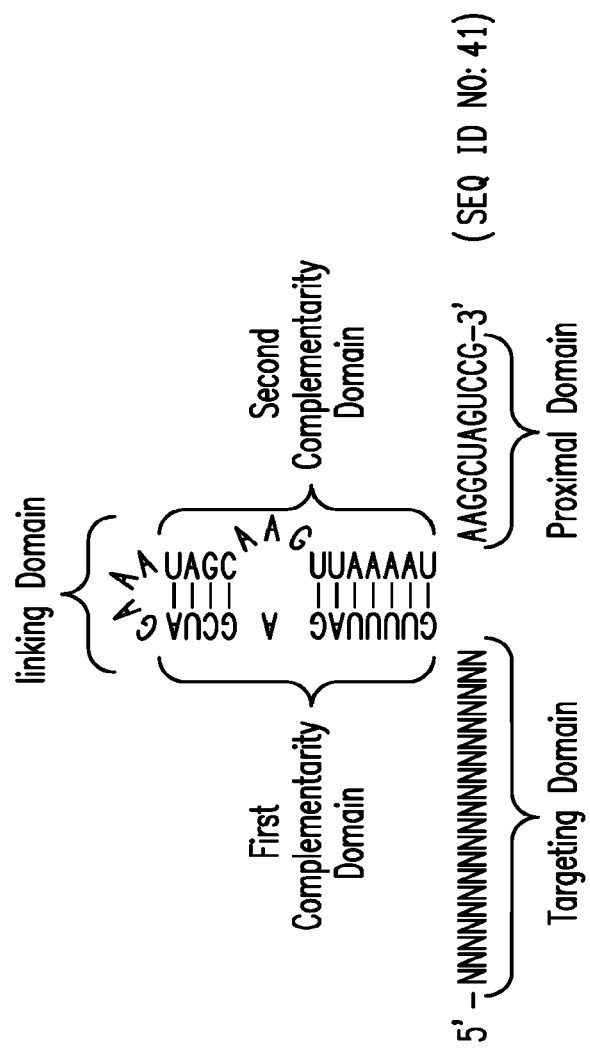
Figure 1C:
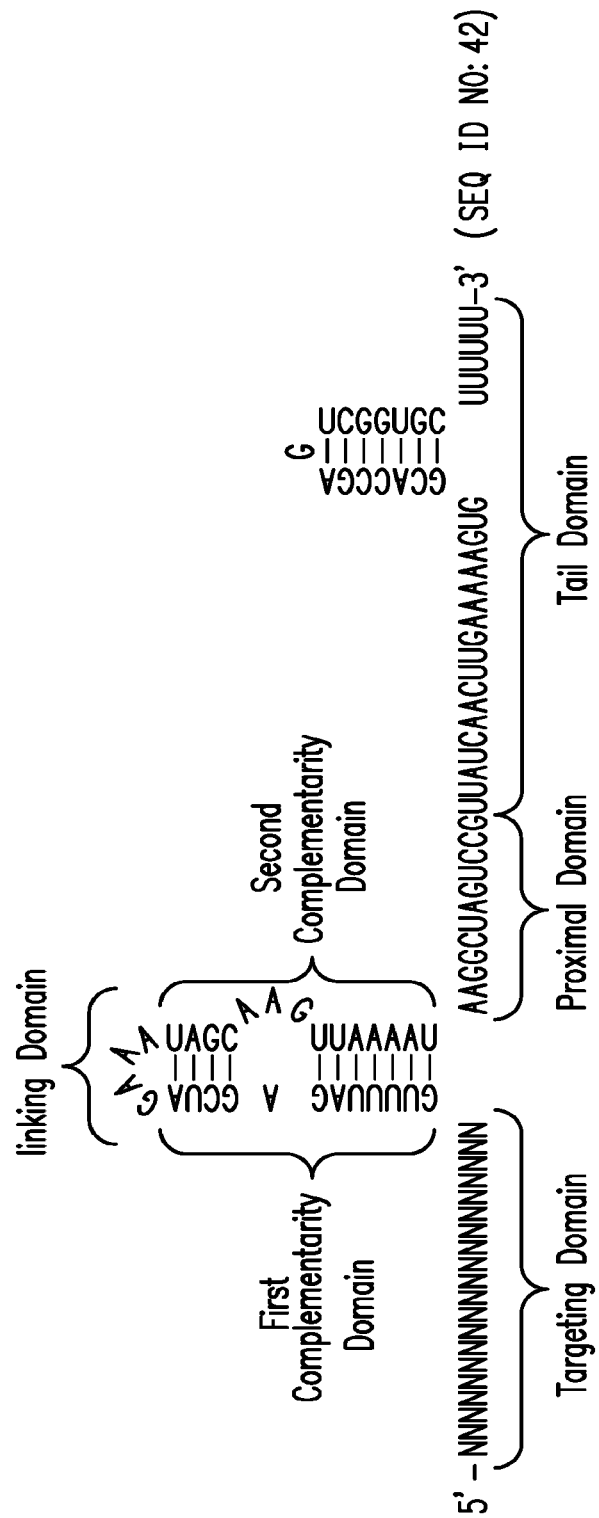
Figure 1D:
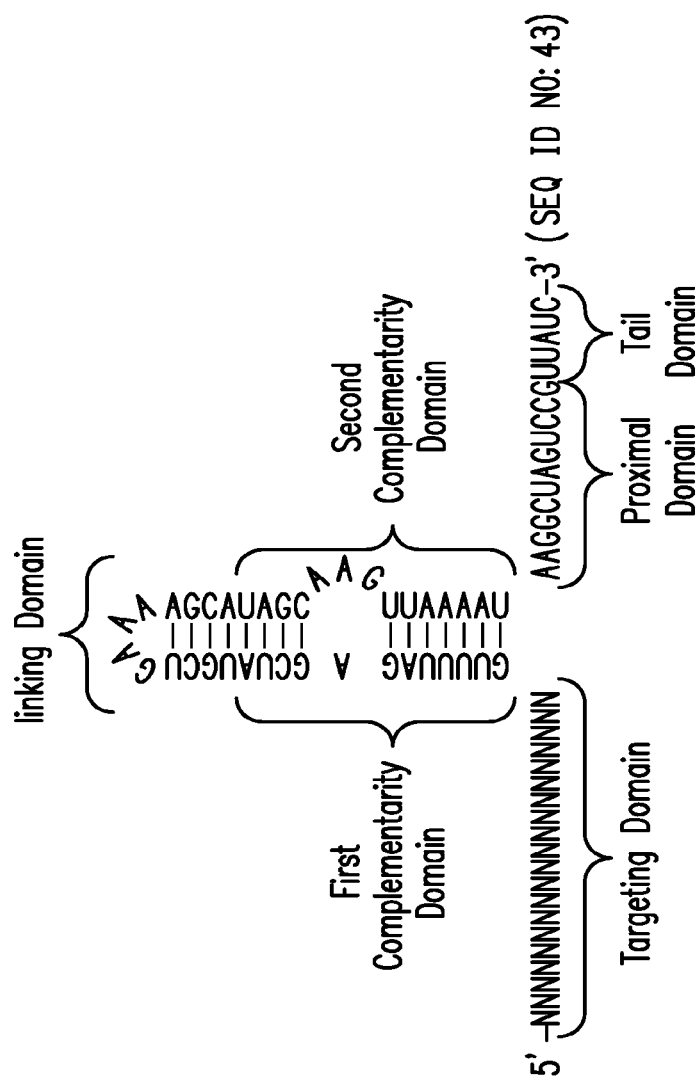
Figure 1E:
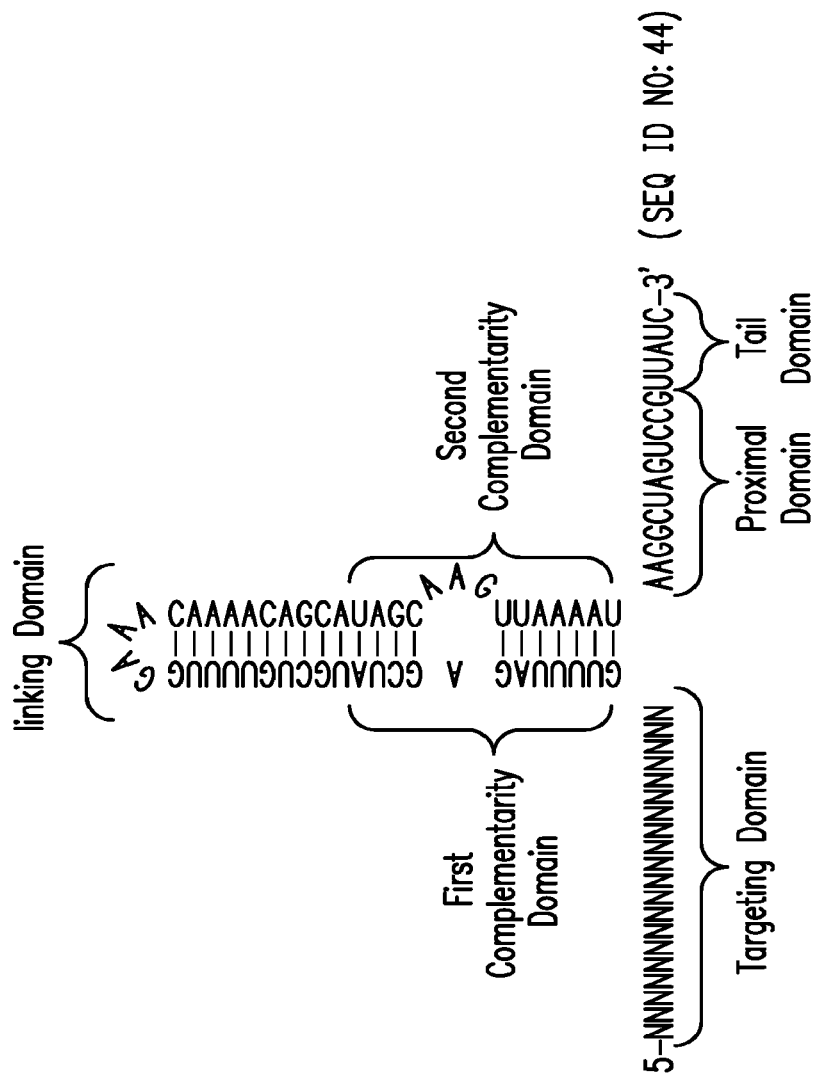

(see Example 3). (B) shows HSV1 target knockdown of RS1 listed in Table 19 (see Example 3).

DETAILED DESCRIPTION

For purposes of clarity of disclosure and not by way of limitation, the detailed description is divided into the following subsections:
1. Definitions
2. Herpes Simplex Virus
3. Methods to Treat, Prevent and/or Reduce HSV-related Ocular Infection;
4. Methods of Altering RS1, RL2, and/or LAT gene(s)
5. Guide RNA (gRNA) Molecules
6. Methods for Designing gRNAs
7. Cas9 Molecules
8. Functional Analysis of Candidate Molecules
9. Genome Editing Approaches
10. Target Cells
11. Delivery, Formulations and Routes of Administration
12. Modified Nucleosides, Nucleotides, and Nucleic Acids

1. Definitions

As used herein, the term "about" or "approximately" means within an acceptable error range for the particular value as determined by one of ordinary skill in the art, which can depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

As used herein, a "genome editing system" refers to any system having RNA-guided DNA editing activity. Genome editing systems of the present disclosure include at least two components adapted from naturally occurring CRISPR systems: a guide RNA (gRNA) and an RNA-guided nuclease. These two components form a complex that is capable of associating with a specific nucleic acid sequence in a cell and editing the DNA in or around that nucleic acid sequence, for instance by making one or more of a single-strand break (an SSB or nick), a double-strand break (a DSB) and/or a point mutation.

Genome editing systems may comprise, in various embodiments, (a) one or more Cas9/gRNA complexes, and (b) separate Cas9 molecules and gRNAs that are capable of associating in a cell to form one or more Cas9/gRNA complexes. A genome editing system according to the present disclosure may be encoded by one or more nucleotides (e.g. RNA, DNA) comprising coding sequences for Cas9 and/or gRNAs that can associate to form a Cas9/gRNA complex, and the one or more nucleotides encoding the gene editing system may be carried by a vector as described herein.

In certain embodiments, the genome editing system targets a HSV viral gene selected from the group consisting of a RS1 gene, a RL2 gene and a LAT gene. A presently disclosed genome editing system can be used to alter (knock out or knock down) one or more HSV viral gene, e.g., a RS1 gene, a RL2 gene, and/or a LAT gene.

In certain embodiments, the genome editing system targets a RS1 gene. In certain embodiments, the RS1 gene is a human RS1 gene. In certain embodiments, the genome editing system targets a RL2 gene. In certain embodiments, the RL2 gene is a human RL2 gene. In certain embodiments, the genome editing system targets a LAT gene. In certain embodiments, the LAT gene is a human LAT gene. In certain embodiments, the genome editing system targets two or three of RS1, RL2 and LAT genes.

In certain embodiments, the genome editing system that targets a RS1 gene comprises a first gRNA molecule comprising a targeting domain complementary to a target domain (also referred to as "target sequence") in the RS1 gene, or a polynucleotide encoding thereof, and at least one Cas9 molecule or polynucleotide(s) encoding thereof. In certain embodiments, the genome editing system that targets a RS1 gene further comprises a second gRNA molecule comprising a targeting domain complementary to a second target domain in the RS1 gene, or a polynucleotide encoding thereof. The the genome editing system that targets a RS1 gene may further comprise a third and a fourth gRNA molecules that target the RS1 gene.

In certain embodiments, the genome editing system that targets a RL2 gene comprises a first gRNA molecule comprising a targeting domain complementary to a target domain in the RL2 gene, or a polynucleotide encoding thereof, and at least one Cas9 molecule or polynucleotide(s) encoding thereof. In certain embodiments, the genome editing system that targets a RL2 gene further comprises a second gRNA molecule comprising a targeting domain complementary to a second target domain in the RL2 gene, or a polynucleotide encoding thereof. The the genome editing system that targets a RL2 gene may further comprise a third and a fourth gRNA molecules that target the RL2 gene.

In certain embodiments, the genome editing system that targets a LAT gene comprises a first gRNA molecule comprising a targeting domain complementary to a target domain in the LAT gene, or a polynucleotide encoding thereof, and at least one Cas9 molecule or polynucleotide(s) encoding thereof. In certain embodiments, the genome editing system that targets a LAT gene further comprises a second gRNA molecule comprising a targeting domain complementary to a second target domain in the LAT gene, or a polynucleotide encoding thereof. The the genome editing system that targets a LAT gene may further comprise a third and a fourth gRNA molecules that target the LAT gene.

In certain embodiments, the genome editing system is implemented in a cell or in an in vitro or in vivo contact. In certain embodiments, the genome editing system is used in a medicament, e.g., a medicament for modifying one or more target genes (e.g., RS1, RL2 and/or LAT genes), or a medicament for treating, preventing, and/or reducing HSV infection (HSV-1 or HSV-2 infection). In certain embodiments, the genome editing system is used in therapy.

"Target gene" as used herein, refers to any nucleotide sequence encoding a known or putative gene product. In certain embodiments, the target gene is a HSV viral gene. As used herein, a "HSV viral gene" refers to a (HSV-1 or HSV-2) RS1 gene, a (HSV-1 or HSV-2) RL2 gene, or a (HSV-1 or HSV-2) LAT gene.

"HSV1 RS1 target knockout position," as used herein, refers to a position in the RS1 gene of HSV1, which if altered by NHEJ-mediated alteration, results in reduction or elimination of expression of a functional RS1 gene product. In certain embodiments, the position is in the coding region (e.g., an early coding region) of the RS1 gene. In certain embodiments, the position is in the non-coding region of the RS1 gene.

"HSV2 RS1 target knockout position," as used herein, refers to a position in the RS1 gene of HSV2, which if altered by NHEJ-mediated alteration, results in reduction or elimination of expression of a functional RS1 gene product. In certain embodiments, the position is in the coding region (e.g., an early coding region) of the RS1 gene. In certain embodiments, the position is in the non-coding region of the RS1 gene.

"HSV RS1 target knockout position," as used herein, refers to a position in the RS1 gene of HSV (e.g., HSV-1 or HSV-2), which if altered by NHEJ-mediated alteration, results in reduction or elimination of expression of a functional RS1 gene product. In certain embodiments, the position is in the coding region (e.g., an early coding region) of the RS1 gene. In certain embodiments, the position is in the non-coding region of the RS1 gene.

"HSV1 RS1 target knockdown position", as used herein, refers to a position in the RS1 gene of HSV1, which if targeted by an eiCas9 or an eiCas9-fusion protein described herein, results in reduction or elimination of expression of functional RS1 gene product. In certain embodiments, transcription is reduced or eliminated. In certain embodiments, the position is in the promoter region of the RS1 gene (e.g., a position in the promoter region of the RS1 gene is targeted by an eiCas9 or an eiCas9-fusion protein).

"HSV2 RS1 target knockdown position", as used herein, refers to a position in the RS1 gene of HSV2, which if targeted by an eiCas9 or an eiCas9-fusion protein described herein, results in reduction or elimination of expression of functional RS1 gene product. In certain embodiments, transcription is reduced or eliminated. In certain embodiments, the position is in the promoter region of the RS1 gene (e.g., a position in the promoter region of the RS1 gene is targeted by an eiCas9 or an eiCas9-fusion protein).

"HSV RS1 target knockdown position", as used herein, refers to a position in the RS1 gene of HSV (e.g., HSV-1 or HSV-2), which if targeted by an eiCas9 or an eiCas9-fusion protein described herein, results in reduction or elimination of expression of functional RS1 gene product. In certain embodiments, transcription is reduced or eliminated. In certain embodiments, the position is in the promoter region of the RS1 gene (e.g., a position in the promoter region of the RS1 gene is targeted by an eiCas9 or an eiCas9-fusion protein).

"HSV RS1 target position", as used herein, includes HSV RS1 target knockdown position and/or HSV RS1 target knockout position.

"HSV1 RL2 target knockout position," as used herein, refers to a position in the RL2 gene of HSV1, which if altered by NHEJ-mediated alteration, results in reduction or elimination of expression of a functional RL2 gene product. In certain embodiments, the position is in the coding region (e.g., an early coding region) of the RL2 gene. In certain embodiments, the position is in the non-coding region of the RL2 gene.

"HSV2 RL2 target knockout position," as used herein, refers to a position in the RL2 gene of HSV2, which if altered by NHEJ-mediated alteration, results in reduction or elimination of expression of a functional RL2 gene product. In certain embodiments, the position is in the coding region (e.g., an early coding region) of the RL2 gene. In certain embodiments, the position is in the non-coding region of the RL2 gene.

"HSV RL2 target knockout position", as used herein, refers to a position in the RL2 gene of HSV (e.g., HSV-1 or HSV-2), which if altered by NHEJ-mediated alteration, results in reduction or elimination of expression of a functional RL2 gene product. In certain embodiments, the position is in the coding region (e.g., an early coding region) of the RL2 gene. In certain embodiments, the position is in the non-coding region of the RL2 gene.

"HSV1 RL2 target knockdown position", as used herein, refers to a position in the RL2 gene of HSV1, which if targeted by an eiCas9 or an eiCas9-fusion protein described herein, results in reduction or elimination of expression of functional RL2 gene product. In certain embodiments, transcription is reduced or eliminated. In certain embodiments, the position is in the promoter region of the RL2 gene (e.g., a position in the promoter region of the RL2 gene is targeted by an eiCas9 or an eiCas9-fusion protein).

"HSV2 RL2 target knockdown position", as used herein, refers to a position in the RL2 gene of HSV2, which if targeted by an eiCas9 or an eiCas9-fusion protein described herein, results in reduction or elimination of expression of functional RL2 gene product. In certain embodiments, transcription is reduced or eliminated. In certain embodiments, the position is in the promoter region of the RL2 gene (e.g., a position in the promoter region of the RL2 gene is targeted by an eiCas9 or an eiCas9-fusion protein).

"HSV RL2 target knockdown position", as used herein, refers to a position in the RL2 gene of HSV (e.g., HSV-1 or HSV-2), which if targeted by an eiCas9 or an eiCas9-fusion protein described herein, results in reduction or elimination of expression of functional RL2 gene product. In certain embodiments, transcription is reduced or eliminated. In certain embodiments, the position is in the promoter region of the RL2 gene (e.g., a position in the promoter region of the RL2 gene is targeted by an eiCas9 or an eiCas9-fusion protein).

"HSV RL2 target position", as used herein, refers to an HSV RL2 target knockout position and/or an HSV RL2 target knockdown position.

"HSV1 LAT target knockout position," as used herein, refers to a position in the LAT gene of HSV1, which if altered by NHEJ-mediated alteration, results in reduction or elimination of expression of a functional LAT gene product. In certain embodiments, the position is in the coding region (e.g., an early coding region) of the LAT gene. In certain embodiments, the position is in the non-coding region of the LAT gene.

"HSV2 LAT target knockout position," as used herein, refers to a position in the LAT gene of HSV2, which if altered by NHEJ-mediated alteration, results in reduction or elimination of expression of a functional LAT gene product. In certain embodiments, the position is in the coding region (e.g., an early coding region) of the LAT gene. In certain embodiments, the position is in the non-coding region of the LAT gene.

"HSV LAT target knockout position", as used herein, refers to a position in the LAT gene of HSV (e.g., HSV-1 or HSV-2), which if altered by NHEJ-mediated alteration, results in reduction or elimination of expression of a functional LAT gene product. In certain embodiments, the position is in the LAT gene coding region, e.g., an early coding region. In certain embodiments, the position is in the non-coding region of the LAT gene.

"HSV1 LAT target knockdown position", as used herein, refers to a position in the LAT gene of HSV1, which if targeted by an eiCas9 or an eiCas9-fusion protein described herein, results in reduction or elimination of expression of functional LAT gene product. In certain embodiments, transcription is reduced or eliminated. In certain embodiments, the position is in the promoter region of the LAT gene (e.g., a position in the promoter region of the LAT gene is targeted by an eiCas9 or an eiCas9-fusion protein).

"HSV2 LAT target knockdown position", as used herein, refers to a position in the LAT gene of HSV2, which if targeted by an eiCas9 or an eiCas9-fusion protein described herein, results in reduction or elimination of expression of functional LAT gene product. In certain embodiments, transcription is reduced or eliminated. In certain embodiments, the position is in the promoter region of the LAT gene (e.g., a position in the promoter region of the LAT gene is targeted by an eiCas9 or an eiCas9-fusion protein).

"HSV LAT target knockdown position", as used herein, refers to a position in the RL2 gene of HSV (e.g., HSV-1 or HSV-2), which if targeted by an eiCas9 or an eiCas9-fusion protein described herein, results in reduction or elimination of expression of functional LAT gene product. In certain embodiments, transcription is reduced or eliminated. In certain embodiments, the position is in the promoter region of the LAT gene (e.g., a position in the promoter region of the LAT gene is targeted by an eiCas9 or an eiCas9-fusion protein).

"HSV LAT target position", as used herein, refers to an HSV LAT target knockout position and/or an HSV LAT target knockdown position.

"Domain", as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule", as used herein, refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In certain embodiments, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the RS1, RL2, or LAT gene (a target gene gRNA); or on more than one nucleic acid that encodes a CRISPR/Cas component, e.g., both (a) and (b). In certain embodiments, a nucleic acid molecule that encodes a CRISPR/Cas component, e.g., that encodes a Cas9 molecule or a target gene gRNA, comprises more than one target domain that is complementary with a governing gRNA targeting domain. In certain embodiments, a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In certain embodiments, the Cas9 molecule forms two complexes: a complex comprising a Cas9 molecule with a target gene gRNA, which complex can alter the RS1, RL2, or LAT gene; and a complex comprising a Cas9 molecule with a governing gRNA molecule, which complex can act to prevent further production of a CRISPR/Cas system component, e.g., a Cas9 molecule or a target gene gRNA molecule. In certain embodiments, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In certain embodiments, a governing gRNA molecule/Cas9 molecule complex binds to or promotes cleavage of a control region sequence, e.g., a promoter, operably linked to a gRNA molecule, or a sequence that encodes the gRNA molecule. In certain embodiments, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In certain embodiments, a governing gRNA places temporal, level of expression, or other limits, on activity of the Cas9 molecule/target gene gRNA molecule complex. In certain embodiments, a governing gRNA reduces off-target or other unwanted activity. In certain embodiments, a governing gRNA molecule inhibits, e.g., entirely or substantially entirely inhibits, the production of a component of the Cas9 system and thereby limits, or governs, its activity.

"Modulator", as used herein, refers to an entity, e.g., a drug that can alter the activity (e.g., enzymatic activity, transcriptional activity, or translational activity), amount, distribution, or structure of a subject molecule or genetic sequence. In certain embodiments, modulation comprises cleavage, e.g., breaking of a covalent or non-covalent bond, or the forming of a covalent or non-covalent bond, e.g., the attachment of a moiety, to the subject molecule. In certain embodiments, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

"Polypeptide", as used herein, refers to a polymer of amino acids having less than 100 amino acid residues. In certain embodiments, it has less than 50, 20, or 10 amino acid residues.

A "Cas9 molecule" or "Cas9 polypeptide" as used herein refers to a molecule or polypeptide, respectively, that can interact with a gRNA molecule and, in concert with the gRNA molecule, localize to a site comprising a target domain (also referred to as "target sequence") and, in certain embodiments, a PAM sequence. Cas9 molecules and Cas9 polypeptides include both naturally occurring Cas9 molecules and Cas9 polypeptides and engineered, altered, or modified Cas9 molecules or Cas9 polypeptides that differ, e.g., by at least one amino acid residue, from a reference sequence, e.g., the most similar naturally occurring Cas9 molecule.

In certain embodiments, the Cas9 molecule is a wild-type S. pyogenes Cas9, which recognizes a NGG PAM sequence. In certain embodiments, the Cas9 molecule is an S. pyogenes Cas9 EQR variant, which recognizes a NGAG PAM sequence, A NGCG PAM sequence, a NGGG PAM sequence, a NGTG PAM sequence, a NGAA PAM sequence, a NGAT PAM sequence or a NGAC PAM sequence. In certain embodiments, the Cas9 molecule is an S. pyogenes Cas9 VRER variant, which recognizes a NGCG PAM sequence, a NGCA PAM sequence, a NGCT PAM sequence, or a NGCC PAM sequence. In certain embodiments, the Cas9 molecule is a wild-type S. aureus Cas9, which recognizes a NNGRRT PAM sequence, or a NNGRRV PAM sequence.

A "reference molecule" as used herein refers to a molecule to which a modified or candidate molecule is compared. For example, a reference Cas9 molecule refers to a Cas9 molecule to which a modified or candidate Cas9 molecule is compared. Likewise, a reference gRNA refers to a gRNA molecule to which a modified or candidate gRNA molecule is compared. The modified or candidate molecule may be compared to the reference molecule on the basis of sequence (e.g., the modified or candidate molecule may have X % sequence identity or homology with the reference molecule) or activity (e.g., the modified or candidate molecule may have X % of the activity of the reference molecule). For example, where the reference molecule is a Cas9 molecule, a modified or candidate molecule may be characterized as having no more than 10% of the nuclease activity of the reference Cas9 molecule. Examples of reference Cas9 molecules include naturally occurring unmodified Cas9 molecules, e.g., a naturally occurring Cas9 molecule from S. pyogenes, S. aureus, or N. meningitidis. In certain embodiments, the reference Cas9 molecule is the naturally occurring Cas9 molecule having the closest sequence identity or homology with the modified or candidate Cas9 molecule to which it is being compared. In certain embodiments, the reference Cas9 molecule is a parental molecule having a naturally occurring or known sequence on which a mutation has been made to arrive at the modified or candidate Cas9 molecule.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In certain embodiments, the subject is a human. In other embodiments, the subject is poultry.

"Treat", "treating" and "treatment", as used herein, mean the treatment of a disease in a mammal, e.g., in a human, including (a) inhibiting the disease, i.e., arresting or preventing its development or progression; (b) relieving the disease, i.e., causing regression of the disease state; (c) relieving one or more symptoms of the disease; and (d) curing the disease.

"Prevent," "preventing," and "prevention" as used herein means the prevention of a disease in a mammal, e.g., in a human, including (a) avoiding or precluding the disease; (b) affecting the predisposition toward the disease; (c) preventing or delaying the onset of at least one symptom of the disease.

"X" as used herein in the context of an amino acid sequence, refers to any amino acid (e.g., any of the twenty natural amino acids) unless otherwise specified.

2. Herpes Simplex Virus

Herpes simplex viruses (HSVs) are categorized into at least two types: herpes simplex virus type 1 (HSV-1) and herpes simplex virus type 2 (HSV-2). HSV-1 and HSV-2 are also known as human herpesvirus 1 (HHV-1) and human herpesvirus (HHV-2), respectively.

The structure of herpes viruses includes a relatively large double-stranded, linear DNA genome encased within an icosahedral protein cage (capsid), which is wrapped in a lipid bilayer called (envelope). The envelope is joined to the capsid by means of a tegument. This complete particle is known as the virion (Mettenleiter et al. (2006) Curr. Opin. Microbiol. 9 (4): 423-429). HSV-1 and HSV-2 each contain at least 74 genes (or open reading frames, ORFs), or even as many as 84 unique protein coding genes by 94 putative ORFs, within their genomes (McGeoch et al. (2006) Virus Res. 117 (1): 90-104; Rajcáni et al. (2004) Virus Genes 28 (3): 293-310). These genes encode a variety of proteins involved in forming the capsid, tegument and envelope of the virus, as well as controlling the replication and infectivity of the virus.

The genomes of HSV-1 and HSV-2 are complex and contain two unique regions, i.e., the long unique region (UL) and the short unique region (US), each containing multiple viral genes. Immediate early genes encode, e.g., proteins that regulate the expression of early and late viral genes. Early genes encode, e.g., enzymes involved in DNA replication and the production of certain envelope glycoproteins. Late genes encode, e.g., proteins that form the virion particle. Transcription of HSV genes is catalyzed by RNA polymerase II of the infected host (McGeoch et al. (2006) Virus Res. 117 (1): 90-104).

Entry of HSV into the host cell involves interactions of several glycoproteins (e.g., glycoprotein B (gB), glycoprotein C (gC), glycoprogein D (gD), glycoprotein H (gH), and glycoprotein L (gL)) on the surface of the enveloped virus, with receptors (e.g., herpesvirus entry mediator (HVEM), nectin-1, or 3-O sulfated heparan sulfate) on the surface of the host cell. The envelope, when bound to specific receptors on the cell surface, will fuse with the host cell membrane and create a pore, through which the virus enters the host cell. The virus can also be endocytosed after binding to the receptors, and the fusion could occur at the endosome. After the viral capsid enters the cellular cytoplasm, it is transported to the cell nucleus. Once attached to the nucleus at a nuclear entry pore, the capsid ejects its DNA contents via the capsid portal. Following infection of a cell, a cascade of herpes virus proteins, e.g., immediate-early, early, and late, are produced.

HSVs may persist in a quiescent but persistent form known as latent infection. During latent infection of a cell, HSVs express Latency Associated Transcript (LAT) RNA. LAT can regulate the host cell genome and interfere with natural cell death mechanisms. By maintaining the host cells, LAT expression preserves a reservoir of the virus, which allows subsequent, usually symptomatic, periodic recurrences or "outbreaks" characteristic of non-latency. Whether or not recurrences are symptomatic, viral shedding occurs to produce further infections. Herpes virus DNA contains a gene that encodes ICP4, which is a transactivator of genes associated with lytic infection (Pinnoji et al. (2007) Virol. J. 4: 56). The human neuronal protein Neuronal Restrictive Silencing Factor (NRSF) or human Repressor Element Silencing Transcription Factor (REST) can bind to the elements surrounding the ICP4 gene and lead to histone deacetylation, which prevents initiation of transcription from this gene, thereby preventing transcription of other viral genes involved in the lytic cycle (Pinnoji et al. (2007) Virol. J. 4: 56; Bedadala et al. (2007) Cell Res. 17 (6): 546-555). The inhibition of ICP4 protein synthesis can be reversed by viral protein ICP0, which dissociates NRSF from the ICP4 gene and thus prevents silencing of the viral DNA (Roizman et al. (2005) Cell Cycle 4 (8): 1019-21).

2.1 HSV-Infections

The herpes simplex viruses enter the host via infection of epithelial cells within the skin and mucous membranes. Most commonly, HSV-1 enters the host via infection of epithelial cells of the oropharynx, including the epithelium of the mouth, lips and nose. Most commonly, HSV-2 enters the host via infection of epithelial cells of the anogenital region, including the epithelium of the genitals and anus. However, HSV-1 can primarily infect the anogenital region and HSV-2 can primarily infect the oropharynx.

HSV-1 causes intermittent sores of the mouth and mucous membranes. It is a ubiquitous and highly contagious pathogen. Initial infection with HSV-1 generally causes painful blistering of the mucous membranes of the lips and mouth.

HSV-2 is a sexually transmitted virus. It is most commonly known as genital herpes. Initial infection with HSV-2 generally causes painful blistering in the genital region. The disease causes lifelong, recurring bouts of viral reactivity. It is highly contagious and increases the risk of acquiring HIV infection, especially among patients with active lesions.

HSV-1 and HSV-2 infections persist for the lifetime of the host. During primary infection, the virus most often infects cells of the oropharynx and ano-genital region, causing painful vesicles in the affected region. Re-activation of HSV infections most often occurs in the oropharynx or ano-genital region. However, re-activation infections of the eye and central nervous system are the most severe and damaging HSV manifestations, as they can lead to blindness and permanent neurologic disability, respectively. Primary and re-activation infections can cause permanent neurologic sequelae and blindness. HSV-2 also increases a subject's risk of developing HIV. There is a considerable need for methods to treat, prevent and/or reduce HSV-1 and/or HSV-2 infections.

The herpes simplex virus produces immediate early genes within the epithelial cells, which encode enzymes and binding proteins necessary for viral synthesis. After primary infection, the virus travels up sensory nerve axons via retrograde transport to the sensory dorsal root ganglion (DRG). HSV-1 mainly travels to the trigeminal DRG, but can travel to other sensory ganglia depending upon the site of primary infection. HSV-2 mainly travels to the sensory DRG located within the sacrum, but can travel to other sensory ganglia depending upon the site of primary infection. Within the DRG, the virus establishes a latent infection. The latent infection persists for the lifetime of the host. Within the DRG cell, the virus uncoats, viral DNA is transported into the nucleus, and key viral RNAs associated with latency are transcribed (including the LAT RNAs).

During the primary infection, subjects generally experience painful blistering in the oral or ano-genital region that lasts 4-15 days. The sores most commonly involve the lips, gums and nasal mucous membranes in HSV-1 primary infections. Less commonly, HSV-1 primary infections may involve the ano-genital region. HSV-2 primary infections most commonly involve the ano-genital region, including the vagina, labia, cervix, penis, scrotum, anus and skin around the thighs. Less commonly, HSV-2 primary infections involve the oropharynx. Rarely, HSV-1 and HSV-2 primary infections may involve the eyes, central nervous system, the fingers and fingernail beds (herpetic whitlow). HSV-1 infection is transmitted primarily through saliva and/or sexual activity. HSV-2 infection is transmitted primarily through sexual activity but may also be transmitted through saliva. The blisters of an HSV infection may break, releasing clear fluid that is highly infectious. Primary infection is often accompanied by a flu-like illness, including fever, chills and muscle aches.

Host immune defense is very important to combating HSV infection. CD4+ T-cells and CD8+ cells are responsible for recognizing and clearing the pathogen. Subjects with impaired T-cell responses, including those with HIV, those receiving immunosuppressants following organ transplants, and neonates with developing immune systems, are subject to the most severe manifestations of HSV-1 and HSV-2 infections.

Reactivations of latent infections are generally less severe and may be of shorter duration. Reactivation of HSV-1 infection most often affects the oral region, but can also affect other areas, including the ano-genital region, the eye, the central nervous system (CNS), the fingernails, and the pharynx. Reactivation of HSV-2 infection most often affects the ano-genital region, but can also affect other areas, including the oral region, the eye, the central nervous system (CNS), the fingernails, and the pharynx. Reactivation of either HSV-1 or HSV-2 infection can cause ophthalmologic disease, including keratitis (epithelial keratitis, stromal keratitis and disciform keratitis). Generally, ophthalmologic manifestations of HSV-1 and HSV-2 include pain, tearing, redness of the eyes and sensitivity to light. Most HSV-related ocular infections resolve without permanent visual damage. However, ocular herpes infections may rarely cause scarring, secondary infection with bacterial pathogens and rarely, blindness. Reactivation of either HSV-1 or HSV-2 infection can also cause retinitis. HSV-associated retinitis is rare but severe and carries a high risk of permanent blindness.

Newborns are a population at particular risk for developing severe HSV-1 and HSV-2 infections. The disease is transmitted from the mother to the fetus during childbirth. The chance of maternal-fetal transmission is highest in cases where the mother developed primary HSV infection during pregnancy. The incidence of neonatal herpes is approximately 4-30 per 100,000 births. Neonates may develop severe HSV-1 or HSV-2 encephalitis and/or meningitis. In spite of prompt treatment with antiviral therapy, the rate of permanent neurologic sequelae in newborns infected with HSV-1 or HSV-2 is significant. In a study of infants with HSV-encephalitis or meningitis treated with high dose antiviral therapy, there was found to be a 4% mortality rate and 69% of survivors had permanent neurologic sequelae (Kimberlin et al., Pediatrics. 2001; 108: 230-238).

Primary HSV-1 and HSV-2 infections may be treated with antiviral therapy, including acyclovir, valacyclovir and famciclovir. These therapies have been demonstrated to reduce viral shedding, decrease pain and improve healing time of lesions. Re-activation of latent infections may resolve without treatment (it may be self-limiting) or may be treated with anti-viral therapy. Therapy is primarily given during acute infection. There are no curative or preventative treatments. Therapy may be given prophylactically in certain situations, including during childbirth in a mother with a recent HSV-1 or HSV-2 infection or reactivation.

There is no effective therapy that prevents HSV-1 or HSV-2 infection. The use of antiviral therapy during active infection and the use of condoms decrease transmission rates by approximately 50%.

Human immunodeficiency virus-1 (HIV-1) acquisition rates are dramatically increased in subjects who are seropositive for HSV-2. The risk of infection with HIV-1 is 3-fold higher in subjects with HSV-2. Antivirals have no impact on reducing risk of HIV acquisition.

2.2 HSV-Related Ocular Disease

HSV infections, e.g., HSV-1 and/or HSV-2 infections of the eye, either primary or reactivation infections, are called HSV-related ocular disease. HSV-related ocular disease most commonly causes infection of the anterior chamber of the eye, known as keratitis, stromal keratitis and/or disciform keratitis. HSV-related ocular disease may, more rarely, cause infection of the posterior chamber of the eye, known as retinitis. HSV-1 keratitis is acutely painful and unpleasant. It may, in rare instances, cause scarring, secondary infection with bacterial pathogens and rarely, blindness. HSV-related retinitis is a rare manifestation of HSV-related ocular disease but carries a much higher risk of permanent visual damage.

Reactivation infections occur in the eye via anterograde transport of the virus into the eye from the trigeminal ganglion, along the ophthalmic branch of the trigeminal nerve (the fifth cranial nerve) and into the eye. Re-activation of the virus may also occur from within the cornea. Latency within the trigeminal ganglion is established via one of two mechanisms. First, HSV-1 or HSV-2 can travel via retrograde transport along the trigeminal nerve from the eye (after an eye infection) into the trigeminal ganglion. Alternatively, it can spread to the trigeminal ganglion via hematogenous spread following infection of the oral mucosa, genital region, or other extraocular site. After establishing latent infection of the trigeminal ganglion, at any time, particularly in the event of an immunocompromised host, the virus can re-establish infection by traveling anterograde along the trigeminal nerve and into the eye.

When ocular herpes affects the posterior chamber of the eye, it causes retinitis. In adults, HSV-1 is responsible for the majority of cases of HSV-retinitis (Pepose et al., Ocular Infection and Immunity 1996; Mosby 1155-1168). In neonates and children, HSV-2 is responsible for the majority of cases of HSV-retinitis (Pepose et al., Ocular Infection and Immunity 1996; Mosby 1155-1168). HSV-related retinitis can lead to acute retinal necrosis (ARN), which will destroy the retina within 2 weeks without treatment (Banerjee and Rouse, Human Herpesviruses 2007; Cambridge University Press, Chapter 35). Even with treatment, the risk of permanent visual damage following ARN is higher than 50% (Roy et al., Ocular Immunology and Inflammation 2014; 22(3): 170-174).

Keratitis is the most common form of ocular herpes. HSV keratitis can manifest as dentritic keratitis, stromal keratitis, blepharatis and conjunctivitis. HSV-1 is responsible for the majority of HSV-associated keratitis, accounting for 58% of cases (Dawson et. al., Suvey of Ophthalmology 1976; 21(2): 121-135). HSV-2 accounts for the remainder of HSV-associated keratitis cases, or approximately 42% of cases. In the U.S., there are approximately 48,000 cases of recurrent or primary HSV-related keratitis infections annually (Liesegang et. al., 1989; 107(8): 1155-1159). Of all cases of HSV-related keratitis, approximately 1.5-3% of subjects experience severe, permanent visual impairment (Wilhelmus et. al., Archives of Ophthalmology 1981; 99(9): 1578-82). The risk to a subject of permanent visual damage due to HSV-related ocular disease increases with increasing numbers of ocular related HSV-reactivations.

Overall, stromal keratitis represents approximately 15% of keratitis cases and is associated with the highest risk of permanent visual damage from keratitis. Stromal keratitis results in scarring and irregular astimagtism. Previous ocular HSV infection increases the risk for developing stromal infection, which means that subjects who have had a prior ocular HSV infection have an increased risk for permanent visual damage on reactivation. In children, stromal keratitis represents up to 60% of all keratitis cases. Therefore, children are particularly at risk for permanent visual damage from HSV-associated keratitis. A retrospective study in the U.S. from 1950-1982 found that there are approximately 2.6 new or recurrent stromal keratitis cases per 100,000 person years, or approximately 8,000 cases of stromal keratitis annually (Liesegang et. al., 1989; 107(8): 1155-1159). A more recent study in France in 2002 estimated the incidence of new or recurrent stromal keratitis cases to be 9.6 per 100,000 (Labetoulle et al., Ophthalmology 2005; 112(5): 888-895). The incidence of HSV-associated keratitis may be increasing in the developed world (Farooq and Shukla 2012; Survey of Ophthalmology 57(5): 448-462).

The genome editing systems, compositions and methods described herein can be used for the treatment, prevention and/or reduction of HSV-1 and/or HSV-2 ocular infections, including but not limited to HSV-1 stromal keratitis, HSV-1 dentritic keratitis, HSV-1 blepharatis, HSV-1 conjunctivitis, HSV-1 retinitis, HSV-2 stromal keratitis, HSV-2 dentritic keratitis, HSV-2 blepharatis, HSV-2 conjunctivitis, and HSV-2 retinitis.

3. Methods to Treat, Prevent and/or Reduce HSV-Related Ocular Infection

Disclosed herein are the approaches to treat, prevent, and/or reduce HSV-related ocular infections, using the methods, genome editing systems, and compositions described herein. HSV-related ocular infection may be caused by an HSV-1 and/or HSV-2 infection. For example, and not by way of limitation. The methods, genome editing systems, and compositions disclosed herein can be used to treat, prevent, and/or reduce HSV-1 infection, HSV-2 infection, or both HSV-1 and HSV-2 infections.

The RS1, RL2, and LAT genes of HSV-1 and HSV-2 are associated with viral infection, proliferation and assembly, as well as maintenance of latency and re-activation of the virus from latency. Knockout or knockdown of any of these genes singly or in combination can reduce HSV-1 and/or HSV-2 infections. As the HSV-1 or HSV-2 virus establishes latency in discrete, localized regions within the body, it is highly amenable to local delivery that delivers a disabling treatment in the region of latency. Targeting knock-out to a discrete region or regions, (e.g., the trigeminal dorsal root ganglion, the cornea, the cervical dorsal root ganglia, or the sacral dorsal root ganglia) can reduce or eliminate latent infection by disabling the HSV-1 and/or HSV-2 virus.

Described herein are the approaches to treat, prevent and/or reduce HSV-1 and/or HSV-2 infections by knocking out or knocking down viral genes. Methods described herein include the knockout or knockdown of the following HSV-1 and/or HSV-2 encoded genes: RL2, LAT and RS1, or any combination thereof (e.g., any single gene, e.g., RL2, e.g., LAT, e.g., RS1, or any two genes, e.g., RL2 and LAT, e.g., RL2 and RS1, e.g., RS1 and LAT, or three three genes). When there are two alterations events (e.g., knocking down or knocking out the expression of the RS1, RL2, and/or LAT gene), the two alteration events may occur sequentially or simultaneously. In certain embodiments, the knockout of the RS1, RL2, and/or LAT gene occurs prior to knockdown of the RS1, RL2, and/or LAT gene gene. In certain embodiments, the knockout of the RS1, RL2, and/or LAT gene is concurrent with knockdown of the RS1, RL2, and/or LAT gene. In certain embodiments, the knockout of the RS1, RL2, and/or LAT gene is subsequent to the knockdown of the RS1, RL2, and/or LAT gene. In certain embodiments, the effect of the alterations is synergistic.

RL2 encodes the gene ICP0, a 775 amino acid protein that is a transactivator of gene expression. The RL2 gene is one of five immediate early genes expressed by herpes viruses. ICP0 is involved in activating the expression of delayed early and late genes (Lees-Miller et al. 1996, Journal of Virology 70(11): 7471-7477). ICP0 is thought to be involved in neurovirulence. In cell culture, ICP0 has been found to be required for reactivation from latency (Leib et al. 1989, Journal of Virology 63:759-768). Deletion mutants not expressing RL2 have been shown to be unable to replicate in vitro (Sacks and Schaffer 1987, Journal of Virology 61(3):829-839). In certain embodiments, knock out of RL2 can disable the ability of HSV-1 and/or HSV-2 to reactivate from latency. In certain embodiments, knock out or knockdown of RL2 can disable the ability of HSV-1 and/or HSV-2 to replicate. In certain embodiments, knockout or knockdown of RL2 can disable the ability of HSV-1 and/or HSV-2 to infect and/or establish latent infections in neural tissue.

LAT encodes the only gene expressed by herpes viruses during the latency period. The latency period is the time in which the virus establishes a quiescent infection in host tissue, often in neural tissue, including the trigeminal ganglion or the sacral ganglia. LAT is thought to be involved in the reactivation of herpes virus infections, allowing the virus to re-infect epithelial and other tissue. In certain embodiments, knockout or knockdown of LAT can disable HSV-1 and/or HSV-2 gene latency and/or reactivation, disrupting the ability of HSV-1 and/or HSV-2 to sustain a latent infection and/or reactivate following latent infection. In certain embodiments, knockout or knockdown of LAT expression eliminates latent infection by HSV-1 and/or HSV-2. In certain embodiments, knockout or knockdown of LAT expression shortens the duration of, treats, and/or cures HSV-1 and/or HSV-2 infections.

RS1 plays an important role in the expression of the immediate early genes by HSV-1 and HSV-2. RS1 is one of five immediate early genes expressed by herpes viruses and is a major transcriptional regulator. RS1 encodes the viral protein ICP4. ICP4 is important for controlling the overall expression of both early and late genes produced by HSV-1 and HSV-2. The RS1 gene is similar in HSV-1 and HSV-2.

In certain embodiments, knockout or knockdown of the RS1, RL2, and/or LAT gene disables HSV-1 and/or HSV-2 gene expression, or reduces one or more of viral replication, assembly, maturation, packaging, or infection. In certain embodiments, knockout of RS1, RL2, and/or LAT gene expression shortens the duration of HSV-1 and/or HSV-2 infections. In certain embodiments, knockout or knockdown of RS1, RL2, and/or LAT gene expression treats or cures HSV-1 and/or HSV-2 infections.

In certain embodiments, reducing the duration, number and/or frequency of ocular related HSV-reactivations can decrease the risk of permanent visual damage in subjects infected with HSV-1 and/or HSV-2.

In certain embodiments, knocking out and/or knocking down RS1, RL2, and/or LAT gene, individually or in combination can make HSV-1 and/or HSV-2 more susceptible to antiviral therapy. Mutations in important genes can render HSV-1, HSV-2 and other viruses more susceptible to treatment with antivirals (Zhou et al., Journal of Virology 2014; 88(19): 11121-11129). Knocking-out or knocking down of the RL2 and LAT and/or RS1 genes, individually or in combination may be combined with an antiviral therapy to treat, prevent and/or reduce HSV-1 and/or HSV-2 infection. The compositions and methods described herein can be used in combination with another antiviral therapy, e.g., another anti-HSV-1 therapy or anti-HSV-2 therapy described herein, to treat, prevent and/or reduce HSV-1 or HSV-2 infection.

In one approach, one, two, or three of the RS1, RL2, and LAT genes is targeted as a targeted knockout or knockdown, e.g., to inhibit one or more viral functions, including, e.g., viral gene regulation, viral gene transcription, viral genome replication, expression of viral latency genes and viral capsid formation. In certain embodiments, said approach comprises knocking out one HSV-1 and/or HSV-2 gene (e.g., RS1, RL2, or LAT gene gene). In certain embodiments, said approach comprises knocking down one HSV-1 and/or HSV-2 gene (e.g., RS1, RL2, or LAT gene). In certain embodiments, said approach comprises knocking out two HSV-1 and/or HSV-2 genes, e.g., both RL2 and LAT genes, e.g., both RL2 and RS1 genes, e.g., both RS1 and LAT genes. In certain embodiments, said approach comprises knocking down two HSV-1 and/or HSV-2 genes, e.g., both RL2 and LAT genes, e.g., both RL2 and RS1 genes, e.g., both RS1 and LAT genes. In certain embodiments, said approach comprises knocking out three HSV-1 and/or HSV-2 genes, e.g., all three RL2, LAT and RS1 genes. In certain embodiments, said approach comprises knocking down three HSV-1 and/or HSV-2 genes, e.g., all three RS1, RL2, and LAT genes.

In certain embodiments, inhibiting one or more viral functions, e.g., viral gene regulation, viral gene transcription, viral genome replication and viral capsid formation, decreases the duration of primary or recurrent infection and/or decreases shedding of viral particles. Subjects may also experience shorter duration(s) of illness, decreased risk of transmission to sexual partners, decreased risk of transmission to the fetus in the case of pregnancy and/or the potential for full clearance of HSV-1 and/or HSV-2 (cure).

Knockout or knockdown of one or more copies (e.g., 1, 2, 3, 4, 5, 6, 7, 8, 9, 10, 20, 30, 40 50, 100, 200, 300, 400, 500, 600, 700, 800, 900, 1000 or more copies) of one or more target gene(s) (e.g., the RS1, RL2, or LAT gene) may be performed prior to disease onset or after disease onset, preferably early in the disease course.

In certain embodiments, the method comprises initiating treatment of a subject prior to disease onset.

In certain embodiments, the method comprises initiating treatment of a subject after disease onset.

In certain embodiments, the method comprises initiating treatment of a subject after disease onset, e.g., 1, 2, 3, 4, 5, 6, 7, 8, 9, 10, 12, 16, 24, 36, 48 or more months after onset of an HSV-1 and/or HSV-2 infection. In certain embodiments, the method comprises initiating treatment of a subject after disease onset, e.g., 1, 2, 3, 4, 5, 10, 15, 20, 25, 40, 50 or 60 years after onset of an HSV-1 and/or HSV-2 infection.

In certain embodiments, the method comprises initiating treatment of a subject in an advanced stage of disease, e.g., during acute or latent periods. In certain embodiments, the method comprises initiating treatment of a subject in severe, acute stages of the disease affecting the central nervous system, eyes, oropharynx, genital region, and/or other regions.

Overall, initiation of treatment for subjects at all stages of disease is expected to improve healing, decrease duration of disease and be of benefit to subjects.

In certain embodiments, the method comprises initiating treatment of a subject prior to disease progression. In certain embodiments, the method comprises initiating treatment of a subject in an early stage of disease, e.g., when a subject has been exposed to HSV-1 and/or HSV-2 or is thought to have been exposed to HSV-1 and/or HSV-2.

In certain embodiments, the method comprises initiating treatment of a subject prior to disease progression. In certain embodiments, the method comprises initiating treatment of a subject in an early stage of disease, e.g., when a subject has tested positive for HSV-1 and/or HSV-2 infections but has no signs or symptoms.

In certain embodiments, the method comprises initiating treatment at the appearance of one or more of the following findings consistent or associated with an HSV-1 and/or HSV-2 infection: fever, headache, body aches, ano-genital blistering, oral ulceration, encephalitis, or keratitis.

In certain embodiments, the method comprises initiating treatment of a subject at the appearance of painful blistering in or around the mouth, e.g., oral or oropharynx, e.g., in an infant, child, adult or young adult.

In certain embodiments, the method comprises initiating treatment of a subject at the appearance of painful blistering in the ano-genital region, geneital ulcers, and/or a flu-like symptom, e.g., in an infant, child, adult or young adult.

In certain embodiments, the method comprises initiating treatment of a subject suspected of having HSV-1 and/or HSV-2 meningitis and/or HSV-1 and/or HSV-2 encephalitis.

In certain embodiments, the method comprises initiating treatment at the appearance of one or more of the following symptoms consistent or associated with HSV-1 and/or HSV-2 meningitis and/or encephalitis: fever, headache, vomiting, photophobia, seizure, decline in level of consciousness, lethargy, or drowsiness.

In certain embodiments, the method comprises initiating treatment at the appearance of any of the following signs consistent or associated with HSV-1 and/or HSV meningitis and/or encephalitis: positive CSF culture for HSV-1 and/or HSV-2, elevated WBC in CSF, neck stiffness/positive Brudzinski's sign. In certain embodiments, the method comprises initiating treatment in a patient with signs consistent with HSV-1 and/or HSV-2 encephalitis and/or meningitis on EEG, CSF exam, MRI, PCR of CSF specimen, and/or PCR of brain biopsy specimen.

In certain embodiments, the method comprises initiating treatment at the appearance of any of the following symptoms consistent or associated with optic HSV-1 and/or HSV-2: pain, photophobia, blurred vision, tearing, redness/injection, loss of vision, floaters, or flashes.

In certain embodiments, the method comprises initiating treatment at the appearance of any of the following findings on ophthalmologic exam consistent or associated with optic HSV-1 and/or HSV-2, also known as HSV-1 and/or HSV-2 keratitis: small, raised clear vesicles on corneal epithelium; irregular corneal surface, punctate epithelial erosions; dense stromal infiltrate; ulceration; necrosis; focal, multifocal, or diffuse cellular infiltrates; immune rings; neovascularization; or ghost vessels at any level of the cornea.

In certain embodiments, the method comprises initiating treatment at the appearance of any of the following findings on ophthalmologic exam consistent or associated with HSV-1 and/or HSV-2 retinitis or acute retinal necrosis: reduced visual acuity; uveitis; vitritis; scleral injection; inflammation of the anterior and/or vitreous chamber/s; vitreous haze; optic nerve edema; peripheral retinal whitening; retinal tear; retinal detachment; retinal necrosis; evidence of occlusive vasculopathy with arterial involvement, including arterioloar sheathing and arteriolar attenuation.

In certain embodiments, the method comprises initiating treatment at the appearance of symptoms and/or signs consistent or associated with either an HSV-1 or an HSV-2 infection of the eye, oropharynx, ano-genital region or central nervous system. In certain embodiments, initiating treatment for an HSV-1 and/or HSV-2 infection in a case of suspected HSV-1 or HSV-2 infection early in the disease course is beneficial.

In certain embodiments, the method comprises initiating treatment in utero. In certain embodiments, the subject is at high risk of maternal-to-fetal transmission.

In certain embodiments, the method comprises initiating treatment during pregnancy in case of mother who has an active HSV-1 and/or HSV-2 infection or has recent primary HSV-1 and/or HSV-2 infection.

In certain embodiments, the method comprises initiating treatment prior to organ transplantation or immediately following organ transplantation.

In certain embodiments, the method comprises initiating treatment in case of suspected exposure to HSV-1 and/or HSV-2.

In certain embodiments, the method comprises initiating treatment prophylactically, in case of suspected HSV-encephalitis or meningitis.

In certain embodiments, it is considered that both HIV positive subjects and post-transplant subjects may experience severe HSV-1 and/or HSV-2 activation or reactivation, including HSV-encephalitis and meningitis, due to immunodeficiency. Neonates are also at risk for severe HSV-encephalitis due to maternal-fetal transmission during childbirth. Inhibiting one or more viral functions, e.g., viral gene regulation, viral gene transcription, viral genome replication, and viral capsid formation, may provide superior protection to said populations at risk for severe HSV-1 and/or HSV-2 infections. Subjects may experience lower rates of HSV-1 and/or HSV-2 encephalitis and/or lower rates of severe neurologic sequelae following HSV-1 and/or HSV-2 encephalitis, which will profoundly improve quality of life.

In certain embodiments, the method comprises initiating treatment of a subject who suffers from or is at risk of developing severe manifestations of HSV-1 and/or HSV-2 infections, e.g., a neonates, a subjects with HIV, a subject who is undergoing an immunosuppressant therapy, e.g., following organ transplantation, a subject who has cancer, a subject who is undergoing chemotherapy, a subject who is undergoing chemotherapy, a subject who is undergoing radiation therapy, a subject who will undergo radiation therapy.

In certain embodiments, both HIV positive subjects and post-transplant subjects may experience severe HSV-1 and/or HSV-2 activation or reactivation, including HSV-encephalitis and meningitis, due to immunodeficiency. Neonates are also at risk for severe HSV-encephalitis due to maternal-fetal transmission during childbirth. Inhibiting essential viral functions, e.g., viral gene regulation, viral gene transcription, expression of viral latency genes, viral genome replication and viral capsid formation, may provide superior protection to said populations at risk for severe HSV-1 and/or HSV-2 infections. Subjects may experience lower rates of HSV-1 and/or HSV-2 encephalitis and/or lower rates of severe neurologic sequelae following HSV-1 and/or HSV-2 encephalitis, which will profoundly improve quality of life.

In certain embodiments, the method comprises initiating treatment of a subject who has tested positive for HSV-1 and/or HSV-2.

In certain embodiments, the method comprises initiating treatment in a subject who has tested positive for HSV-1 and/or HSV-2 infection. HSV-1 and/or HSV-2 infections can be tested, e.g., using viral culture, direct fluorescent antibody study, skin biopsy, PCR, blood serologic test, CSF serologic test, CSF PCR, or brain biopsy. In certain embodiments, the method comprises initiating treatment in a subject who has tested positive for HSV-2 infection via diagnostic vitrectomy, endoretinal biopsy, or PCR of aqueous fluid, PCR of vitreous sample.

In certain embodiments, the method comprises initiating treatment in a subject exposed to HSV-1 and/or HSV-2 and at high risk for severe sequelae from HSV infection.

In certain embodiments, a cell is manipulated by editing (e.g., introducing a mutation in) one or more target genes, e.g., the RS1, RL2, or LAT gene. In certain embodiments, the expression of one or more target genes (e.g., one or more RS1, RL2, or LAT gene described herein) is modulated, e.g., in vivo.

In certain embodiments, the method comprises delivery of gRNA molecule by an adeno-associated virus (AAV). In certain embodiments, the method comprises delivery of gRNA molecule by a lentivirus (LV). In certain embodiments, the method comprises delivery of gRNA molecule by a nanoparticle.

In certain embodiments, the method further comprising administering to the subject a second antiviral therapy or therapeutic agent, e.g., an anti-HSV-1 or anti-HSV-2 therapy or therapeutic agent described herein. The composition and the other therapy or therapeutic agent can be administered in any order. For example, the compositions described herein can be administered concurrently with, prior to, or subsequent to, one or more additional therapies or therapeutic agents. In certain embodiments, the effect of the two or more therapies or therapeutic agents is synergistic. Exemplary anti-HSV-1 and anti-HSV-2 therapies and therapeutic agents include, but are not limited to, acyclovir, valacyclovir, famciclovir, penciclovir, or a vaccine.

4. Methods of Altering RS1, RL2, and/or LAT Gene(s)

As disclosed herein, the RS1, RL2, and/or LAT gene can be altered by the genome editing systems, compositions and methods as described herein.

Methods, genome editing systems, and compositions discussed herein, provide for altering (e.g., knocking out or knocking down) an HSV RS1 target position, an HSV RL2 target position, or an HSV LAT target position.

As disclosed herein, an HSV RS1 target position, an HSV RL2 target position, or an HSV LAT target position, can be altered, alone or in combination, by gene editing, e.g., using CRISPR-Cas9 mediated methods, genome editing systems, and composition described herein. Altering (e.g., knocking out or knocking down) an HSV RS1 target position, an HSV RL2 target position, or an HSV LAT target position can be achieved, e.g., by:

(1) knocking out the RS1, RL2, or LAT gene:
 (a) insertion or deletion (e.g., NHEJ-mediated insertion or deletion) of one or more nucleotides in close proximity to or within the early coding region of the RS1, RL2, or LAT gene; or
 (b) deletion (e.g., NHEJ-mediated deletion) of a genomic sequence or multiple genomic sequences including at least a portion of the RS1, RL2, or LAT gene; or
(2) knocking down the RS1, RL2, or LAT gene mediated by an eiCas9 molecule or an eiCas9-fusion protein by targeting a non-coding region, e.g., a promoter region, of the RS1, RL2, or LAT gene.

All approaches give rise to altering (e.g., knocking out or knocking down) the RS1, RL2, and/or LAT gene(s). Exemplary mechanisms that can be associated with an alteration of one or both of the RS1, RL2, and/or LAT gene(s) include, but are not limited to, non-homologous end joining (e.g., classical or alternative), microhomology-mediated end joining (MMEJ), homology-directed repair (e.g., endogenous donor template mediated), SDSA (synthesis dependent strand annealing), single strand annealing or single strand invasion.

In certain embodiments, the methods, genome editing systems, and composition described herein introduce one or more breaks near the early coding region of the RS1, RL2, and/or LAT gene(s). In certain embodiments, methods, genome editing systems, and compositions described herein introduce two or more breaks to flank at least a portion of the RS1, RL2, and/or LAT gene(s). The two or more breaks remove (e.g., delete) a genomic sequence including at least a portion of the RS1, RL2, and/or LAT gene(s). In certain embodiments, methods described herein comprise knocking down the RS1, RL2, and/or LAT gene(s) mediated by eiCas9 molecule or an eiCas9-fusion protein by targeting the promoter region of HSV RL2 and/or HSV LAT and/or RS1 target knockdown position(s). All methods described herein result in altering (e.g., knocking out or knocking down) the RS1, RL2, and/or LAT gene(s).

4.1 Knocking Out the RS1, RL2, or LAT Gene by Introducing an Indel or a Deletion in the RS1, RL2, or LAT Gene In certain embodiments, the method comprises introducing an insertion or deletion of one or more nucleotides in close proximity to an HSV RS1 target knockout position, an HSV RL2 target knockout position, or an HSV LAT target knockout position (e.g., the early coding region) of the RS1, RL2, and/or LAT gene(s). As described herein, in certain embodiments, the method comprises the introduction of one or more breaks (e.g., single strand breaks or double strand breaks) sufficiently close to (e.g., either 5' or 3' to) the early coding region of an HSV RL2 target knockout position, or an HSV LAT target knockout position, such that the break-induced indel could be reasonably expected to span an HSV RL2 target knockout position, or an HSV LAT target knockout position (e.g., the early coding region). NHEJ-mediated repair of the break(s) allows for the NHEJ-mediated introduction of an indel in close proximity to or within the early coding region of an HSV RL2 target knockout position, or an HSV LAT target knockout position.

In certain embodiments, the method comprises introducing a deletion of a genomic sequence comprising at least a portion of the RS1, RL2, and/or LAT gene. As described herein, in an embodiment, the method comprises the introduction of two double stand breaks—one 5' and the other 3' to (i.e., flanking) the RL2, LAT or RS1 target position. In an embodiment, two gRNAs, e.g., unimolecular (or chimeric) or modular gRNA molecules, are configured to position the two double strand breaks on opposite sides of the RL2, LAT or RS1 target knockout position in the RS1, RL2, and/or LAT gene.

In certain embodiments, a single strand break is introduced (e.g., positioned by one gRNA molecule) at or in close proximity to an HSV RS1 target position, an HSV RL2 target position, or an HSV LAT target position. In certain embodiments, a single gRNA molecule (e.g., with a Cas9 nickase) is used to create a single strand break at or in close proximity to an HSV RS1 target position, an HSV RL2 target position, or an HSV LAT target position, e.g., the gRNA molecule is configured such that the single strand break is positioned either upstream (e.g., within 200 bp upstream) or downstream (e.g., within 200 bp downstream) of an HSV RS1 target position, an HSV RL2 target position, or an HSV LAT target position. In certain embodiments, the break is positioned to avoid unwanted target chromosome elements, such as repeat elements, e.g., an Alu repeat.

In certain embodiments, a double strand break is introduced (e.g., positioned by one gRNA molecule) at or in close proximity to an HSV RS1 target position, an HSV RL2 target position, or an HSV LAT target position. In certain embodiments, a single gRNA molecule (e.g., with a Cas9 nuclease other than a Cas9 nickase) is used to create a double strand break at or in close proximity to an HSV RS1 target position, an HSV RL2 target position, or an HSV LAT target position, e.g., the gRNA molecule is configured such that the double strand break is positioned either upstream (e.g., within 200 bp upstream) or downstream of (e.g., within 200 bp downstream) of an HSV RS1 target position, an HSV RL2 target position, or an HSV LAT target position. In certain embodiments, the break is positioned to avoid unwanted target chromosome elements, such as repeat elements, e.g., an Alu repeat.

In certain embodiments, two single strand breaks are introduced (e.g., positioned by two gRNA molecules) at or in close proximity to an HSV RS1 target position, an HSV RL2 target position, or an HSV LAT target position. In certain embodiments, two gRNA molecules (e.g., with one or two Cas9 nickases) are used to create two single strand breaks at or in close proximity to an HSV RS1 target position, an HSV RL2 target position, or an HSV LAT target position, e.g., the gRNAs molecules are configured such that both of the single strand breaks are positioned upstream (e.g., within 200 bp upstream) or downstream (e.g., within 200 bp downstream) of an HSV RS1 target position, an HSV RL2 target position, or an HSV LAT target position. In certain embodiments, two gRNA molecules (e.g., with two Cas9 nickases) are used to create two single strand breaks at or in close proximity to an HSV RS1 target position, an HSV RL2 target position, or an HSV LAT target position, e.g., the gRNAs molecules are configured such that one single strand break is positioned upstream (e.g., within 200 bp upstream) and a second single strand break is positioned downstream (e.g., within 200 bp downstream) of an HSV RS1 target position, an HSV RL2 target position, or an HSV LAT target position. In certain embodiments, the breaks are positioned to avoid unwanted target chromosome elements, such as repeat elements, e.g., an Alu repeat.

In certain embodiments, two double strand breaks are introduced (e.g., positioned by two gRNA molecules) at or in close proximity to an HSV RS1 target position, an HSV RL2 target position, or an HSV LAT target position. In certain embodiments, two gRNA molecules (e.g., with one or two Cas9 nucleases that are not Cas9 nickases) are used to create two double strand breaks to flank an HSV RS1 target position, an HSV RL2 target position, or an HSV LAT target position, e.g., the gRNA molecules are configured such that one double strand break is positioned upstream (e.g., within 200 bp upstream) and a second double strand break is positioned downstream (e.g., within 200 bp downstream) of an HSV RS1 target position, an HSV RL2 target position, or an HSV LAT target position. In certain embodiments, the breaks are positioned to avoid unwanted target chromosome elements, such as repeat elements, e.g., an Alu repeat.

In certain embodiments, one double strand break and two single strand breaks are introduced (e.g., positioned by three gRNA molecules) at or in close proximity to an HSV RS1 target position, an HSV RL2 target position, or an HSV LAT target position. In certain embodiments, three gRNA molecules (e.g., with a Cas9 nuclease other than a Cas9 nickase and one or two Cas9 nickases) to create one double strand break and two single strand breaks to flank an HSV RS1 target position, an HSV RL2 target position, or an HSV LAT target position, e.g., the gRNA molecules are configured such that the double strand break is positioned upstream or downstream of (e.g., within 200 bp upstream or downstream) oft an HSV RS1 target position, an HSV RL2 target position, or an HSV LAT target position, and the two single strand breaks are positioned at the opposite site, e.g., downstream or upstream (within 200 bp downstream or upstream), of an HSV RS1 target position, an HSV RL2 target position, or an HSV LAT target position. In certain embodiments, the breaks are positioned to avoid unwanted target chromosome elements, such as repeat elements, e.g., an Alu repeat.

In certain embodiments, four single strand breaks are introduced (e.g., positioned by four gRNA molecules) at or in close proximity to an HSV RS1 target position, an HSV RL2 target position, or an HSV LAT target position. In certain embodiments, four gRNA molecule (e.g., with one or more Cas9 nickases are used to create four single strand breaks to flank an HSV RS1 target position, an HSV RL2 target position, or an HSV LAT target position, e.g., the gRNA molecules are configured such that a first and second single strand breaks are positioned upstream (e.g., within 200 bp upstream) of an HSV RS1 target position, an HSV RL2 target position, or an HSV LAT target position, and a third and a fourth single stranded breaks are positioned downstream (e.g., within 200 bp downstream) of an HSV RS1 target position, an HSV RL2 target position, or an HSV LAT target position. In certain embodiments, the breaks are positioned to avoid unwanted target chromosome elements, such as repeat elements, e.g., an Alu repeat.

In certain embodiments, two or more (e.g., three or four) gRNA molecules are used with one Cas9 molecule or Cas9-fusion protein. In certain embodiments, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

4.2. Knocking Out the One or More of the RS1, RL2, and/or LAT Gene(s) by Deleting (e.g., NHEJ-Mediated Deletion) a Genomic Sequence or Multiple Genomic Sequences Comprising at Least a Portion of the RS1, RL2, and/or LAT Gene(s)

In certain embodiments, the method comprises deleting (e.g., NHEJ-mediated deletion) a genomic sequence including at least a portion of the RS1, RL2, and/or LAT gene(s) or multiple genomic sequences including at least a portion of the RS1, RL2, and/or LAT gene(s). In certain embodiments, the method comprises the introduction of two double stand breaks—one 5' and the other 3' to (i.e., flanking) an HSV RS1 target knockout position, an HSV RL2 target knockout position or an HSV LAT target knockout position. In certain embodiments, two gRNAs, e.g., unimolecular (or chimeric) or modular gRNA molecules, are configured to position the two double strand breaks on opposite sides of the HSV RL2 target knockout position in the RL2 gene. In certain embodiments, two gRNAs, e.g., unimolecular (or chimeric) or modular gRNA molecules, are configured to position the two double strand breaks on opposite sides of the HSV LAT target knockout position in the LAT gene. In certain embodiments, two gRNAs, e.g., unimolecular (or chimeric) or modular gRNA molecules, are configured to position the two double strand breaks on opposite sides of the HSV RS1 target knockout position in the RS1 gene.

4.3. Knocking Down One or More of the RS1, RL2, and/or LAT Gene(s) Mediated by an Enzymatically Inactive Cas9 (eiCas9) Molecule or an eiCas9 Fusion Protein A targeted knockdown approach reduces or eliminates expression of functional RS1, RL2, and/or LAT gene product(s). As described herein, in certain embodiments, a targeted knockdown is mediated by targeting an enzymatically inactive Cas9 (eiCas9) molecule or an eiCas9-fusion protein (e.g., a eiCas9 fused to a transcription repressor domain or chromatin modifying protein) to one, two, or three of the RS1, RL2, and/or LAT gene(s).

Methods and compositions discussed herein may be used to alter the expression of one or more of the RS1, RL2, and/or LAT gene(s) to treat or prevent HSV-1 or HSV-2 infection by targeting a transcriptional regulatory region, e.g., a promoter region (e.g., a promoter region that controls the transcription of one or more of the RS1, RL2, and LAT genes). In certain embodiments, the promoter region is targeted to knock down expression of one or more of the RS1, RL2, and/or LAT genes. A targeted knockdown approach reduces or eliminates expression of functional RS1, RL2, and/or LAT gene product(s).

In certain embodiments, one or more eiCas9s may be used to block binding of one or more endogenous transcription factors. In certain embodiments, an eiCas9 can be fused to a chromatin modifying protein. Altering chromatin status can result in decreased expression of the target gene. One or more eiCas9s fused to one or more chromatin modifying proteins may be used to alter chromatin status.

In certain embodiments, eiCas9 mediated reduction in the expression of one or more of the RS1, RL2, and/or LAT gene(s) causes the reduction and/or cessation of transcription of RS1, RL2, and/or LAT RNA. In certain embodiments, eiCas9 mediated reduction in the expression of one or more of the RS1, RL2, and/or LAT gene(s) leads to reduction and/or cessation of translation of HSV-1 or HSV-2 proteins encoded by the RS1, RL2, and/or LAT gene(s), e.g., ICP0 protein and/or LAT protein and/or transcriptional regulator ICP4 protein. In certain embodiments, eiCas9 mediated reduction in the expression of one or more of the RS1, RL2, and/or LAT genes gives rise to any of the following, singly or in combination: decreased HSV DNA production, decreased HSV shedding, decreased HSV replication, decreased viral infectivity, decreased packaging of viral particles, decreased production of viral proteins, e.g., ICP0 proteins, e.g., transcriptional regulator ICP4 protein.

In certain embodiments, knockdown of one or more of the RS1, RL2, and/or LAT gene(s) cures HSV-1 or HSV-2 infection. In certain embodiments, knock down of one or more of the RS1, RL2, and/or LAT gene(s) leads to a functional cure of HSV-1 or HSV-2 infection. In certain embodiments, knock down of one or more of the RS1, RL2, and/or LAT gene(s) leads to a sustained virologic response to HSV-1 or HSV-2 infection. A targeted knockdown approach during an acute episode may decrease viral shedding, replication, which leads to decreased inflammation, which can decease damage to eyes. In certain embodiments, the eiCas9 molecule can be a Cas9 variant, as disclosed herein. For example, and not by way of limitation, the Cas9 variant can be a *S. pyogenes* Cas9 variant or a *S. aureus* Cas9 variant. In certain embodiments, the *S. pyogenes* Cas9 variant is the EQR variant. In certain embodiments, the *S. pyogenes* Cas9 variant is the VRER variant.

5. Guide RNA (gRNA) Molecules

Figure 7:
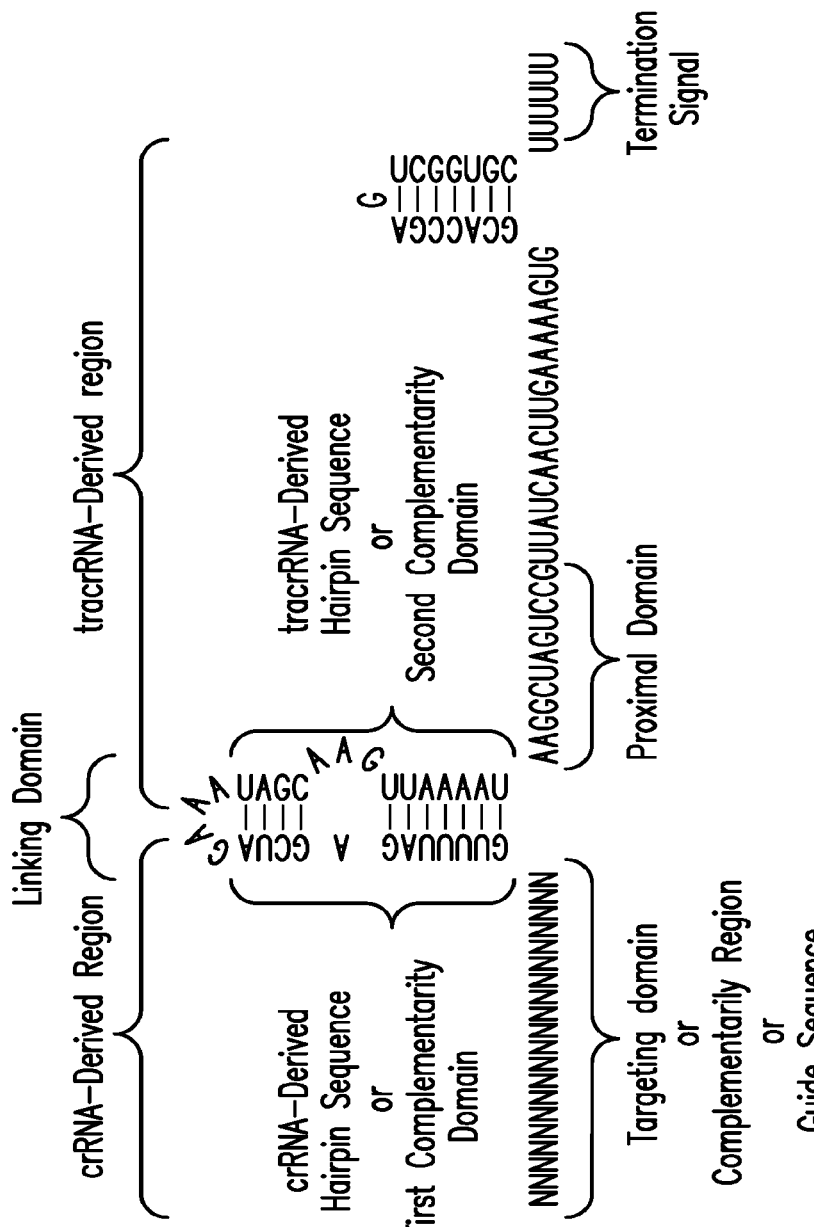
FIG. 7 illustrates gRNA domain nomenclature using an exemplary gRNA sequence (SEQ ID NO:42).

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule) (e.g., chimeric), or modular (comprising more than one, and typically two, separate RNA molecules). The gRNA molecules provided herein comprise a targeting domain comprising, consisting of, or consisting essentially of a nucleic acid sequence fully or partially complementary to a target domain (also referred to as "target sequence"). In certain embodiments, the gRNA molecule further comprises one or more additional domains, including for example a first complementarity domain, a linking domain, a second complementarity domain, a proximal domain, a tail domain, and a 5' extension domain. Each of these domains is discussed in detail below. In certain embodiments, one or more of the domains in the gRNA molecule comprises a nucleotide sequence identical to or sharing sequence homology with a naturally occurring sequence, e.g., from *S. pyogenes, S. aureus*, or *S. thermophilus*. In certain embodiments, one or more of the domains in the gRNA molecule comprises a nucleotide sequence identical to or sharing sequence homology with a naturally occurring sequence, e.g., from *S. pyogenes* or *S. aureus*, Several exemplary gRNA structures are provided in FIGS. 1A-1I. With regard to the three-dimensional form, or intra- or inter-strand interactions of an active form of a gRNA, regions of high complementarity are sometimes shown as duplexes in FIGS. 1A-1I and other depictions provided herein. FIG. 7 illustrates gRNA domain nomenclature using the gRNA sequence of SEQ ID NO:42, which contains one hairpin loop in the tracrRNA-derived region. In certain embodiments, a gRNA may contain more than one (e.g., two, three, or more) hairpin loops in this region (see, e.g., FIGS. 1H-1I).

In certain embodiments, a unimolecular, or chimeric, gRNA comprises, preferably from 5' to 3':

a targeting domain complementary to a target domain in a RL2, LAT, or a RS1 gene, e.g., a targeting domain comprising a nucleotide sequence selected from SEQ ID NOs: 208 to 58749;

a first complementarity domain;

a linking domain;

a second complementarity domain (which is complementary to the first complementarity domain);

a proximal domain; and optionally, a tail domain.

In certain embodiments, a modular gRNA comprises:
a first strand comprising, preferably from 5' to 3':
a targeting domain complementary to a target domain in a RL2, LAT, or RS1 gene, e.g., a targeting domain comprising a nucleotide sequence selected from SEQ ID NOs: 208 to 58749; and
a first complementarity domain; and
a second strand, comprising, preferably from 5' to 3':
optionally, a 5' extension domain;
a second complementarity domain;
a proximal domain; and
optionally, a tail domain.

5.1 Targeting Domain

The targeting domain (sometimes referred to alternatively as the guide sequence) comprises, consists of, or consists essentially of a nucleic acid sequence that is complementary or partially complementary to a target nucleic acid sequence in a RL2, LAT, or RS1 gene. The nucleic acid sequence in a RL2, LAT, or RS1 gene to which all or a portion of the targeting domain is complementary or partially complementary is referred to herein as the target domain.

Methods for selecting targeting domains are known in the art (see, e.g., Fu 2014; Sternberg 2014). Examples of suitable targeting domains for use in the methods, compositions, and kits described herein comprise nucleotide sequences set forth in SEQ ID NOs: 208 to 58749.

The strand of the target nucleic acid comprising the target domain is referred to herein as the complementary strand because it is complementary to the targeting domain sequence. Since the targeting domain is part of a gRNA molecule, it comprises the base uracil (U) rather than thymine (T); conversely, any DNA molecule encoding the gRNA molecule can comprise thymine rather than uracil. In a targeting domain/target domain pair, the uracil bases in the targeting domain will pair with the adenine bases in the target domain. In certain embodiments, the degree of complementarity between the targeting domain and target domain is sufficient to allow targeting of a Cas9 molecule to the target nucleic acid.

In certain embodiments, the targeting domain comprises a core domain and an optional secondary domain. In certain of these embodiments, the core domain is located 3' to the secondary domain, and in certain of these embodiments the core domain is located at or near the 3' end of the targeting domain. In certain of these embodiments, the core domain consists of or consists essentially of about 8 to about 13 nucleotides at the 3' end of the targeting domain. In certain embodiments, only the core domain is complementary or partially complementary to the corresponding portion of the target domain, and in certain of these embodiments the core domain is fully complementary to the corresponding portion of the target domain. In certain embodiments, the secondary domain is also complementary or partially complementary to a portion of the target domain. In certain embodiments, the core domain is complementary or partially complementary to a core domain target in the target domain, while the secondary domain is complementary or partially complementary to a secondary domain target in the target domain. In certain embodiments, the core domain and secondary domain have the same degree of complementarity with their respective corresponding portions of the target domain. In certain embodiments, the degree of complementarity between the core domain and its target and the degree of complementarity between the secondary domain and its target may differ. In certain of these embodiments, the core domain may have a higher degree of complementarity for its target than the secondary domain, whereas in other embodiments the secondary domain may have a higher degree of complementarity than the core domain.

In certain embodiments, the targeting domain and/or the core domain within the targeting domain is 3 to 100, 5 to 100, 10 to 100, or 20 to 100 nucleotides in length, and in certain of these embodiments the targeting domain or core domain is 3 to 15, 3 to 20, 5 to 20, 10 to 20, 15 to 20, 5 to 50, 10 to 50, or 20 to 50 nucleotides in length. In certain embodiments, the targeting domain and/or the core domain within the targeting domain is 6, 7, 8, 9, 10, 11, 12, 13, 14, 15, 16, 17, 18, 19, 20, 21, 22, 23, 24, 25, or 26 nucleotides in length. In certain embodiments, the targeting domain and/or the core domain within the targeting domain is 6+/−2, 7+/−2, 8+/−2, 9+/−2, 10+/−2, 10+/−4, 10+/−5, 11+/−2, 12+/−2, 13+/−2, 14+/−2, 15+/−2, or 16+−2, 20+/−5, 30+/−5, 40+/−5, 50+/−5, 60+/−5, 70+/−5, 80+/−5, 90+/−5, or 100+/−5 nucleotides in length.

In certain embodiments wherein the targeting domain includes a core domain, the core domain is 3 to 20 nucleotides in length, and in certain of these embodiments the core domain 5 to 15 or 8 to 13 nucleotides in length. In certain embodiments wherein the targeting domain includes a secondary domain, the secondary domain is 0, 1, 2, 3, 4, 5, 6, 7, 8, 9, 10, 11, 12, 13, 14 or 15 nucleotides in length. In certain embodiments wherein the targeting domain comprises a core domain that is 8 to 13 nucleotides in length, the targeting domain is 26, 25, 24, 23, 22, 21, 20, 19, 18, 17, or 16 nucleotides in length, and the secondary domain is 13 to 18, 12 to 17, 11 to 16, 10 to 15, 9 to 14, 8 to 13, 7 to 12, 6 to 11, 5 to 10, 4 to 9, or 3 to 8 nucleotides in length, respectively.

In certain embodiments, the targeting domain is fully complementary to the target domain. Likewise, where the targeting domain comprises a core domain and/or a secondary domain, in certain embodiments one or both of the core domain and the secondary domain are fully complementary to the corresponding portions of the target domain. In certain embodiments, the targeting domain is partially complementary to the target domain, and in certain of these embodiments where the targeting domain comprises a core domain and/or a secondary domain, one or both of the core domain and the secondary domain are partially complementary to the corresponding portions of the target domain. In certain of these embodiments, the nucleic acid sequence of the targeting domain, or the core domain or targeting domain within the targeting domain, is at least about 80%, about 85%, about 90%, or about 95% complementary to the target domain or to the corresponding portion of the target domain. In certain embodiments, the targeting domain and/or the core or secondary domains within the targeting domain include one or more nucleotides that are not complementary with the target domain or a portion thereof, and in certain of these embodiments the targeting domain and/or the core or secondary domains within the targeting domain include 1, 2, 3, 4, 5, 6, 7, or 8 nucleotides that are not complementary with the target domain. In certain embodiments, the core domain includes 1, 2, 3, 4, or 5 nucleotides that are not complementary with the corresponding portion of the target domain. In certain embodiments wherein the targeting domain includes one or more nucleotides that are not complementary with the target domain, one or more of said non-complementary nucleotides are located within five nucleotides of the 5' or 3' end of the targeting domain. In certain of these embodiments, the targeting domain includes 1, 2, 3, 4, or 5 nucleotides within five nucleotides of its 5' end, 3' end, or both its 5' and 3' ends that are not complementary to the target domain. In certain embodiments wherein the targeting domain includes two or more nucleotides that are not complementary to the target domain, two or more of said non-complementary nucleotides are adjacent to one another, and in certain of these embodiments the two or more consecutive non-complementary nucleotides are located within five nucleotides of the 5' or 3' end of the targeting domain. In certain embodiments, the two or more consecutive non-complementary nucleotides are both located more than five nucleotides from the 5' and 3' ends of the targeting domain.

In certain embodiments, the targeting domain, core domain, and/or secondary domain do not comprise any modifications. In certain embodiments, the targeting domain, core domain, and/or secondary domain, or one or more nucleotides therein, have a modification, including but not limited to the modifications set forth below. In certain embodiments, one or more nucleotides of the targeting domain, core domain, and/or secondary domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the targeting domain, core domain, and/or secondary domain render the targeting domain and/or the gRNA comprising the targeting domain less susceptible to degradation or more bio-compatible, e.g., less immunogenic. In certain embodiments, the targeting domain and/or the core or secondary domains include 1, 2, 3, 4, 5, 6, 7, or 8 or more modifications, and in certain of these embodiments the targeting domain and/or core or secondary domains include 1, 2, 3, or 4 modifications within five nucleotides of their respective 5' ends and/or 1, 2, 3, or 4 modifications within five nucleotides of their respective 3' ends. In certain embodiments, the targeting domain and/or the core or secondary domains comprise modifications at two or more consecutive nucleotides.

In certain embodiments wherein the targeting domain includes core and secondary domains, the core and secondary domains contain the same number of modifications. In certain of these embodiments, both domains are free of modifications. In other embodiments, the core domain includes more modifications than the secondary domain, or vice versa.

In certain embodiments, modifications to one or more nucleotides in the targeting domain, including in the core or secondary domains, are selected to not interfere with targeting efficacy, which can be evaluated by testing a candidate modification using a system as set forth below. gRNAs having a candidate targeting domain having a selected length, sequence, degree of complementarity, or degree of modification can be evaluated using a system as set forth below. The candidate targeting domain can be placed, either alone or with one or more other candidate changes in a gRNA molecule/Cas9 molecule system known to be functional with a selected target, and evaluated.

In certain embodiments, all of the modified nucleotides are complementary to and capable of hybridizing to corresponding nucleotides present in the target domain. In certain embodiments, 1, 2, 3, 4, 5, 6, 7 or 8 or more modified nucleotides are not complementary to or capable of hybridizing to corresponding nucleotides present in the target domain.

5.2 First and Second Complementarity Domains

The first and second complementarity (sometimes referred to alternatively as the crRNA-derived hairpin sequence and tracrRNA-derived hairpin sequences, respectively) domains are fully or partially complementary to one another. In certain embodiments, the degree of complementarity is sufficient for the two domains to form a duplexed region under at least some physiological conditions. In certain embodiments, the degree of complementarity between the first and second complementarity domains, together with other properties of the gRNA, is sufficient to allow targeting of a Cas9 molecule to a target nucleic acid. Examples of first and second complementary domains are set forth in FIGS. 1A-1G.

In certain embodiments (see, e.g., FIGS. 1A-1B) the first and/or second complementarity domain includes one or more nucleotides that lack complementarity with the corresponding complementarity domain. In certain embodiments, the first and/or second complementarity domain includes 1, 2, 3, 4, 5, or 6 nucleotides that do not complement with the corresponding complementarity domain. For example, the second complementarity domain may contain 1, 2, 3, 4, 5, or 6 nucleotides that do not pair with corresponding nucleotides in the first complementarity domain. In certain embodiments, the nucleotides on the first or second complementarity domain that do not complement with the corresponding complementarity domain loop out from the duplex formed between the first and second complementarity domains. In certain of these embodiments, the unpaired loop-out is located on the second complementarity domain, and in certain of these embodiments the unpaired region begins 1, 2, 3, 4, 5, or 6 nucleotides from the 5' end of the second complementarity domain.

In certain embodiments, the first complementarity domain is 5 to 30, 5 to 25, 7 to 25, 5 to 24, 5 to 23, 7 to 22, 5 to 22, 5 to 21, 5 to 20, 7 to 18, 7 to 15, 9 to 16, or 10 to 14 nucleotides in length, and in certain of these embodiments the first complementarity domain is 5, 6, 7, 8, 9, 10, 11, 12, 13, 14, 15, 16, 17, 18, 19, 20, 21, 22, 23, 24, or 25 nucleotides in length. In certain embodiments, the second complementarity domain is 5 to 27, 7 to 27, 7 to 25, 5 to 24, 5 to 23, 5 to 22, 5 to 21, 7 to 20, 5 to 20, 7 to 18, 7 to 17, 9 to 16, or 10 to 14 nucleotides in length, and in certain of these embodiments the second complementarity domain is 5, 6, 7, 8, 9, 10, 11, 12, 13, 14, 15, 16, 17, 18, 19, 20, 21, 22, 23, 24, 25, or 26 nucleotides in length. In certain embodiments, the first and second complementarity domains are each independently 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length. In certain embodiments, the second complementarity domain is longer than the first complementarity domain, e.g., 2, 3, 4, 5, or 6 nucleotides longer.

In certain embodiments, the first and/or second complementarity domains each independently comprise three subdomains, which, in the 5' to 3' direction are: a 5' subdomain, a central subdomain, and a 3' subdomain. In certain embodiments, the 5' subdomain and 3' subdomain of the first complementarity domain are fully or partially complementary to the 3' subdomain and 5' subdomain, respectively, of the second complementarity domain.

In certain embodiments, the 5' subdomain of the first complementarity domain is 4 to 9 nucleotides in length, and in certain of these embodiments the 5' domain is 4, 5, 6, 7, 8, or 9 nucleotides in length. In certain embodiments, the 5' subdomain of the second complementarity domain is 3 to 25, 4 to 22, 4 to 18, or 4 to 10 nucleotides in length, and in certain of these embodiments the 5' domain is 3, 4, 5, 6, 7, 8, 9, 10, 11, 12, 13, 14, 15, 16, 17, 18, 19, 20, 21, 22, 23, 24, or 25 nucleotides in length. In certain embodiments, the central subdomain of the first complementarity domain is 1, 2, or 3 nucleotides in length. In certain embodiments, the central subdomain of the second complementarity domain is 1, 2, 3, 4, or 5 nucleotides in length. In certain embodiments, the 3' subdomain of the first complementarity domain is 3 to 25, 4 to 22, 4 to 18, or 4 to 10 nucleotides in length, and in certain of these embodiments the 3' subdomain is 3, 4, 5, 6, 7, 8, 9, 10, 11, 12, 13, 14, 15, 16, 17, 18, 19, 20, 21, 22, 23, 24, or 25 nucleotides in length. In certain embodiments, the 3' subdomain of the second complementarity domain is 4 to 9, e.g., 4, 5, 6, 7, 8 or 9 nucleotides in length.

The first and/or second complementarity domains can share homology with, or be derived from, naturally occurring or reference first and/or second complementarity domain. In certain of these embodiments, the first and/or second complementarity domains have at least about 50%, about 60%, about 70%, about 80%, about 85%, about 90%, or about 95% homology with, or differ by no more than 1, 2, 3, 4, 5, or 6 nucleotides from, the naturally occurring or reference first and/or second complementarity domain. In certain of these embodiments, the first and/or second complementarity domains may have at least about 50%, about 60%, about 70%, about 80%, about 85%, about 90%, or about 95% homology with homology with a first and/or second complementarity domain from *S. pyogenes* or *S. aureus*.

In certain embodiments, the first and/or second complementarity domains do not comprise any modifications. In other embodiments, the first and/or second complementarity domains or one or more nucleotides therein have a modification, including but not limited to a modification set forth below. In certain embodiments, one or more nucleotides of the first and/or second complementarity domain may comprise a 2' modification (e.g., a modification at the 2' position on ribose), e.g., a 2-acetylation, e.g., a 2' methylation. In certain embodiments, the backbone of the targeting domain can be modified with a phosphorothioate. In certain embodiments, modifications to one or more nucleotides of the first and/or second complementarity domain render the first and/or second complementarity domain and/or the gRNA comprising the first and/or second complementarity less susceptible to degradation or more bio-compatible, e.g., less immunogenic. In certain embodiments, the first and/or second complementarity domains each independently include 1, 2, 3, 4, 5, 6, 7, or 8 or more modifications, and in certain of these embodiments the first and/or second complementarity domains each independently include 1, 2, 3, or 4 modifications within five nucleotides of their respective 5' ends, 3' ends, or both their 5' and 3' ends. In certain embodiments, the first and/or second complementarity domains each independently contain no modifications within five nucleotides of their respective 5' ends, 3' ends, or both their 5' and 3' ends. In certain embodiments, one or both of the first and second complementarity domains comprise modifications at two or more consecutive nucleotides.

In certain embodiments, modifications to one or more nucleotides in the first and/or second complementarity domains are selected to not interfere with targeting efficacy, which can be evaluated by testing a candidate modification in a system as set forth below. gRNAs having a candidate first or second complementarity domain having a selected length, sequence, degree of complementarity, or degree of modification can be evaluated in a system as set forth below. The candidate complementarity domain can be placed, either alone or with one or more other candidate changes in a gRNA molecule/Cas9 molecule system known to be functional with a selected target, and evaluated.

In certain embodiments, the duplexed region formed by the first and second complementarity domains is, for example, 6, 7, 8, 9, 10, 11, 12, 13, 14, 15, 16, 17, 18, 19, 20, 21, or 22 bp in length, excluding any looped out or unpaired nucleotides.

In certain embodiments, the first and second complementarity domains, when duplexed, comprise 11 paired nucleotides (see, for e.g., gRNA of SEQ ID NO:48). In certain embodiments, the first and second complementarity domains, when duplexed, comprise 15 paired nucleotides (see, e.g., gRNA of SEQ ID NO:50). In certain embodiments, the first and second complementarity domains, when duplexed, comprise 16 paired nucleotides (see, e.g., gRNA of SEQ ID NO:51). In certain embodiments, the first and second complementarity domains, when duplexed, comprise 21 paired nucleotides (see, e.g., gRNA of SEQ ID NO:29).

In certain embodiments, one or more nucleotides are exchanged between the first and second complementarity domains to remove poly-U tracts. For example, nucleotides 23 and 48 or nucleotides 26 and 45 of the gRNA of SEQ ID NO:48 may be exchanged to generate the gRNA of SEQ ID NOs:49 or 31, respectively. Similarly, nucleotides 23 and 39 of the gRNA of SEQ ID NO:29 may be exchanged with nucleotides 50 and 68 to generate the gRNA of SEQ ID NO:30.

5.3 Linking Domain

The linking domain is disposed between and serves to link the first and second complementarity domains in a unimolecular or chimeric gRNA. FIGS. 1B-1E provide examples of linking domains. In certain embodiments, part of the linking domain is from a crRNA-derived region, and another part is from a tracrRNA-derived region.

In certain embodiments, the linking domain links the first and second complementarity domains covalently. In certain of these embodiments, the linking domain consists of or comprises a covalent bond. In other embodiments, the linking domain links the first and second complementarity domains non-covalently. In certain embodiments, the linking domain is ten or fewer nucleotides in length, e.g., 1, 2, 3, 4, 5, 6, 7, 8, 9, or 10 nucleotides. In other embodiments, the linking domain is greater than 10 nucleotides in length, e.g., 11, 12, 13, 14, 15, 16, 17, 18, 19, 20, 21, 22, 23, 24, or 25 or more nucleotides. In certain embodiments, the linking domain is 2 to 50, 2 to 40, 2 to 30, 2 to 20, 2 to 10, 2 to 5, 10 to 100, 10 to 90, 10 to 80, 10 to 70, 10 to 60, 10 to 50, 10 to 40, 10 to 30, 10 to 20, 10 to 15, 20 to 100, 20 to 90, 20 to 80, 20 to 70, 20 to 60, 20 to 50, 20 to 40, 20 to 30, or 20 to 25 nucleotides in length. In certain embodiments, the linking domain is 10+/−5, 20+/−5, 20+/−10, 30+/−5, 30+/−10, 40+/−5, 40+/−10, 50+/−5, 50+/−10, 60+/−5, 60+/−10, 70+/−5, 70+/−10, 80+/−5, 80+/−10, 90+/−5, 90+/−10, 100+/−5, or 100+/−10 nucleotides in length.

In certain embodiments, the linking domain shares homology with, or is derived from, a naturally occurring sequence, e.g., the sequence of a tracrRNA that is 5' to the second complementarity domain. In certain embodiments, the linking domain has at least about 50%, about 60%, about 70%, about 80%, about 90%, or about 95% homology with or differs by no more than 1, 2, 3, 4, 5, or 6 nucleotides from a linking domain disclosed herein, e.g., the linking domains of FIGS. 1B-1E.

In certain embodiments, the linking domain does not comprise any modifications. In other embodiments, the linking domain or one or more nucleotides therein have a modification, including but not limited to the modifications set forth below. In certain embodiments, one or more nucleotides of the linking domain may comprise a 2' modification (e.g., a modification at the 2' position on ribose), e.g., a 2-acetylation, e.g., a 2' methylation. In certain embodiments, the backbone of the linking domain can be modified with a phosphorothioate. In certain embodiments, modifications to one or more nucleotides of the linking domain render the linking domain and/or the gRNA comprising the linking domain less susceptible to degradation or more bio-compatible, e.g., less immunogenic. In certain embodiments, the linking domain includes 1, 2, 3, 4, 5, 6, 7, or 8 or more modifications, and in certain of these embodiments the linking domain includes 1, 2, 3, or 4 modifications within five nucleotides of its 5' and/or 3' end. In certain embodiments, the linking domain comprises modifications at two or more consecutive nucleotides.

In certain embodiments, modifications to one or more nucleotides in the linking domain are selected to not interfere with targeting efficacy, which can be evaluated by testing a candidate modification in a system as set forth below. gRNAs having a candidate linking domain having a selected length, sequence, degree of complementarity, or degree of modification can be evaluated in a system as set forth below. The candidate linking domain can be placed, either alone or with one or more other candidate changes in a gRNA molecule/Cas9 molecule system known to be functional with a selected target, and evaluated.

In certain embodiments, the linking domain comprises a duplexed region, typically adjacent to or within 1, 2, or 3 nucleotides of the 3' end of the first complementarity domain and/or the 5' end of the second complementarity domain. In certain of these embodiments, the duplexed region of the linking region is 10+/−5, 15+/−5, 20+/−5, 20+/−10, or 30+/−5 bp in length. In certain embodiments, the duplexed region of the linking domain is 1, 2, 3, 4, 5, 6, 7, 8, 9, 10, 11, 12, 13, 14, or 15 bp in length. In certain embodiments, the sequences forming the duplexed region of the linking domain are fully complementarity. In other embodiments, one or both of the sequences forming the duplexed region contain one or more nucleotides (e.g., 1, 2, 3, 4, 5, 6, 7, or 8 nucleotides) that are not complementary with the other duplex sequence.

5.4 5' Extension Domain

In certain embodiments, a modular gRNA as disclosed herein comprises a 5' extension domain, i.e., one or more additional nucleotides 5' to the second complementarity domain (see, e.g., FIG. 1A). In certain embodiments, the 5' extension domain is 2 to 10 or more, 2 to 9, 2 to 8, 2 to 7, 2 to 6, 2 to 5, or 2 to 4 nucleotides in length, and in certain of these embodiments the 5' extension domain is 2, 3, 4, 5, 6, 7, 8, 9, or 10 or more nucleotides in length.

In certain embodiments, the 5' extension domain nucleotides do not comprise modifications, e.g., modifications of the type provided below. However, in certain embodiments, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) as set forth below. In certain embodiments, a nucleotide of the 5' extension domain can comprise a 2' modification (e.g., a modification at the 2' position on ribose), e.g., a 2-acetylation, e.g., a 2' methylation, or other modification(s) as set forth below.

In certain embodiments, the 5' extension domain can comprise as many as 1, 2, 3, 4, 5, 6, 7, or 8 modifications. In certain embodiments, the 5' extension domain comprises as many as 1, 2, 3, or 4 modifications within 5 nucleotides of its 5' end, e.g., in a modular gRNA molecule. In certain embodiments, the 5' extension domain comprises as many as 1, 2, 3, or 4 modifications within 5 nucleotides of its 3' end, e.g., in a modular gRNA molecule.

In certain embodiments, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In certain embodiments, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In certain embodiments, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in a system as set forth below. gRNAs having a candidate 5' extension domain having a selected length, sequence, degree of complementarity, or degree of modification, can be evaluated in a system as set forth below. The candidate 5' extension domain can be placed, either alone, or with one or more other candidate changes in a gRNA molecule/Cas9 molecule system known to be functional with a selected target and evaluated.

In certain embodiments, the 5' extension domain has at least about 60%, about 70%, about 80%, about 85%, about 90%, or about 95% homology with, or differs by no more than 1, 2, 3, 4, 5, or 6 nucleotides from, a reference 5' extension domain, e.g., a naturally occurring, e.g., an *S. pyogenes*, *S. aureus*, or *S. thermophilus*, 5' extension domain, or a 5' extension domain described herein, e.g., from FIGS. 1A-1G.

5.5 Proximal Domain

FIGS. 1A-1G provide examples of proximal domains.

In certain embodiments, the proximal domain is 5 to 20 or more nucleotides in length, e.g., 5, 6, 7, 8, 9, 10, 11, 12, 13, 14, 15, 16, 17, 18, 19, 20, 21, 22, 23, 24, 25, or 26 nucleotides in length. In certain of these embodiments, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length. In certain embodiments, the proximal domain is 5 to 20, 7, to 18, 9 to 16, or 10 to 14 nucleotides in length.

In certain embodiments, the proximal domain can share homology with or be derived from a naturally occurring proximal domain. In certain of these embodiments, the proximal domain has at least about 50%, about 60%, about 70%, about 80%, about 85%, about 90%, or about 95% homology with or differs by no more than 1, 2, 3, 4, 5, or 6 nucleotides from a proximal domain disclosed herein, e.g., an *S. pyogenes*, *S. aureus*, or *S. thermophilus* proximal domain, including those set forth in FIGS. 1A-1G.

In certain embodiments, the proximal domain does not comprise any modifications. In other embodiments, the proximal domain or one or more nucleotides therein have a modification, including but not limited to the modifications set forth in herein. In certain embodiments, one or more nucleotides of the proximal domain may comprise a 2' modification (e.g., a modification at the 2' position on ribose), e.g., a 2-acetylation, e.g., a 2' methylation. In certain embodiments, the backbone of the proximal domain can be modified with a phosphorothioate. In certain embodiments, modifications to one or more nucleotides of the proximal domain render the proximal domain and/or the gRNA comprising the proximal domain less susceptible to degradation or more bio-compatible, e.g., less immunogenic. In certain embodiments, the proximal domain includes 1, 2, 3, 4, 5, 6, 7, or 8 or more modifications, and in certain of these embodiments the proximal domain includes 1, 2, 3, or 4 modifications within five nucleotides of its 5' and/or 3' end. In certain embodiments, the proximal domain comprises modifications at two or more consecutive nucleotides.

In certain embodiments, modifications to one or more nucleotides in the proximal domain are selected to not interfere with targeting efficacy, which can be evaluated by testing a candidate modification in a system as set forth below. gRNAs having a candidate proximal domain having a selected length, sequence, degree of complementarity, or degree of modification can be evaluated in a system as set forth below. The candidate proximal domain can be placed, either alone or with one or more other candidate changes in a gRNA molecule/Cas9 molecule system known to be functional with a selected target, and evaluated.

5.6 Tail Domain

A broad spectrum of tail domains are suitable for use in the gRNA molecules disclosed herein. FIGS. 1A and 1C-1G provide examples of such tail domains.

In certain embodiments, the tail domain is absent. In other embodiments, the tail domain is 1 to 100 or more nucleotides in length, e.g., 1, 2, 3, 4, 5, 6, 7, 8, 9, 10, 20, 30, 40, 50, 60, 70, 80, 90, or 100 nucleotides in length. In certain embodiments, the tail domain is 1 to 5, 1 to 10, 1 to 15, 1 to 20, 1 to 50, 10 to 100, 20 to 100, 10 to 90, 20 to 90, 10 to 80, 20 to 80, 10 to 70, 20 to 70, 10 to 60, 20 to 60, 10 to 50, 20 to 50, 10 to 40, 20 to 40, 10 to 30, 20 to 30, 20 to 25, 10 to 20, or 10 to 15 nucleotides in length. In certain embodiments, the tail domain is 5+/−5, 10+/−5, 20+/−10, 20+/−5, 25+/−10, 30+/−10, 30+/−5, 40+/−10, 40+/−5, 50+/−10, 50+/−5, 60+/−10, 60+/−5, 70+/−10, 70+/−5, 80+/−10, 80+/−5, 90+/−10, 90+/−5, 100+/−10, or 100+/−5 nucleotides in length, In certain embodiments, the tail domain can share homology with or be derived from a naturally occurring tail domain or the 5' end of a naturally occurring tail domain. In certain of these embodiments, the proximal domain has at least about 50%, about 60%, about 70%, about 80%, about 85%, about 90%, or about 95% homology with or differs by no more than 1, 2, 3, 4, 5, or 6 nucleotides from a naturally occurring tail domain disclosed herein, e.g., an *S. pyogenes*, *S. aureus*, or *S. thermophilus* tail domain, including those set forth in FIGS. 1A and 1C-1G.

In certain embodiments, the tail domain includes sequences that are complementary to each other and which, under at least some physiological conditions, form a duplexed region. In certain of these embodiments, the tail domain comprises a tail duplex domain which can form a tail duplexed region. In certain embodiments, the tail duplexed region is 3, 4, 5, 6, 7, 8, 9, 10, 11, or 12 bp in length. In certain embodiments, the tail domain comprises a single stranded domain 3' to the tail duplex domain that does not form a duplex. In certain of these embodiments, the single stranded domain is 3 to 10 nucleotides in length, e.g., 3, 4, 5, 6, 7, 8, 9, 10, or 4 to 6 nucleotides in length.

In certain embodiments, the tail domain does not comprise any modifications. In other embodiments, the tail domain or one or more nucleotides therein have a modification, including but not limited to the modifications set forth herein. In certain embodiments, one or more nucleotides of the tail domain may comprise a 2' modification (e.g., a modification at the 2' position on ribose), e.g., a 2-acetylation, e.g., a 2' methylation. In certain embodiments, the backbone of the tail domain can be modified with a phosphorothioate. In certain embodiments, modifications to one or more nucleotides of the tail domain render the tail domain and/or the gRNA comprising the tail domain less susceptible to degradation or more bio-compatible, e.g., less immunogenic. In certain embodiments, the tail domain includes 1, 2, 3, 4, 5, 6, 7, or 8 or more modifications, and in certain of these embodiments the tail domain includes 1, 2, 3, or 4 modifications within five nucleotides of its 5' and/or 3' end. In certain embodiments, the tail domain comprises modifications at two or more consecutive nucleotides.

In certain embodiments, modifications to one or more nucleotides in the tail domain are selected to not interfere with targeting efficacy, which can be evaluated by testing a candidate modification as set forth below. gRNAs having a candidate tail domain having a selected length, sequence, degree of complementarity, or degree of modification can be evaluated using a system as set forth below. The candidate tail domain can be placed, either alone or with one or more other candidate changes in a gRNA molecule/Cas9 molecule system known to be functional with a selected target, and evaluated.

In certain embodiments, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. In certain embodiments, the gRNA molecule includes a 3' polyA tail that is prepared by in vitro transcription from a DNA template. In certain embodiments, the 5' nucleotide of the targeting domain of the gRNA molecule is a guanine nucleotide, the DNA template comprises a T7 promoter sequence located immediately upstream of the sequence that corresponds to the targeting domain, and the 3' nucleotide of the T7 promoter sequence is not a guanine nucleotide. In certain embodiments, the 5' nucleotide of the targeting domain of the gRNA molecule is not a guanine nucleotide, the DNA template comprises a T7 promoter sequence located immediately upstream of the sequence that corresponds to the targeting domain, and the 3' nucleotide of the T7 promoter sequence is a guanine nucleotide which is downstream of a nucleotide other than a guanine nucleotide.

When a U6 promoter is used for in vivo transcription, these nucleotides may be the sequence UUUUUU. When an H1 promoter is used for transcription, these nucleotides may be the sequence UUUU. When alternate pol-III promoters are used, these nucleotides may be various numbers of uracil bases depending on, e.g., the termination signal of the pol-III promoter, or they may include alternate bases.

In certain embodiments, the proximal and tail domain taken together comprise, consist of, or consist essentially of the sequence set forth in SEQ ID NOs:32, 33, 34, 35, 36, or 37.

5.7 Exemplary Unimolecular/Chimeric gRNAs

In certain embodiments, a gRNA as disclosed herein has the structure: 5' [targeting domain]-[first complementarity domain]-[linking domain]-[second complementarity domain]-[proximal domain]-[tail domain]-3', wherein:

the targeting domain comprises a core domain and optionally a secondary domain, and is 10 to 50 nucleotides in length;

the first complementarity domain is 5 to 25 nucleotides in length and, in certain embodiments has at least about 50%, about 60%, about 70%, about 80%, about 85%, about 90%, or about 95% homology with a reference first complementarity domain disclosed herein;

the linking domain is 1 to 5 nucleotides in length;

the second complementarity domain is 5 to 27 nucleotides in length and, in certain embodiments has at least about 50%, about 60%, about 70%, about 80%, about 85%, about 90%, or about 95% homology with a reference second complementarity domain disclosed herein; the proximal domain is 5 to 20 nucleotides in length and, in certain embodiments has at least about 50%, about 60%, about 70%, about 80%, about 85%, about 90%, or about 95% homology with a reference proximal domain disclosed herein; and the tail domain is absent or a nucleotide sequence is 1 to 50 nucleotides in length and, in certain embodiments has at least about 50%, about 60%, about 70%, about 80%, about 85%, about 90%, or about 95% homology with a reference tail domain disclosed herein.

In certain embodiments, a unimolecular gRNA as disclosed herein comprises, preferably from 5' to 3':

a targeting domain, e.g., comprising 10-50 nucleotides;
a first complementarity domain, e.g., comprising 15, 16, 17, 18, 19, 20, 21, 22, 23, 24, 25, or 26 nucleotides;
a linking domain;
a second complementarity domain;
a proximal domain; and
a tail domain,
wherein, (a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), and/or (c) has at least about 50%, about 60%, about 70%, about 75%, about 60%, about 70%, about 80%, about 85%, about 90%, about 95%, or about 99% homology with the corresponding sequence of a naturally occurring gRNA, or with a gRNA described herein.

In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that are complementary to the corresponding nucleotides of the first complementarity domain.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary or partially complementary to the target domain or a portion thereof, e.g., the targeting domain is 16, 17, 18, 19, 20, 21, 22, 23, 24, 25, or 26 nucleotides in length. In certain of these embodiments, the targeting domain is complementary to the target domain over the entire length of the targeting domain, the entire length of the target domain, or both.

In certain embodiments, a unimolecular or chimeric gRNA molecule disclosed herein (comprising a targeting domain, a first complementary domain, a linking domain, a second complementary domain, a proximal domain and, optionally, a tail domain) comprises the amino acid sequence set forth in SEQ ID NO:42, wherein the targeting domain is listed as 20 N's (residues 1-20) but may range in length from 16 to 26 nucleotides, and wherein the final six residues (residues 97-102) represent a termination signal for the U6 promoter buy may be absent or fewer in number. In certain embodiments, the unimolecular, or chimeric, gRNA molecule is a *S. pyogenes* gRNA molecule.

In certain embodiments, a unimolecular or chimeric gRNA molecule disclosed herein (comprising a targeting domain, a first complementary domain, a linking domain, a second complementary domain, a proximal domain and, optionally, a tail domain) comprises the amino acid sequence set forth in SEQ ID NO:38, wherein the targeting domain is listed as 20 Ns (residues 1-20) but may range in length from 16 to 26 nucleotides, and wherein the final six residues (residues 97-102) represent a termination signal for the U6 promoter but may be absent or fewer in number. In certain embodiments, the unimolecular or chimeric gRNA molecule is an *S. aureus* gRNA molecule.

Figure 1H:
Figure 1I:
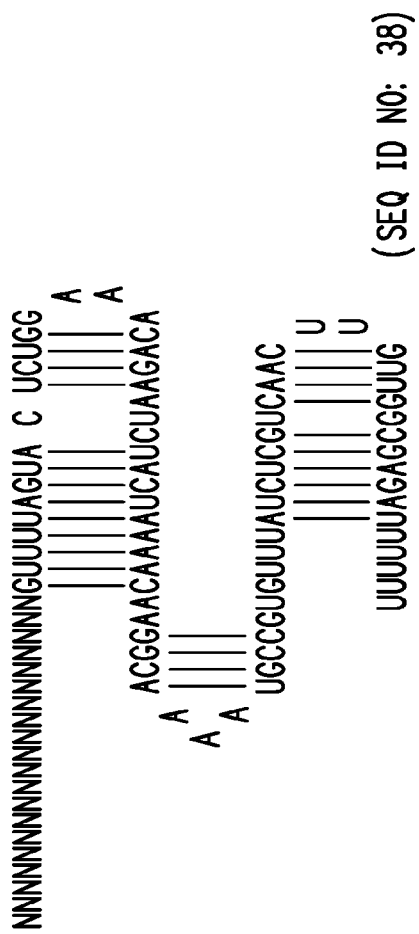

The sequences and structures of exemplary chimeric gRNAs are also shown in FIGS. 1H-1I.

5.8 Exemplary Modular gRNAs

In certain embodiments, a modular gRNA disclosed herein comprises:

a first strand comprising, preferably from 5' to 3';
a targeting domain, e.g., comprising 15, 16, 17, 18, 19, 20, 21, 22, 23, 24, 25, or 26 nucleotides;
a first complementarity domain; and
a second strand, comprising, preferably from 5' to 3':
optionally a 5' extension domain;
a second complementarity domain;
a proximal domain; and
a tail domain, wherein:

(a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the sequence from (a), (b), or (c), has at least about 50%, about 60%, about 70%, about 80%, about 85%, about 90%, about 95%, or about 99% homology with the corresponding sequence of a naturally occurring gRNA, or with a gRNA described herein. In certain embodiments, the proximal and tail domain, when taken together, comprise at least 15, 18, 20, 25, 30, 31, 35, 40, 45, 49, 50, or 53 nucleotides.

In certain embodiments, there are at least 15, 18, 20, 25, 30, 31, 35, 40, 45, 49, 50, or 53 nucleotides 3' to the last nucleotide of the second complementarity domain.

In certain embodiments, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 16, 17, 18, 19, 20, 21, 22, 23, 24, 25, or 26 nucleotides (e.g., 16, 17, 18, 19, 20, 21, 22, 23, 24, 25, or 26 consecutive nucleotides) having complementarity with the target domain, e.g., the targeting domain is 16, 17, 18, 19, 20, 21, 22, 23, 24, 25, or 26 nucleotides in length.

In certain embodiments, the targeting domain consists of, consists essentially of, or comprises 16, 17, 18, 19, 20, 21, 22, 23, 24, 25, or 26 nucleotides (e.g., 16, 17, 18, 19, 20, 21, 22, 23, 24, 25, or 26 consecutive nucleotides) complementary to the target domain or a portion thereof. In certain of these embodiments, the targeting domain is complementary to the target domain over the entire length of the targeting domain, the entire length of the target domain, or both.

In certain embodiments, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In certain embodiments, the targeting domain has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In certain embodiments, the targeting domain has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In certain embodiments, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In certain embodiments, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In certain embodiments, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

5.9 gRNA Delivery

In certain embodiments of the methods provided herein, the methods comprise delivery of one or more (e.g., two, three, or four) gRNA molecules as described herein. In certain of these embodiments, the gRNA molecules are delivered by intravenous injection, intramuscular injection, subcutaneous injection, or inhalation. In certain embodiments, the gRNA molecules are delivered with a Cas9 molecule in a genome editing system.

6. Methods for Designing gRNAs

Methods for selecting, designing, and validating targeting domains for use in the gRNAs described herein are provided. Exemplary targeting domains for incorporation into gRNAs are also provided herein.

Methods for selection and validation of target sequences as well as off-target analyses have been described previously (see, e.g., Mali 2013; Hsu 2013; Fu 2014; Heigwer 2014; Bae 2014; Xiao 2014). For example, a software tool can be used to optimize the choice of potential targeting domains corresponding to a user's target sequence, e.g., to minimize total off-target activity across the genome. Off-target activity may be other than cleavage. For each possible targeting domain choice using *S. pyogenes* Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible targeting domain is then ranked according to its total predicted off-target cleavage; the top-ranked targeting domains represent those that are likely to have the greatest on-target cleavage and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate targeting domains and gRNAs comprising those targeting domains can be functionally evaluated using methods known in the art and/or as set forth herein.

As a non-limiting example, targeting domains for use in gRNAs for use with *S. pyogenes*, *S. aureus*, and *N. meningitidis* Cas9s were identified using a DNA sequence searching algorithm. 17-mer and 20-mer targeting domains were designed for *S. pyogenes* and *N. meningitidis* targets, while 18-mer, 19-mer, 20-mer, 21-mer, 22-mer, 23-mer, and 24-mer targeting domains were designed for *S. aureus* targets. gRNA design was carried out using custom gRNA design software based on the public tool cas-offinder (Bae 2014). This software scores guides after calculating their genome-wide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential target sites adjacent to PAM sequences, the software also identifies all PAM adjacent sequences that differ by 1, 2, 3, or more than 3 nucleotides from the selected target sites. Genomic DNA sequences for each gene were obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, targeting domain were ranked into tiers based on their distance to the target site, their orthogonality, and presence of a 5' G (based on identification of close matches in the human genome containing a relevant PAM, e.g., an NGG PAM for a wild-type *S. pyogenes* Cas9 molecule; an NNGRRT (SEQ ID NO:204) or NNGRRV (SEQ ID NO:205) PAM for a wild-type *S. aureus* Cas9 molecule, or a NNNNGATT or NNNNGCTT PAM for a wild-type *N. meningitidis* Cas9 molecule; a PAM selected from the group consisting of NGAG, NGCG, NGGG, NGTG, NGAA, NGAT and NGAC for a *S. pyogenes* Cas9 EQR variant; or a PAM selected from the group consisting of NGCG, NGCA, NGCT, and NGCC for a *S. pyogenes* Cas9 VRER variant). Orthogonality refers to the number of sequences in the human genome that contain a minimum number of mismatches to the target sequence. A "high level of orthogonality" or "good orthogonality" may, for example, refer to 20-mer targeting domain that have no identical sequences in the human genome besides the intended target, nor any sequences that contain one or two mismatches in the target sequence. Targeting domains with good orthogonality are selected to minimize off-target DNA cleavage.

Targeting domains were identified for both single-gRNA nuclease cleavage and for a dual-gRNA paired "nickase" strategy. Criteria for selecting targeting domains and the determination of which targeting domains can be used for the dual-gRNA paired "nickase" strategy is based on two considerations:

(1) Targeting domain pairs should be oriented on the DNA such that PAMs are facing out and cutting with the D10A Cas9 nickase can result in 5' overhangs; and (2) An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the target site of one targeting domain.

6.1 Targeting Domains for Use in Knocking Out the HSV-1 RS1 Gene

Targeting domains for use in gRNAs for knocking out the HSV-1 RS1 gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon).

For *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality, (3) the presence of 5'G and (4) wherein the PAM is NNGRRT (SEQ ID NO: 204). The targeting domain for tier 2 gRNA molecules were selected based on (1) distance to a target site (e.g., start codon), e.g., within 500 bp (e.g., downstream) of the target site (e.g., start codon), (2) a high level of orthogonality, and (3) wherein the PAM is NNGRRT. The targeting domain for tier 3 gRNA molecules were selected based on (1) distance to a target site (e.g., start codon), e.g., within 500 bp (e.g., downstream) of the target site (e.g., start codon) and (2) wherein the PAM is NNGRRT. The targeting domain for tier 4 gRNA molecules were selected based on (1) distance to a target site (e.g., start codon), e.g., within 500 bp (e.g., downstream) of the target site (e.g., start codon) and (2) wherein the PAM is NNGRRV. The targeting domain for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), (2) the presence of 5'G and (3) wherein the PAM is NNGRRT. The targeting domain for tier 6 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRT. The targeting domain for tier 7 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRV. Note that tiers are non-inclusive (each gRNA is listed only once for the strategy). In certain instances, no gRNA was identified based on the criteria of the particular tier. Note that tiers are non-inclusive (each targeting domain is listed only once for the strategy). In certain instances, no targeting domain was identified based on the criteria of the particular tier. The identified targeting domains are summarized below in Table 1.

TABLE 1

Nucleotide sequences of S. pyogenes, S. aureus, and N. meningitidis targeting domains for knocking out the HSV-1 RS1 gene

| | S. pyogenes | S. aureus | N. meningitidis |
|---|---|---|---|
| Tier 1 | SEQ ID NOS: 208 to 254 | SEQ ID NOS: 2510 to 2531 | SEQ ID NO: 7074 |
| Tier 2 | SEQ ID NOS: 255 to 333 | SEQ ID NOS: 2532 to 2563 | SEQ ID NO: 7075 |
| Tier 3 | SEQ ID NOS: 334 to 425 | SEQ ID NOS: 2564 to 2586 | Not applicable |
| Tier 4 | SEQ ID NOS: 426 to 516 | SEQ ID NOS: 2587 to 3244 | Not applicable |
| Tier 5 | SEQ ID NOS: 517 to 2509 | SEQ ID NOS: 3245 to 3368 | SEQ ID NOS: 7076 to 7097 |
| Tier 6 | Not applicable | SEQ ID NOS: 3369 to 3545 | Not applicable |
| Tier 7 | Not applicable | SEQ ID NOS: 3546 to 7073 | Not applicable |

6.2 Targeting Domains for Use in Knocking Out the HSV-2 RS1 Gene

Targeting domains for use in gRNAs for knocking out the HSV-2 RS1 gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon).

For *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality, (3) the presence of 5'G and (4) wherein the PAM is NNGRRT. The targeting domain for tier 2 gRNA molecules were selected based on (1) distance to a target site (e.g., start codon), e.g., within 500 bp (e.g., downstream) of the target site (e.g., start codon), (2) a high level of orthogonality, and (3) wherein the PAM is NNGRRT. The targeting domain for tier 3 gRNA molecules were selected based on (1) distance to a target site (e.g., start codon), e.g., within 500 bp (e.g., downstream) of the target site (e.g., start codon) and (2) wherein the PAM is NNGRRT. The targeting domain for tier 4 gRNA molecules were selected based on (1) distance to a target site (e.g., start codon), e.g., within 500 bp (e.g., downstream) of the target site (e.g., start codon) and (2) PAM is NNGRRV. The targeting domain for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), (2) the presence of 5'G and (3) wherein the PAM is NNGRRT. The targeting domain for tier 6 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRT. The targeting domain for tier 7 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 2.

TABLE 2

Nucleotide sequences of *S. pyogenes*, *S. aureus*, and *N. meningitidis* targeting domains for knocking out the HSV-2 RS1 gene

|  | S. pyogenes | S. aureus | N. meningitidis |
|---|---|---|---|
| Tier 1 | SEQ ID NOS: 7098 to 7148 | SEQ ID NOS: 9293 to 9314 | SEQ ID NO: 13615 |
| Tier 2 | SEQ ID NOS: 7149 to 7236 | SEQ ID NOS: 9315 to 9342 | SEQ ID NOS: 13616 to 13618 |
| Tier 3 | SEQ ID NOS: 7237 to 7286 | SEQ ID NOS: 9343 to 9355 | Not applicable |
| Tier 4 | SEQ ID NOS: 7287 to 7341 | SEQ ID NOS: 9356 to 9911 | Not applicable |
| Tier 5 | SEQ ID NOS: 7342 to 9292 | SEQ ID NOS: 9912 to 10034 | SEQ ID NOS: 13619 to 13636 |
| Tier 6 | Not applicable | SEQ ID NOS: 10035 to 10191 | Not applicable |
| Tier 7 | Not applicable | SEQ ID NOS: 10192 to 13614 | Not applicable |

6.3 Targeting Domains for Use in Knocking Out the HSV-1 RL2 Gene

Targeting domains for use in gRNAs for knocking out the HSV-1 RL2 gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon).

For *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality, (3) the presence of 5'G and (4) wherein the PAM is NNGRRT. The targeting domain for tier 2 gRNA molecules were selected based on (1) distance to a target site (e.g., start codon), e.g., within 500 bp (e.g., downstream) of the target site (e.g., start codon), (2) a high level of orthogonality, and (3) wherein the PAM is NNGRRT. The targeting domain for tier 3 gRNA molecules were selected based on (1) distance to a target site (e.g., start codon), e.g., within 500 bp (e.g., downstream) of the target site (e.g., start codon) and (2) wherein the PAM is NNGRRT. The targeting domain for tier 4 gRNA molecules were selected based on (1) distance to a target site (e.g., start codon), e.g., within 500 bp (e.g., downstream) of the target site (e.g., start codon) and (2) wherein the PAM is NNGRRV. The targeting domain for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), (2) the presence of 5'G and (3) wherein the PAM is NNGRRT. The targeting domain for tier 6 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRT. The targeting domain for tier 7 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 3.

TABLE 3

Nucleotide sequences of *S. pyogenes*, *S. aureus*, and *N. meningitidis* targeting domains for knocking out the HSV-1 RL2 gene

|  | S. pyogenes | S. aureus | N. meningitidis |
|---|---|---|---|
| Tier 1 | SEQ ID NOS: 21324 to 21368 | SEQ ID NOS: 22745 to 22755 | SEQ ID NO: 26602 |
| Tier 2 | SEQ ID NOS: 21369 to 21441 | SEQ ID NOS: 22756 to 22769 | SEQ ID NO: 26603 |
| Tier 3 | SEQ ID NOS: 21442 to 21505 | SEQ ID NOS: 22770 to 22800 | Not applicable |
| Tier 4 | SEQ ID NOS: 21506 to 21567 | SEQ ID NOS: 22801 to 23486 | SEQ ID NO: 26604 |
| Tier 5 | SEQ ID NOS: 21568 to 22744 | SEQ ID NOS: 23487 to 23587 | SEQ ID NOS: 26605 to 26612 |
| Tier 6 | Not applicable | SEQ ID NOS: 23588 to 23745 | Not applicable |
| Tier 7 | Not applicable | SEQ ID NOS: 23746 to 26601 | Not applicable |

6.4 Targeting Domains for Use in Knocking Out the HSV-2 RL2 Gene

Targeting domains for use in gRNAs for knocking out the HSV-2 RL2 gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon).

For *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality, (3) the presence of 5'G and (4) wherein the PAM is NNGRRT. The targeting domain for tier 2 gRNA molecules were selected based on (1) distance to a target site (e.g., start codon), e.g., within 500 bp (e.g., downstream) of the target site (e.g., start codon), (2) a high level of orthogonality, and (3) wherein the PAM is NNGRRT. The targeting domain for tier 3 gRNA molecules were selected based on (1) distance to a target site (e.g., start codon), e.g., within 500 bp (e.g., downstream) of the target site (e.g., start codon) and (2) wherein the PAM is NNGRRT. The targeting domain for tier 4 gRNA molecules were selected based on (1) distance to a target site (e.g., start codon), e.g., within 500 bp (e.g., downstream) of the target site (e.g., start codon) and (2) wherein the PAM is NNGRRV. The targeting domain for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), (2) the presence of 5'G and (3) wherein the PAM is NNGRRT. The targeting domain for tier 6 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRT. The targeting domain for tier 7 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 4.

TABLE 4

Nucleotide sequences of *S. pyogenes*, *S. aureus*, and *N. meningitidis* targeting domains for knocking out the HSV-2 RL2 gene

| | S. pyogenes | S. aureus | N. meningitidis |
|---|---|---|---|
| Tier 1 | SEQ ID NOS: 26613 to 26638 | SEQ ID NOS: 28038 to 28056 | SEQ ID NOS: 31721 to 31722 |
| Tier 2 | SEQ ID NOS: 26639 to 26670 | SEQ ID NOS: 28057 to 28107 | SEQ ID NOS: 31723 to 31726 |
| Tier 3 | SEQ ID NOS: 26671 to 26743 | SEQ ID NOS: 28108 to 28138 | Not applicable |
| Tier 4 | SEQ ID NOS: 26744 to 26863 | SEQ ID NOS: 28139 to 28740 | SEQ ID NO: 31727 |
| Tier 5 | SEQ ID NOS: 26864 to 28037 | SEQ ID NOS: 28741 to 28846 | SEQ ID NOS: 31728 to 31729 |
| Tier 6 | Not applicable | SEQ ID NOS: 28847 to 28999 | Not applicable |
| Tier 7 | Not applicable | SEQ ID NOS: 29000 to 31720 | Not applicable |

6.5 Targeting Domains for Use in Knocking Out the HSV-1 LAT Intron

Targeting domains for use in gRNAs for knocking out the HSV-1 LAT Intron in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site, e.g., within the first 500 bp of the LAT intron, (2) a high level of orthogonality and (3) the presence of 5'G. The targeting domain for tier 2 gRNA molecules were selected based on (1) distance to a target site, e.g., within the first 500 bp of the LAT intron and (2) a high level of orthogonality. The targeting domain for tier 3 gRNA molecules were selected based on (1) distance to a target site, e.g., within the first 500 bp of the LAT intron and (2) the presence of 5'G. The targeting domain for tier 4 gRNA molecules were selected based on distance to a target site, e.g., within the first 500 bp of the LAT intron. The targeting domain for tier 5 gRNA molecules were selected based on distance to the target site, e.g., within the reminder of the LAT intron, e.g., downstream of the first 500 bp of LAT intron.

For *S. aureus*, the targeting domain for tier 1 gRNA molecules were selected based on (1) distance to a target site, e.g., within the first 500 bp of the LAT intron, (2) a high level of orthogonality, (3) the presence of 5'G and (4) wherein the PAM is NNGRRT. The targeting domain for tier 2 gRNA molecules were selected based on (1) distance to a target site, e.g., within the first 500 bp of the LAT intron, (2) a high level of orthogonality, and (3) wherein the PAM is NNGRRT. The targeting domain for tier 3 gRNA molecules were selected based on (1) distance to a target site, e.g., within the first 500 bp of the LAT intron and (2) wherein the PAM is NNGRRT. The targeting domain for tier 4 gRNA molecules were selected based on (1) distance to a target site, e.g., within the first 500 bp of the LAT intron and (2) wherein the PAM is NNGRRV. The targeting domain for tier 5 gRNA molecules were selected based on (1) distance to the target site, e.g., within the reminder of the LAT intron, e.g., downstream of the first 500 bp of LAT intron, (2) the presence of 5'G and (3) wherein the PAM is NNGRRT. The targeting domain for tier 6 gRNA molecules were selected based on (1) distance to the target site, e.g., within the reminder of the LAT intron, e.g., downstream of the first 500 bp of LAT intron and (2) wherein the PAM is NNGRRT. The targeting domain for tier 7 gRNA molecules were selected based on (1) distance to the target site, e.g., within the reminder of the LAT intron, e.g., downstream of the first 500 bp of LAT intron and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 5.

TABLE 5

Nucleotide sequences of *S. pyogenes*, *S. aureus*, and *N. meningitidis* targeting domains for knocking out the HSV-1 LAT intron

| | S. pyogenes | S. aureus | N. meningitidis |
|---|---|---|---|
| Tier 1 | SEQ ID NOS: 31730 to 31762 | SEQ ID NOS: 32747 to 32782 | SEQ ID NO: 35601 |
| Tier 2 | SEQ ID NOS: 31763 to 31809 | SEQ ID NOS: 32783 to 32841 | SEQ ID NOS: 35602 to 35603 |
| Tier 3 | SEQ ID NOS: 31810 to 31897 | SEQ ID NOS: 32842 to 32893 | Not applicable |
| Tier 4 | SEQ ID NOS: 31898 to 32025 | SEQ ID NOS: 32894 to 33621 | SEQ ID NO: 35604 |
| Tier 5 | SEQ ID NOS: 32026 to 32746 | SEQ ID NOS: 33622 to 33716 | SEQ ID NOS: 35605 to 35616 |
| Tier 6 | Not applicable | SEQ ID NOS: 33717 to 33932 | Not applicable |
| Tier 7 | Not applicable | SEQ ID NOS: 33933 to 35600 | Not applicable |

6.6 Targeting Domains for Use in Knocking Out the HSV-2 LAT Intron

Targeting domains for use in gRNAs for knocking out the HSV-2 LAT Intron gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site, e.g., within the first 500 bp of the LAT intron, (2) a high level of orthogonality and (3) the presence of 5'G. The targeting domain for tier 2 gRNA molecules were selected based on (1) distance to a target site, e.g., within the first 500 bp of the LAT intron and (2) a high level of orthogonality. The targeting domain for tier 3 gRNA molecules were selected based on (1) distance to a target site, e.g., within the first 500 bp of the LAT intron and (2) the presence of 5'G. The targeting domain for tier 4 gRNA molecules were selected based on distance to a target site, e.g., within the first 500 bp of the LAT intron. The targeting domain for tier 5 gRNA molecules were selected based on distance to the target site, e.g., within the reminder of the LAT intron, e.g., downstream of the first 500 bp of the LAT intron.

For *S. aureus*, the targeting domain for tier 1 gRNA molecules were selected based on (1) distance to a target site, e.g., within the first 500 bp of the LAT intron, (2) a high level of orthogonality, (3) the presence of 5'G and (4) wherein the PAM is NNGRRT. The targeting domain for tier 2 gRNA molecules were selected based on (1) distance to a target site, e.g., within the first 500 bp of the LAT intron, (2) a high level of orthogonality, and (3) wherein the PAM is NNGRRT. The targeting domain for tier 3 gRNA molecules were selected based on (1) distance to a target site, e.g., within the first 500 bp of the LAT intron and (2) wherein the PAM is NNGRRT. The targeting domain for tier 4 gRNA molecules were selected based on (1) distance to a target site, e.g., within the first 500 bp of the LAT intron and (2) wherein the PAM is NNGRRV. The targeting domain for tier 5 gRNA molecules were selected based on (1) distance to the target site, e.g., within the reminder of the LAT intron, e.g., downstream of the first 500 bp of LAT intron, (2) the presence of 5'G and (3) wherein the PAM is NNGRRT. The targeting domain for tier 6 gRNA molecules were selected based on (1) distance to the target site, e.g., within the reminder of the LAT intron, e.g., downstream of the first 500 bp of LAT intron and (2) wherein the PAM is NNGRRT. The targeting domain for tier 7 gRNA molecules were selected based on (1) distance to the target site, e.g., within the reminder of the LAT intron, e.g., downstream of the first 500 bp of LAT intron and (2) wherein the PAM is NNGRRV.

Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 6

TABLE 6

Nucleotide sequences of *S. pyogenes*, *S. aureus*, and *N. meningitidis* targeting domains for knocking out the HSV-2 LAT intron

| | S. pyogenes | S. aureus | N. meningitidis |
|---|---|---|---|
| Tier 1 | SEQ ID NOS: 35617 to 35640 | SEQ ID NOS: 36927 to 36941 | SEQ ID NOS: 40872 to 40873 |
| Tier 2 | SEQ ID NOS: 35641 to 35704 | SEQ ID NOS: 36942 to 36980 | Not applicable |
| Tier 3 | SEQ ID NOS: 35705 to 35795 | SEQ ID NOS: 36981 to 37038 | Not applicable |
| Tier 4 | SEQ ID NOS: 35796 to 35911 | SEQ ID NOS: 37039 to 37860 | Not applicable |
| Tier 5 | SEQ ID NOS: 35912 to 36926 | SEQ ID NOS: 37861 to 37960 | SEQ ID NOS: 40874 to 40885 |
| Tier 6 | Not applicable | SEQ ID NOS: 37961 to 38098 | Not applicable |
| Tier 7 | Not applicable | SEQ ID NOS: 38099 to 40871 | Not applicable |

6.7 Targeting Domains for Use in Knocking Down the HSV-1 RS1 Gene

Targeting domains for use in gRNAs for knocking down HSV-1 RS1 gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site e.g., within 500 bp (e.g., upstream or downstream) of a transcription start site (TSS), (2) a high level of orthogonality and (3) the presence of 5'G. The targeting domain for tier 2 gRNA molecules were selected based on (1) distance to a target site e.g., within 500 bp (e.g., upstream or downstream) of a transcription start site (TSS) and (2) a high level of orthogonality. The targeting domain for tier 3 gRNA molecules were selected based on (1) distance to a target site e.g., within 500 bp (e.g., upstream or downstream) of a transcription start site (TSS) and (2) the presence of 5'G. The targeting domain for tier 4 gRNA molecules were selected based on distance to a target site e.g., within 500 bp (e.g., upstream or downstream) of a transcription start site (TSS). The targeting domain for tier 5 gRNA molecules were selected based on distance to the target site, e.g., within the additional 500 bp (e.g., upstream or downstream) of a transcription start site (TSS), e.g., extending to 1 kb upstream and downstream of a TSS.

For *S. aureus*, the targeting domain for tier 1 gRNA molecules were selected based on (1) distance to a target site e.g., within 500 bp (e.g., upstream or downstream) of a transcription start site (TSS), (2) a high level of orthogonality, (3) the presence of 5'G and (4) wherein the PAM is NNGRRT. The targeting domain for tier 2 gRNA molecules were selected based on (1) distance to a target site e.g., within 500 bp (e.g., upstream or downstream) of a transcription start site (TSS), (2) a high level of orthogonality, and (3) wherein the PAM is NNGRRT. The targeting domain for tier 3 gRNA molecules were selected based on (1) distance to a target site e.g., within 500 bp (e.g., upstream or downstream) of a transcription start site (TSS) and (2) wherein the PAM is NNGRRT. The targeting domain for tier 4 gRNA molecules were selected based on (1) distance to a target site e.g., within 500 bp (e.g., upstream or downstream) of a transcription start site (TSS) and (2) wherein the PAM is NNGRRV. The targeting domain for tier 5 gRNA molecules were selected based on (1) distance to the target site, e.g., within the additional 500 bp (e.g., upstream or downstream) of a transcription start site (TSS), e.g., extending to 1 kb upstream and downstream of a TSS, (2) the presence of 5'G and (3) wherein the PAM is NNGRRT. The targeting domain for tier 6 gRNA molecules were selected based on (1) distance to the target site, e.g., within the additional 500 bp (e.g., upstream or downstream) of a transcription start site (TSS), e.g., extending to 1 kb upstream and downstream of a TSS and (2) PAM is NNGRRT. The targeting domain for tier 7 gRNA molecules were selected based on (1) distance to the target site, e.g., within the additional 500 bp (e.g., upstream or downstream) of a transcription start site (TSS), e.g., extending to 1 kb upstream and downstream of a TSS and (2) PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 7.

TABLE 7

Nucleotide sequences of S. pyogenes, S. aureus, and N. meningitidis targeting domains for knocking down the HSV-1 RS1 gene

|  | S. pyogenes | S. aureus | N. meningitidis |
| --- | --- | --- | --- |
| Tier 1 | SEQ ID NOS: 13637 to 13743 | SEQ ID NOS: 14795 to 14841 | SEQ ID NOS: 17742 to 17743 |
| Tier 2 | SEQ ID NOS: 13744 to 13957 | SEQ ID NOS: 14842 to 14938 | SEQ ID NOS: 17744 to 17748 |
| Tier 3 | SEQ ID NOS: 13958 to 14099 | SEQ ID NOS: 14939 to 14965 | Not applicable |
| Tier 4 | SEQ ID NOS: 14100 to 14274 | SEQ ID NOS: 14966 to 16394 | Not applicable |
| Tier 5 | SEQ ID NOS: 14275 to 14794 | SEQ ID NOS: 16395 to 16458 | SEQ ID NOS: 17749 to 17752 |
| Tier 6 | Not applicable | SEQ ID NOS: 16459 to 16548 | Not applicable |
| Tier 7 | Not applicable | SEQ ID NOS: 16549 to 17741 | Not applicable |

6.8 Targeting Domains for Use in Knocking Down the HSV-2 RS1 Gene

Targeting domains for use in gRNAs for knocking down HSV-2 RS1 gene in conjunction with the methods disclosed herein were identified and ranked into 5 tiers for S. pyogenes, 7 tiers for S. aureus, and 5 tiers for N. meningitidis.

For S. pyogenes, and N. meningitidis, the targeting domain for tier 1 gRNA molecules were selected based on (1) distance to a target site, e.g., within 500 bp (e.g., upstream or downstream) of a start codon, (2) a high level of orthogonality and (3) the presence of 5'G. The targeting domain for tier 2 gRNA molecules were selected based on (1) distance to a target site, e.g., within 500 bp (e.g., upstream or downstream) of a start codon and (2) a high level of orthogonality. The targeting domain for tier 3 gRNA molecules were selected based on (1) distance to a target site, e.g., within 500 bp (e.g., upstream or downstream) of a start codon and (2) the presence of 5'G. The targeting domain for tier 4 gRNA molecules were selected based on distance to a target site, e.g., within 500 bp (e.g., upstream or downstream) of a start codon. The targeting domain for tier 5 gRNA molecules were selected based on distance to the target site, e.g., within the additional 500 bp (e.g., upstream or downstream) of a start codon, e.g., extending to 1 kb upstream and downstream of a start codon.

For S. aureus, the targeting domain for tier 1 gRNA molecules were selected based on (1) distance to a target site, e.g., within 500 bp (e.g., upstream or downstream) of a start codon, (2) a high level of orthogonality, (3) the presence of 5'G and (4) wherein the PAM is NNGRRT. The targeting domain for tier 2 gRNA molecules were selected based on (1) distance to a target site, e.g., within 500 bp (e.g., upstream or downstream) of a start codon, (2) a high level of orthogonality, and (3) wherein the PAM is NNGRRT. The targeting domain for tier 3 gRNA molecules were selected based on (1) distance to a target site, e.g., within 500 bp (e.g., upstream or downstream) of a start codon and (2) wherein the PAM is NNGRRT. The targeting domain for tier 4 gRNA molecules were selected based on (1) distance to a target site, e.g., within 500 bp (e.g., upstream or downstream) of a start codon and (2) wherein the PAM is NNGRRV. The targeting domain for tier 5 gRNA molecules were selected based on (1) distance to the target site, e.g., within the additional 500 bp (e.g., upstream or downstream) of a start codon, e.g., extending to 1 kb upstream and downstream of a start codon, (2) the presence of 5'G and (3) wherein the PAM is NNGRRT. The targeting domain for tier 6 gRNA molecules were selected based on (1) distance to the target site, e.g., within the additional 500 bp (e.g., upstream or downstream) of a start codon, e.g., extending to 1 kb upstream and downstream of a start codon and (2) wherein the PAM is NNGRRT. The targeting domain for tier 7 gRNA molecules were selected based on (1) distance to the target site, e.g., within the additional 500 bp (e.g., upstream or downstream) of a start codon, e.g., extending to 1 kb upstream and downstream of a start codon and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 8.

TABLE 8

Nucleotide sequences of S. pyogenes, S. aureus, and N. meningitidis targeting domains for knocking down the HSV-2 RS1 gene

|  | S. pyogenes | S. aureus | N. meningitidis |
| --- | --- | --- | --- |
| Tier 1 | SEQ ID NOS: 17753 to 17850 | SEQ ID NOS: 18785 to 18816 | SEQ ID NO: 21312 |
| Tier 2 | SEQ ID NOS: 17851 to 18016 | SEQ ID NOS: 18817 to 18868 | SEQ ID NOS: 21313 to 21319 |
| Tier 3 | SEQ ID NOS: 18017 to 18102 | SEQ ID NOS: 18869 to 18889 | Not applicable |
| Tier 4 | SEQ ID NOS: 18103 to 18257 | SEQ ID NOS: 18890 to 20108 | Not applicable |
| Tier 5 | SEQ ID NOS: 18258 to 18784 | SEQ ID NOS: 20109 to 20151 | SEQ ID NOS: 21320 to 21323 |
| Tier 6 | Not applicable | SEQ ID NOS: 20152 to 20213 | Not applicable |

TABLE 8-continued

Nucleotide sequences of S. pyogenes, S. aureus, and N. meningitidis targeting domains for knocking down the HSV-2 RS1 gene

| | S. pyogenes | S. aureus | N. meningitidis |
|---|---|---|---|
| Tier 7 | Not applicable | SEQ ID NOS: 20214 to 21311 | Not applicable |

6.9 Targeting Domains for Use in Knocking Down the HSV-1 RL2 Gene

Targeting domains for use in gRNAs for knocking down HSV-1 RL2 gene in conjunction with the methods disclosed herein were identified and ranked into 5 tiers for S. pyogenes, 7 tiers for S. aureus, and 5 tiers for N. meningitidis.

For S. pyogenes, and N. meningitidis, the targeting domain for tier 1 gRNA molecules were selected based on (1) distance to a target site e.g., within 500 bp (e.g., upstream or downstream) of a transcription start site (TSS), (2) a high level of orthogonality and (3) the presence of 5'G. The targeting domain for tier 2 gRNA molecules were selected based on (1) distance to a target site e.g., within 500 bp (e.g., upstream or downstream) of a transcription start site (TSS) and (2) a high level of orthogonality. The targeting domain for tier 3 gRNA molecules were selected based on (1) distance to a target site e.g., within 500 bp (e.g., upstream or downstream) of a transcription start site (TSS) and (2) the presence of 5'G. The targeting domain for tier 4 gRNA molecules were selected based on distance to a target site e.g., within 500 bp (e.g., upstream or downstream) of a transcription start site (TSS). The targeting domain for tier 5 gRNA molecules were selected based on distance to the target site, e.g., within the additional 500 bp (e.g., upstream or downstream) of a transcription start site (TSS), e.g., extending to 1 kb upstream and downstream of a TSS.

For S. aureus, the targeting domain for tier 1 gRNA molecules were selected based on (1) distance to a target site e.g., within 500 bp (e.g., upstream or downstream) of a transcription start site (TSS), (2) a high level of orthogonality, (3) the presence of 5'G and (4) wherein the PAM is NNGRRT. The targeting domain for tier 2 gRNA molecules were selected based on (1) distance to a target site e.g., within 500 bp (e.g., upstream or downstream) of a transcription start site (TSS), (2) a high level of orthogonality, and (3) wherein the PAM is NNGRRT. The targeting domain for tier 3 gRNA molecules were selected based on (1) distance to a target site e.g., within 500 bp (e.g., upstream or downstream) of a transcription start site (TSS) and (2) wherein the PAM is NNGRRT. The targeting domain for tier 4 gRNA molecules were selected based on (1) distance to a target site e.g., within 500 bp (e.g., upstream or downstream) of a transcription start site (TSS) and (2) wherein the PAM is NNGRRV. The targeting domain for tier 5 gRNA molecules were selected based on (1) distance to the target site, e.g., within the additional 500 bp (e.g., upstream or downstream) of a transcription start site (TSS), e.g., extending to 1 kb upstream and downstream of a TSS, (2) the presence of 5'G and (3) wherein the PAM is NNGRRT. The targeting domain for tier 6 gRNA molecules were selected based on (1) distance to the target site, e.g., within the additional 500 bp (e.g., upstream or downstream) of a transcription start site (TSS), e.g., extending to 1 kb upstream and downstream of a TSS and (2) wherein the PAM is NNGRRT. The targeting domain for tier 7 gRNA molecules were selected based on (1) distance to the target site, e.g., within the additional 500 bp (e.g., upstream or downstream) of a transcription start site (TSS), e.g., extending to 1 kb upstream and downstream of a TSS and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 9.

TABLE 9

Nucleotide sequences of S. pyogenes, S. aureus, and N. meningitidis targeting domains for knocking down the HSV-1 RL2 gene

| | S. pyogenes | S. aureus | N. meningitidis |
|---|---|---|---|
| Tier 1 | SEQ ID NOS: 40886 to 40976 | SEQ ID NOS: 42079 to 42149 | SEQ ID NOS: 45316 to 45319 |
| Tier 2 | SEQ ID NOS: 40977 to 41180 | SEQ ID NOS: 42150 to 42299 | SEQ ID NOS: 45320 to 45327 |
| Tier 3 | SEQ ID NOS: 41181 to 41305 | SEQ ID NOS: 42300 to 42323 | Not applicable |
| Tier 4 | SEQ ID NOS: 41306 to 41493 | SEQ ID NOS: 42324 to 43715 | Not applicable |
| Tier 5 | SEQ ID NOS: 41494 to 42078 | SEQ ID NOS: 43716 to 43784 | SEQ ID NOS: 45328 to 45339 |
| Tier 6 | Not applicable | SEQ ID NOS: 43785 to 43921 | Not applicable |
| Tier 7 | Not applicable | SEQ ID NOS: 43922 to 45315 | Not applicable |

6.10 Targeting Domains for Use in Knocking Down the HSV-2 RL2 Gene

Targeting domains for use in gRNAs for knocking down HSV-2 RL2 gene in conjunction with the methods disclosed herein were identified and ranked into 5 tiers for S. pyogenes, 7 tiers for S. aureus, and 5 tiers for N. meningitidis. For S. pyogenes, and N. meningitidis, the targeting domain for tier 1 gRNA molecules were selected based on (1) distance to a target site, e.g., within 500 bp (e.g., upstream or downstream) of a start codon, (2) a high level of orthogonality and (3) the presence of 5'G. The targeting domain for tier 2 gRNA molecules were selected based on (1) distance to a target site, e.g., within 500 bp (e.g., upstream or downstream) of a start codon and (2) a high level of orthogonality. The targeting domain for tier 3 gRNA molecules were selected based on (1) distance to a target site, e.g., within 500 bp (e.g., upstream or downstream) of a start codon and (2) the presence of 5'G. The targeting domain for tier 4 gRNA molecules were selected based on distance to a target site, e.g., within 500 bp (e.g., upstream or downstream) of a start codon. The targeting domain for tier 5 gRNA molecules were selected based on distance to the target site, e.g., within the additional 500 bp (e.g., upstream or downstream) of a start codon, e.g., extending to 1 kb upstream and downstream of a start codon.

For S. aureus, the targeting domain for tier 1 gRNA molecules were selected based on (1) distance to a target site, e.g., within 500 bp (e.g., upstream or downstream) of a start codon, (2) a high level of orthogonality, (3) the presence of 5'G and (4) wherein the PAM is NNGRRT. The targeting domain for tier 2 gRNA molecules were selected based on (1) distance to a target site, e.g., within 500 bp (e.g., upstream or downstream) of a start codon, (2) a high level of orthogonality, and (3) wherein the PAM is NNGRRT. The targeting domain for tier 3 gRNA molecules were selected based on (1) distance to a target site, e.g., within 500 bp (e.g., upstream or downstream) of a start codon and (2) wherein the PAM is NNGRRT. The targeting domain for tier 4 gRNA molecules were selected based on (1) distance to a target site, e.g., within 500 bp (e.g., upstream or downstream) of a start codon and (2) wherein the PAM is NNGRRV. The targeting domain for tier 5 gRNA molecules were selected based on (1) distance to the target site, e.g., within the additional 500 bp (e.g., upstream or downstream) of a start codon, e.g., extending to 1 kb upstream and downstream of a start codon, (2) the presence of 5'G and (3) wherein the PAM is NNGRRT. The targeting domain for tier 6 gRNA molecules were selected based on (1) distance to the target site, e.g., within the additional 500 bp (e.g., upstream or downstream) of a start codon, e.g., extending to 1 kb upstream and downstream of a start codon and (2) wherein the PAM is NNGRRT. The targeting domain for tier 7 gRNA molecules were selected based on (1) distance to the target site, e.g., within the additional 500 bp (e.g., upstream or downstream) of a start codon, e.g., extending to 1 kb upstream and downstream of a start codon and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 10.

TABLE 10

Nucleotide sequences of S. pyogenes, S. aureus, and N. meningitidis targeting domains for knocking down the HSV-2 RL2 gene

|  | S. pyogenes | S. aureus | N. meningitidis |
| --- | --- | --- | --- |
| Tier 1 | SEQ ID NOS: 49498 to 49587 | SEQ ID NOS: 50653 to 50725 | SEQ ID NOS: 53825 to 53834 |
| Tier 2 | SEQ ID NOS: 49588 to 49738 | SEQ ID NOS: 50726 to 50857 | SEQ ID NOS: 53835 to 53843 |
| Tier 3 | SEQ ID NOS: 49739 to 49899 | SEQ ID NOS: 50858 to 50911 | Not applicable |
| Tier 4 | SEQ ID NOS: 49900 to 50151 | SEQ ID NOS: 50912 to 52535 | Not applicable |
| Tier 5 | SEQ ID NOS: 50152 to 50652 | SEQ ID NOS: 52536 to 52587 | SEQ ID NOS: 53844 to 53857 |
| Tier 6 | Not applicable | SEQ ID NOS: 52588 to 52696 | Not applicable |
| Tier 7 | Not applicable | SEQ ID NOS: 52697 to 53824 | Not applicable |

6.11 Targeting Domains for Use in Knocking Down the HSV-1 LAT Gene

Targeting domains for use in gRNAs for knocking down HSV-1 LAT gene in conjunction with the methods disclosed herein were identified and ranked into 5 tiers for *S. pyogenes,* 7 tiers for *S. aureus,* and 5 tiers for *N. meningitidis.*

For *S. pyogenes,* and *N. meningitidis,* the targeting domain for tier 1 gRNA molecules were selected based on (1) distance to a target site, e.g., within 500 bp (e.g., upstream or downstream) of a transcription start site (TSS), (2) a high level of orthogonality and (3) the presence of 5'G. The targeting domain for tier 2 gRNA molecules were selected based on (1) distance to a target site, e.g., within 500 bp (e.g., upstream or downstream) of a transcription start site (TSS) and (2) a high level of orthogonality. The targeting domain for tier 3 gRNA molecules were selected based on (1) distance to a target site, e.g., within 500 bp (e.g., upstream or downstream) of a transcription start site (TSS) and (2) the presence of 5'G. The targeting domain for tier 4 gRNA molecules were selected based on distance to a target site, e.g., within 500 bp (e.g., upstream or downstream) of a transcription start site (TSS). The targeting domain for tier 5 gRNA molecules were selected based on distance to the target site, e.g., within the additional 500 bp (e.g., upstream or downstream) of a transcription start site (TSS), e.g., extending to 1 kb upstream and downstream of a TSS.

For *S. aureus,* the targeting domain for tier 1 gRNA molecules were selected based on (1) distance to a target site, e.g., within 500 bp (e.g., upstream or downstream) of a transcription start site (TSS), (2) a high level of orthogonality, (3) the presence of 5'G and (4) wherein the PAM is NNGRRT. The targeting domain for tier 2 gRNA molecules were selected based on (1) distance to a target site, e.g., within 500 bp (e.g., upstream or downstream) of a transcription start site (TSS), (2) a high level of orthogonality, and (3) wherein the PAM is NNGRRT. The targeting domain for tier 3 gRNA molecules were selected based on (1) distance to a target site, e.g., within 500 bp (e.g., upstream or downstream) of a transcription start site (TSS) and (2) wherein the PAM is NNGRRT. The targeting domain for tier 4 gRNA molecules were selected based on (1) distance to a target site, e.g., within 500 bp (e.g., upstream or downstream) of a transcription start site (TSS) and (2) wherein the PAM is NNGRRV. The targeting domain for tier 5 gRNA molecules were selected based on (1) distance to the target site, e.g., within the additional 500 bp (e.g., upstream or downstream) of a transcription start site (TSS), e.g., extending to 1 kb upstream and downstream of a TSS, (2) the presence of 5'G and (3) wherein the PAM is NNGRRT. The targeting domain for tier 6 gRNA molecules were selected based on (1) distance to the target site, e.g., within the additional 500 bp (e.g., upstream or downstream) of a transcription start site (TSS), e.g., extending to 1 kb upstream and downstream of a TSS and (2) wherein the PAM is NNGRRT. The targeting domain for tier 7 gRNA molecules were selected based on (1) distance to the target site, e.g., within the additional 500 bp (e.g., upstream or downstream) of a transcription start site (TSS), e.g., extending to 1 kb upstream and downstream of a TSS and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 11.

TABLE 11

Nucleotide sequences of S. pyogenes, S. aureus, and N. meningitidis targeting domains for knocking down the HSV-1 LAT gene

|  | S. pyogenes | S. aureus | N. meningitidis |
| --- | --- | --- | --- |
| Tier 1 | SEQ ID NOS: 45340 to 45427 | SEQ ID NOS: 46480 to 46533 | Not applicable |
| Tier 2 | SEQ ID NOS: 45428 to 45589 | SEQ ID NOS: 46534 to 46619 | SEQ ID NOS: 49480 to 49488 |
| Tier 3 | SEQ ID NOS: 45590 to 45707 | SEQ ID NOS: 46620 to 46664 | Not applicable |
| Tier 4 | SEQ ID NOS: 45708 to 45897 | SEQ ID NOS: 46665 to 47789 | SEQ ID NO: 49489 |
| Tier 5 | SEQ ID NOS: 45898 to 46479 | SEQ ID NOS: 47790 to 47887 | SEQ ID NOS: 49490 to 49497 |
| Tier 6 | Not applicable | SEQ ID NOS: 47888 to 48041 | Not applicable |
| Tier 7 | Not applicable | SEQ ID NOS: 48042 to 49479 | Not applicable |

6.12 Targeting Domains for Use in Knocking Down the HSV-2 LAT Gene

Targeting domains for use in gRNAs for knocking down HSV-2 LAT gene in conjunction with the methods disclosed herein were identified and ranked into 5 tiers for *S. pyogenes*, 7 tiers for *S. aureus*, and 5 tiers for *N. meningitidis*.

For *S. pyogenes*, and *N. meningitidis*, the targeting domain for tier 1 gRNA molecules were selected based on (1) distance to a target site, e.g., within 500 bp (e.g., upstream or downstream) of a transcription start site (TSS), (2) a high level of orthogonality and (3) the presence of 5'G. The targeting domain for tier 2 gRNA molecules were selected based on (1) distance to a target site, e.g., within 500 bp (e.g., upstream or downstream) of a transcription start site (TSS) and (2) a high level of orthogonality. The targeting domain for tier 3 gRNA molecules were selected based on (1) distance to a target site, e.g., within 500 bp (e.g., upstream or downstream) of a transcription start site (TSS) and (2) the presence of 5'G. The targeting domain for tier 4 gRNA molecules were selected based on distance to a target site, e.g., within 500 bp (e.g., upstream or downstream) of a transcription start site (TSS). The targeting domain for tier 5 gRNA molecules were selected based on distance to the target site, e.g., within the additional 500 bp (e.g., upstream or downstream) of a transcription start site (TSS), e.g., extending to 1 kb upstream and downstream of a TSS.

For *S. aureus*, the targeting domain for tier 1 gRNA molecules were selected based on (1) distance to a target site, e.g., within 500 bp (e.g., upstream or downstream) of a transcription start site (TSS), (2) a high level of orthogonality, (3) the presence of 5'G and (4) wherein the PAM is NNGRRT. The targeting domain for tier 2 gRNA molecules were selected based on (1) distance to a target site, e.g., within 500 bp (e.g., upstream or downstream) of a transcription start site (TSS), (2) a high level of orthogonality, and (3) wherein the PAM is NNGRRT. The targeting domain for tier 3 gRNA molecules were selected based on (1) distance to a target site, e.g., within 500 bp (e.g., upstream or downstream) of a transcription start site (TSS) and (2) wherein the PAM is NNGRRT. The targeting domain for tier 4 gRNA molecules were selected based on (1) distance to a target site, e.g., within 500 bp (e.g., upstream or downstream) of a transcription start site (TSS) and (2) wherein the PAM is NNGRRV. The targeting domain for tier 5 gRNA molecules were selected based on (1) distance to the target site, e.g., within the additional 500 bp (e.g., upstream or downstream) of a transcription start site (TSS), e.g., extending to 1 kb upstream and downstream of a TSS, (2) the presence of 5'G and (3) wherein the PAM is NNGRRT. The targeting domain for tier 6 gRNA molecules were selected based on (1) distance to the target site, e.g., within the additional 500 bp (e.g., upstream or downstream) of a transcription start site (TSS), e.g., extending to 1 kb upstream and downstream of a TSS and (2) wherein the PAM is NNGRRT. The targeting domain for tier 7 gRNA molecules were selected based on (1) distance to the target site, e.g., within the additional 500 bp (e.g., upstream or downstream) of a transcription start site (TSS), e.g., extending to 1 kb upstream and downstream of a TSS and (2) wherein the PAM is NNGRRV. Note that tiers are non-inclusive (each gRNA is listed only once for the strategy). In certain instances, no gRNA was identified based on the criteria of the particular tier.

Note that tiers are non-inclusive (each targeting domain is listed only once for the strategy). In certain instances, no targeting domain was identified based on the criteria of the particular tier. The identified targeting domains are summarized below in Table 12.

TABLE 12

Nucleotide sequences of *S. pyogenes*, *S. aureus*, and *N. meningitidis* targeting domains for knocking down the HSV-2 LAT gene

| | S. pyogenes | S. aureus | N. meningitidis |
|---|---|---|---|
| Tier 1 | SEQ ID NOS: 53858 to 53916 | SEQ ID NOS: 55057 to 55080 | SEQ ID NOS: 58732 to 58736 |
| Tier 2 | SEQ ID NOS: 53917 to 54030 | SEQ ID NOS: 55081 to 55119 | SEQ ID NOS: 58737 to 58743 |
| Tier 3 | SEQ ID NOS: 54031 to 54240 | SEQ ID NOS: 55120 to 55140 | Not applicable |
| Tier 4 | SEQ ID NOS: 54241 to 54468 | SEQ ID NOS: 55141 to 56792 | Not applicable |
| Tier 5 | SEQ ID NOS: 54469 to 55056 | SEQ ID NOS: 56793 to 56865 | SEQ ID NOS: 58744 to 58749 |
| Tier 6 | Not applicable | SEQ ID NOS: 56866 to 56970 | Not applicable |
| Tier 7 | Not applicable | SEQ ID NOS: 56971 to 58731 | Not applicable |

One or more of the gRNA molecules described herein, e.g., those comprising the targeting domains described in Tables 1-12 can be used with at least one Cas9 molecule (e.g., a *S. pyogenes* Cas9 molecule and/or a *S. aureus* Cas9 molecule) to form a single or a double stranded cleavage, e.g., with a Cas9 nickase molecule to generate a single strand break, or with a Cas9 nuclease molecule to generate a double strand break.

In certain embodiments, when a single gRNA molecule is used to target a Cas9 nickase to create a single strand break in close proximity to a RS1, RL2, or LAT target position, e.g., the gRNA is used to target either upstream of (e.g., within 500 bp upstream), or downstream of (e.g., within 500 bp downstream) of the RS1, RL2, or LAT target position.

In certain embodiments, when a single gRNA molecule is used to target a Cas9 nuclease to create a double strand break to in close proximity to the RL2, LAT, or RS1 target position, e.g., the gRNA is used to target either upstream of (e.g., within 500 bp upstream), or downstream of (e.g., within 500 bp downstream) of the RS1, RL2, or LAT target position.

In certain embodiments, two or more (e.g., three or four) gRNA molecules are used with one Cas9 molecule or Cas9-fusion protein. In certain embodiments, when two or more (e.g., three or four) gRNAs are used with two or more Cas9 molecules or Cas9-fusion proteins, at least one Cas9 molecule is from a different species than the other Cas9 molecule(s). When two gRNAs designed for use to target two Cas9 molecules, one Cas9 can be one species, the second Cas9 can be from a different species. Both Cas9 species are used to generate a single or double-strand break, as desired.

Any upstream gRNA described in Tables 1-12 may be paired with any downstream gRNA described in Tables 1-12. When an upstream gRNA designed for use with one species of Cas9 is paired with a downstream gRNA designed for use from a different species of Cas9, both Cas9 species are used to generate a single or double-strand break, as desired.

7. Cas9 Molecules

Cas9 molecules of a variety of species can be used in the methods and compositions described herein. While the *S. pyogenes*, *S. aureus* and *Neisseria meningitidis* Cas9 molecules are the subject of much of the disclosure herein, Cas9 molecules, derived from, or based on the Cas9 proteins of other species listed herein can be used as well. These include, for example, Cas9 molecules from *Acidovorax avenae, Actinobacillus pleuropneumonias, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus Puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae.*

7.1 Cas9 Domains

Crystal structures have been determined for two different naturally occurring bacterial Cas9 molecules (Jinek 2014) and for *S. pyogenes* Cas9 with a guide RNA (e.g., a synthetic fusion of crRNA and tracrRNA) (Nishimasu 2014; Anders 2014).

Figure 8A:
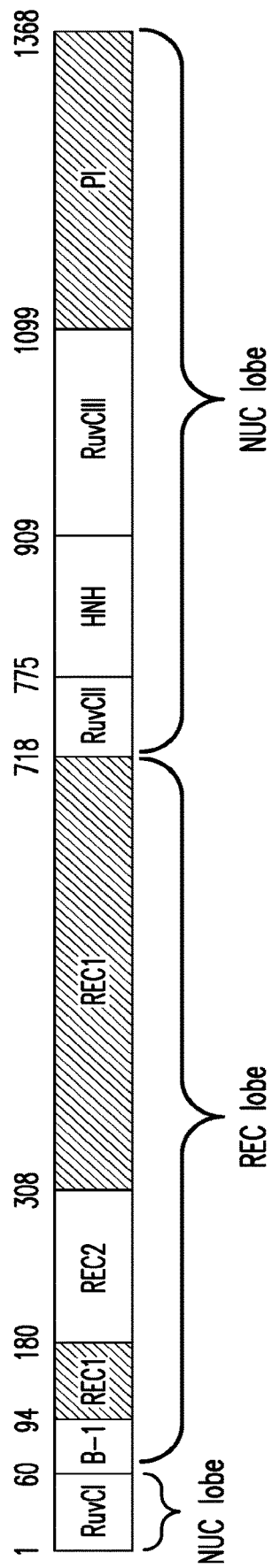
FIGS. 8A and 8B provide schematic representations of the domain organization of *S. pyogenes* Cas9.
Figure 8B:
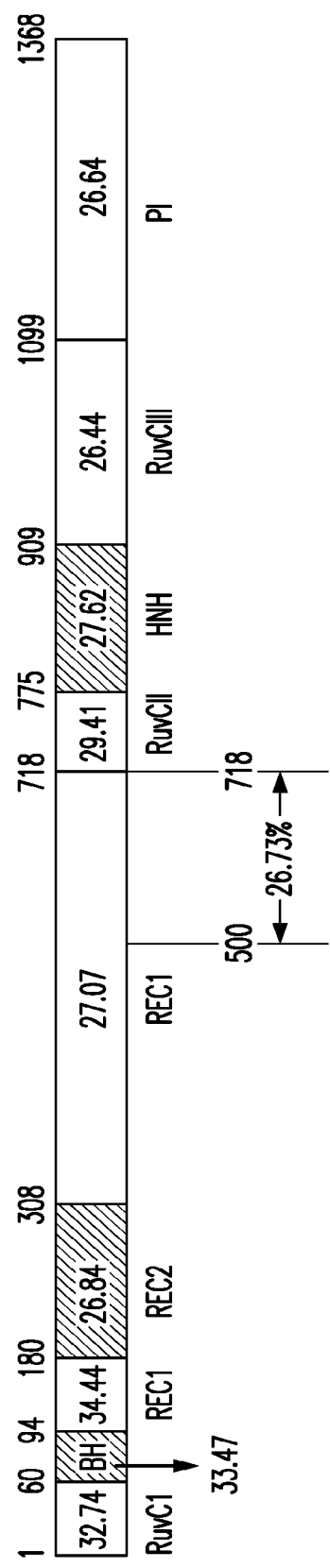

A naturally occurring Cas9 molecule comprises two lobes: a recognition (REC) lobe and a nuclease (NUC) lobe; each of which further comprise domains described herein. FIGS. 8A-8B provide a schematic of the organization of important Cas9 domains in the primary structure. The domain nomenclature and the numbering of the amino acid residues encompassed by each domain used throughout this disclosure is as described previously (Nishimasu 2014). The numbering of the amino acid residues is with reference to Cas9 from *S. pyogenes.*

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

7.1.1 RuvC-Like Domain and HNH-Like Domain

In certain embodiments, a Cas9 molecule or Cas9 polypeptide comprises an HNH-like domain and a RuvC-like domain, and in certain of these embodiments cleavage activity is dependent on the RuvC-like domain and the HNH-like domain. A Cas9 molecule or Cas9 polypeptide can comprise one or more of a RuvC-like domain and an HNH-like domain. In certain embodiments, a Cas9 molecule or Cas9 polypeptide comprises a RuvC-like domain, e.g., a RuvC-like domain described below, and/or an HNH-like domain, e.g., an HNH-like domain described below. RuvC-like domains In certain embodiments, a RuvC-like domain cleaves a single strand, e.g., the non-complementary strand of the target nucleic acid molecule. The Cas9 molecule or Cas9 polypeptide can include more than one RuvC-like domain (e.g., one, two, three or more RuvC-like domains). In certain embodiments, a RuvC-like domain is at least 5, 6, 7, 8 amino acids in length but not more than 20, 19, 18, 17, 16 or 15 amino acids in length. In certain embodiments, the Cas9 molecule or Cas9 polypeptide comprises an N-terminal RuvC-like domain of about 10 to 20 amino acids, e.g., about 15 amino acids in length.

7.1.2 N-Terminal RuvC-Like Domains

Some naturally occurring Cas9 molecules comprise more than one RuvC-like domain with cleavage being dependent on the N-terminal RuvC-like domain. Accordingly, a Cas9 molecule or Cas9 polypeptide can comprise an N-terminal RuvC-like domain. Exemplary N-terminal RuvC-like domains are described below.

In certain embodiments, a Cas9 molecule or Cas9 polypeptide comprises an N-terminal RuvC-like domain comprising an amino acid sequence of Formula I:

$$D\text{-}X_1\text{-}G\text{-}X_2\text{-}X_3\text{-}X_4\text{-}X_5\text{-}G\text{-}X_6\text{-}X_7\text{-}X_8\text{-}X_9 \quad \text{(SEQ ID NO:20)},$$

wherein, $X_1$ is selected from I, V, M, L, and T (e.g., selected from I, V, and L);

$X_2$ is selected from T, I, V, S, N, Y, E, and L (e.g., selected from T, V, and I);

$X_3$ is selected from N, S, G, A, D, T, R, M, and F (e.g., A or N);

$X_4$ is selected from S, Y, N, and F (e.g., S);

$X_5$ is selected from V, I, L, C, T, and F (e.g., selected from V, I and L);

$X_6$ is selected from W, F, V, Y, S, and L (e.g., W);

$X_7$ is selected from A, S, C, V, and G (e.g., selected from A and S);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R, or, e.g., selected from T, V, I, L, and A).

In certain embodiments, the N-terminal RuvC-like domain differs from a sequence of SEQ ID NO:20 by as many as 1 but no more than 2, 3, 4, or 5 residues.

In certain embodiments, the N-terminal RuvC-like domain is cleavage competent. In other embodiments, the N-terminal RuvC-like domain is cleavage incompetent.

In certain embodiments, a Cas9 molecule or Cas9 polypeptide comprises an N-terminal RuvC-like domain comprising an amino acid sequence of Formula II:

$$D-X_1-G-X_2-X_3-S-X_5-G-X_6-X_7-X_8-X_9, \quad \text{(SEQ ID NO:21)},$$

wherein $X_1$ is selected from I, V, M, L, and T (e.g., selected from I, V, and L);

$X_2$ is selected from T, I, V, S, N, Y, E, and L (e.g., selected from T, V, and I);

$X_3$ is selected from N, S, G, A, D, T, R, M and F (e.g., A or N);

$X_5$ is selected from V, I, L, C, T, and F (e.g., selected from V, I and L);

$X_6$ is selected from W, F, V, Y, S, and L (e.g., W);

$X_7$ is selected from A, S, C, V, and G (e.g., selected from A and S);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R or selected from e.g., T, V, I, L, and A).

In certain embodiments, the N-terminal RuvC-like domain differs from a sequence of SEQ ID NO:21 by as many as 1 but not more than 2, 3, 4, or 5 residues.

In certain embodiments, the N-terminal RuvC-like domain comprises an amino acid sequence of Formula III:

$$D-I-G-X_2-X_3-S-V-G-W-A-X_8-X_9 \quad \text{(SEQ ID NO:22)},$$

wherein $X_2$ is selected from T, I, V, S, N, Y, E, and L (e.g., selected from T, V, and I);

$X_3$ is selected from N, S, G, A, D, T, R, M, and F (e.g., A or N);

$X_8$ is selected from V, I, L, A, M, and H (e.g., selected from V, I, M and L); and $X_9$ is selected from any amino acid or is absent (e.g., selected from T, V, I, L, A, F, S, A, Y, M, and R or selected from e.g., T, V, I, L, and A).

In certain embodiments, the N-terminal RuvC-like domain differs from a sequence of SEQ ID NO:22 by as many as 1 but not more than, 2, 3, 4, or 5 residues.

In certain embodiments, the N-terminal RuvC-like domain comprises an amino acid sequence of Formula IV:

$$D-I-G-T-N-S-V-G-W-A-V-X \quad \text{(SEQ ID NO:23)},$$

wherein

X is a non-polar alkyl amino acid or a hydroxyl amino acid, e.g., X is selected from V, I, L, and T (e.g., the Cas9 molecule can comprise an N-terminal RuvC-like domain shown in FIGS. 2A-2G (depicted as Y)).

In certain embodiments, the N-terminal RuvC-like domain differs from a sequence of SEQ ID NO:23 by as many as 1 but not more than, 2, 3, 4, or 5 residues.

In certain embodiments, the N-terminal RuvC-like domain differs from a sequence of an N-terminal RuvC like domain disclosed herein, e.g., in FIGS. 3A-3B, as many as 1 but no more than 2, 3, 4, or 5 residues. In certain embodiments, 1, 2, 3 or all of the highly conserved residues identified in FIGS. 3A-3B are present.

In certain embodiments, the N-terminal RuvC-like domain differs from a sequence of an N-terminal RuvC-like domain disclosed herein, e.g., in FIGS. 4A-4B, as many as 1 but no more than 2, 3, 4, or 5 residues. In certain embodiments, 1, 2, or all of the highly conserved residues identified in FIGS. 4A-4B are present.

7.1.3 Additional RuvC-Like Domains

In addition to the N-terminal RuvC-like domain, the Cas9 molecule or Cas9 polypeptide can comprise one or more additional RuvC-like domains. In certain embodiments, the Cas9 molecule or Cas9 polypeptide comprises two additional RuvC-like domains. In certain embodiments, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence of Formula V:

$$I-X_1-X_2-E-X_3-A-R-E \quad \text{(SEQ ID NO:15)}$$

wherein, $X_1$ is V or H;

$X_2$ is I, L or V (e.g., I or V); and $X_3$ is M or T.

In certain embodiments, the additional RuvC-like domain comprises an amino acid sequence of Formula VI:

$$I-V-X_2-E-M-A-R-E \quad \text{(SEQ ID NO:16)},$$

wherein $X_2$ is I, L or V (e.g., I or V) (e.g., the Cas9 molecule or Cas9 polypeptide can comprise an additional RuvC-like domain shown in FIG. 2A-2G (depicted as B)).

An additional RuvC-like domain can comprise an amino acid sequence of Formula VII:

$$H-H-A-X_1-D-A-X_2-X_3 \quad \text{(SEQ ID NO:17)},$$

wherein $X_1$ is H or L;

$X_2$ is R or V; and $X_3$ is E or V.

In certain embodiments, the additional RuvC-like domain comprises the amino acid sequence: H-H-A-H-D-A-Y-L (SEQ ID NO:18).

In certain embodiments, the additional RuvC-like domain differs from a sequence of SEQ ID NOs:15-18 by as many as 1 but not more than 2, 3, 4, or 5 residues.

In certain embodiments, the sequence flanking the N-terminal RuvC-like domain has the amino acid sequence of Formula VIII:

$$K-X_1'-Y-X_2'-X_3'-X_4'-Z-T-D-X_9'-Y \quad \text{(SEQ ID NO: 19)},$$

wherein $X_1'$ is selected from K and P;

$X_2'$ is selected from V, L, I, and F (e.g., V, I and L);

$X_3'$ is selected from G, A and S (e.g., G);

$X_4'$ is selected from L, I, V, and F (e.g., L);

$X_9'$ is selected from D, E, N, and Q; and

Z is an N-terminal RuvC-like domain, e.g., as described above, e.g., having 5 to 20 amino acids.

7.1.4 HNH-Like Domains

In certain embodiments, an HNH-like domain cleaves a single stranded complementary domain, e.g., a complementary strand of a double stranded nucleic acid molecule. In certain embodiments, an HNH-like domain is at least 15, 20, or 25 amino acids in length but not more than 40, 35, or 30 amino acids in length, e.g., 20 to 35 amino acids in length, e.g., 25 to 30 amino acids in length. Exemplary HNH-like domains are described below.

In certain embodiments, a Cas9 molecule or Cas9 polypeptide comprises an HNH-like domain having an amino acid sequence of Formula IX:

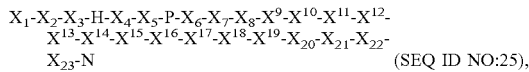
(SEQ ID NO:25), wherein
$X_1$ is selected from D, E, Q and N (e.g., D and E);
$X^2$ is selected from L, I, R, Q, V, M, and K;
$X_3$ is selected from D and E;
$X_4$ is selected from I, V, T, A, and L (e.g., A, I and V);
$X_5$ is selected from V, Y, I, L, F, and W (e.g., V, I and L);
$X_6$ is selected from Q, H, R, K, Y, I, L, F, and W;
$X_7$ is selected from S, A, D, T, and K (e.g., S and A);
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{11}$ is selected from D, S, N, R, L, and T (e.g., D);
$X_{12}$ is selected from D, N and S;
$X_{13}$ is selected from S, A, T, G, and R (e.g., S);
$X_{14}$ is selected from I, L, F, S, R, Y, Q, W, D, K, and H (e.g., I, L and F);
$X_{15}$ is selected from D, S, I, N, E, A, H, F, L, Q, M, G, Y, and V;
$X_{16}$ is selected from K, L, R, M, T, and F (e.g., L, R and K);
$X_{17}$ is selected from V, L, I, A and T;
$X_{18}$ is selected from L, I, V, and A (e.g., L and I);
$X_{19}$ is selected from T, V, C, E, S, and A (e.g., T and V);
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, a HNH-like domain differs from a sequence of SEQ ID NO:25 by at least one but not more than, 2, 3, 4, or 5 residues.

In certain embodiments, the HNH-like domain is cleavage competent. In certain embodiments, the HNH-like domain is cleavage incompetent.

In certain embodiments, a Cas9 molecule or Cas9 polypeptide comprises an HNH-like domain comprising an amino acid sequence of Formula X:

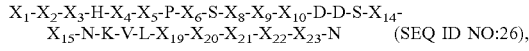
(SEQ ID NO:26), wherein
$X_1$ is selected from D and E;
$X_2$ is selected from L, I, R, Q, V, M, and K;
$X_3$ is selected from D and E;
$X_4$ is selected from I, V, T, A, and L (e.g., A, I and V);
$X_5$ is selected from V, Y, I, L, F, and W (e.g., V, I and L);
$X_6$ is selected from Q, H, R, K, Y, I, L, F, and W;
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{14}$ is selected from I, L, F, S, R, Y, Q, W, D, K, and H (e.g., I, L and F);
$X_{15}$ is selected from D, S, I, N, E, A, H, F, L, Q, M, G, Y, and V;
$X_{19}$ is selected from T, V, C, E, S, and A (e.g., T and V);
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiment, the HNH-like domain differs from a sequence of SEQ ID NO:26 by 1, 2, 3, 4, or 5 residues.

In certain embodiments, a Cas9 molecule or Cas9 polypeptide comprises an HNH-like domain comprising an amino acid sequence of Formula XI:

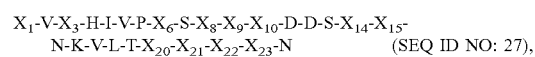
(SEQ ID NO: 27), wherein
$X_1$ is selected from D and E;
$X_3$ is selected from D and E;
$X_6$ is selected from Q, H, R, K, Y, I, L, and W;
$X_8$ is selected from F, L, V, K, Y, M, I, R, A, E, D, and Q (e.g., F);
$X_9$ is selected from L, R, T, I, V, S, C, Y, K, F, and G;
$X_{10}$ is selected from K, Q, Y, T, F, L, W, M, A, E, G, and S;
$X_{14}$ is selected from I, L, F, S, R, Y, Q, W, D, K, and H (e.g., I, L and F);
$X_{15}$ is selected from D, S, I, N, E, A, H, F, L, Q, M, G, Y, and V;
$X_{20}$ is selected from R, F, T, W, E, L, N, C, K, V, S, Q, I, Y, H, and A;
$X_{21}$ is selected from S, P, R, K, N, A, H, Q, G, and L;
$X_{22}$ is selected from D, G, T, N, S, K, A, I, E, L, Q, R, and Y; and
$X_{23}$ is selected from K, V, A, E, Y, I, C, L, S, T, G, K, M, D, and F.

In certain embodiments, the HNH-like domain differs from a sequence of SEQ ID NO:27 by 1, 2, 3, 4, or 5 residues.

In certain embodiments, a Cas9 molecule or Cas9 polypeptide comprises an HNH-like domain having an amino acid sequence of Formula XII:

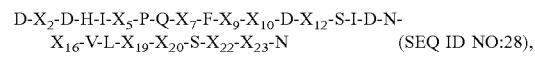
(SEQ ID NO:28), wherein
$X_2$ is selected from I and V;
$X_5$ is selected from I and V;
$X_7$ is selected from A and S;
$X_9$ is selected from I and L;
$X_{10}$ is selected from K and T;
$X_{12}$ is selected from D and N;
$X_{16}$ is selected from R, K, and L;
$X_{19}$ is selected from T and V;
$X_{20}$ is selected from S, and R;
$X_{22}$ is selected from K, D, and A; and
$X_{23}$ is selected from E, K, G, and N (e.g., the Cas9 molecule or Cas9 polypeptide can comprise an HNH-like domain as described herein).

In certain embodiments, the HNH-like domain differs from a sequence of SEQ ID NO:28 by as many as 1 but no more than 2, 3, 4, or 5 residues.

In certain embodiments, a Cas9 molecule or Cas9 polypeptide comprises the amino acid sequence of Formula XIII:

L-Y-Y-L-Q-N-G-$X_1'$-D-M-Y-$X_2'$-D-M-Y-$X_2'$-$X_3'$-$X_4'$-$X_5'$-L-D-I-$X_6'$-$X_7'$-L-S-$X_8'$-Y-Z-N-R-$X_9'$-K-$X_{10}'$-D-$X_{11}'$-Y-P  (SEQ ID NO:24), wherein
$X_1'$ is selected from K and R;
$X_2'$ is selected from V and T;
$X_3'$ is selected from G and D;
$X_4'$ is selected from E, Q and D;
$X_5'$ is selected from E and D;
$X_6'$ is selected from D, N, and H;
$X_7'$ is selected from Y, R, and N;
$X_8'$ is selected from Q, D, and N;
$X_9'$ is selected from G and E;
$X_{10}'$ is selected from S and G;
$X_{11}'$ is selected from D and N; and
Z is an HNH-like domain, e.g., as described above.

In certain embodiments, the Cas9 molecule or Cas9 polypeptide comprises an amino acid sequence that differs from a sequence of SEQ ID NO:24 by as many as 1 but not more than 2, 3, 4, or 5 residues.

In certain embodiments, the HNH-like domain differs from a sequence of an HNH-like domain disclosed herein, e.g., in FIGS. 5A-5C, by as many as 1 but not more than 2, 3, 4, or 5 residues. In certain embodiments, 1 or both of the highly conserved residues identified in FIGS. 5A-5C are present.

In certain embodiments, the HNH-like domain differs from a sequence of an HNH-like domain disclosed herein, e.g., in FIGS. 6A-6B, by as many as 1 but not more than 2, 3, 4, or 5 residues. In certain embodiments, 1, 2, or all 3 of the highly conserved residues identified in FIGS. 6A-6B are present.

7.2 Cas9 Activities

In certain embodiments, the Cas9 molecule or Cas9 polypeptide is capable of cleaving a target nucleic acid molecule. Typically wild-type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In certain embodiments, an eaCas9 molecule or eaCas9 polypeptide comprises one or more of the following enzymatic activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which in certain embodiments is the presence of two nickase activities;

an endonuclease activity;

an exonuclease activity; and a helicase activity, i.e., the ability to unwind the helical structure of a double stranded nucleic acid.

In certain embodiments, an enzymatically active Cas9 ("eaCas9") molecule or eaCas9 polypeptide cleaves both DNA strands and results in a double stranded break. In certain embodiments, an eaCas9 molecule or eaCas9 polypeptide cleaves only one strand, e.g., the strand to which the gRNA hybridizes to, or the strand complementary to the strand the gRNA hybridizes with. In certain embodiments, an eaCas9 molecule or eaCas9 polypeptide comprises cleavage activity associated with an HNH domain. In certain embodiments, an eaCas9 molecule or eaCas9 polypeptide comprises cleavage activity associated with a RuvC domain. In certain embodiments, an eaCas9 molecule or eaCas9 polypeptide comprises cleavage activity associated with an HNH domain and cleavage activity associated with a RuvC domain. In certain embodiments, an eaCas9 molecule or eaCas9 polypeptide comprises an active, or cleavage competent, HNH domain and an inactive, or cleavage incompetent, RuvC domain. In certain embodiments, an eaCas9 molecule or eaCas9 polypeptide comprises an inactive, or cleavage incompetent, HNH domain and an active, or cleavage competent, RuvC domain.

In certain embodiments, the Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an enzymatically inactive Cas9 ("eiCas9") molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

7.3 Targeting and PAMs

A Cas9 molecule or Cas9 polypeptide can interact with a gRNA molecule and, in concert with the gRNA molecule, localizes to a site which comprises a target domain, and in certain embodiments, a PAM sequence. In certain embodiments, the Cas9 molecules or Cas9 polypeptides of the present disclosure (e.g., an eaCas9 or eiCas9) can be targeted using the gRNAs disclosed in WO 2015/089465, which is incorporated by reference herein in its entirety. In certain embodiments, the Cas9 molecule or Cas9 polypeptide targeted using the gRNAs disclosed in WO 2015/089465 is an *S. pyogenes* Cas9. In certain embodiments, the Cas9 molecule or Cas9 polypeptide targeted using the gRNAs disclosed in WO 2015/089465 is an *S. aureus* Cas9.

In certain embodiments, the ability of an eaCas9 molecule or eaCas9 polypeptide to interact with and cleave a target nucleic acid is PAM sequence dependent. A PAM sequence is a sequence in the target nucleic acid. In certain embodiments, cleavage of the target nucleic acid occurs upstream from the PAM sequence. eaCas9 molecules from different bacterial species can recognize different sequence motifs (e.g., PAM sequences). In certain embodiments, an eaCas9 molecule of *S. pyogenes* recognizes the sequence motif NGG and directs cleavage of a target nucleic acid sequence 1 to 10, e.g., 3 to 5, bp upstream from that sequence (see, e.g., *Mali* 2013).

In certain embodiments, the Cas9 molecule is an *S. pyogenes* Cas9 EQR variant or an *S. pyogenes* Cas9 VRER variant.

In certain embodiments, the *S. pyogenes* Cas9 EQR variant recognizes a PAM sequence of NGAG, NGCG, NGGG, NGTG, NGAA, NGAT or NGAC and directs cleavage of a target nucleic acid sequence at 1 to 10, e.g., 3 to 5, base pairs upstream from that sequence. In certain embodiments, the *S. pyogenes* Cas9 EQR variant recognizes a PAM sequence of NGAG and directs cleavage of a target nucleic acid sequence at 1 to 10, e.g., 3 to 5, base pairs upstream from that sequence. See Kleinstiver et al., *NATURE* 2015; 523(7561):481-5.

In certain embodiments, the *S. pyogenes* Cas9 VRER variant recognizes a PAM sequence of NGCG, NGCA, NGCT PAM, or NGCC and directs cleavage of a target nucleic acid sequence at 1 to 10, e.g., 3 to 5, base pairs upstream from that sequence. In certain embodiments, the *S. pyogenes* Cas9 VRER variant recognizes the sequence motif of NGCG and directs cleavage of a target nucleic acid sequence 1 to 10, e.g., 3 to 5, base pairs upstream from that sequence. See Kleinstiver Kleinstiver et al., *NATURE* 2015; 523(7561):481-5.

In certain embodiments, the *S. thermophilus* Cas9 molecule recognizes a PAM sequence of NGGNG (SEQ ID NO:199) and/or NNAGAAW (W=A or T) (SEQ ID NO:200) and directs cleavage of a target nucleic acid sequence 1 to 10, e.g., 3 to 5, bp upstream from these sequences (see, e.g., Horvath 2010; Deveau 2008).

In certain embodiments, *S. mutans* Cas9 molecule recognizes a PAM sequence of NGG and/or NAAR (R=A or G) (SEQ ID NO:201) and directs cleavage of a target nucleic acid sequence 1 to 10, e.g., 3 to 5 bp, upstream from this sequence (see, e.g., Deveau 2008).

In certain embodiments, an *S. aureus* Cas9 molecule recognizes a PAM sequence of NNGRR (R=A or G) (SEQ ID NO:202) and directs cleavage of a target nucleic acid sequence 1 to 10, e.g., 3 to 5, bp upstream from that sequence.

In certain embodiments, an *S. aureus* recognizes a PAM sequence of NNGRRN (R=A or G) (SEQ ID NO:203) and directs cleavage of a target nucleic acid sequence 1 to 10, e.g., 3 to 5, bp upstream from that sequence. In certain embodiments, an *S. aureus* Cas9 molecule recognizes a PAM sequence of NNGRRT (R=A or G) (SEQ ID NO:204) and directs cleavage of a target nucleic acid sequence 1 to 10, e.g., 3 to 5, bp upstream from that sequence. In certain embodiments, an *S. aureus* Cas9 molecule recognizes a PAM sequence of NNGRRV (R=A or G) (SEQ ID NO:205) and directs cleavage of a target nucleic acid sequence 1 to 10, e.g., 3 to 5, bp upstream from that sequence.

In certain embodiments, an *Neisseria meningitidis* Cas9 molecule recognizes a PAM sequence of NNNNGATT or NNNGCTT and directs cleavage of a target nucleic acid sequence 1 to 10, e.g., 3 to 5, base pairs upstream from that sequence. See, e.g., Hou et al., PNAS Early Edition 2013, 1-6.

The ability of a Cas9 molecule to recognize a PAM sequence can be determined, e.g., using a transformation assay as described previously (Jinek 2012). In the aforementioned embodiments, N can be any nucleotide residue, e.g., any of A, G, C, or T.

As is discussed herein, Cas9 molecules can be engineered to alter the PAM specificity of the Cas9 molecule.

Exemplary naturally occurring Cas9 molecules have been described previously (see, e.g., Chylinski 2013). Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. aureus, S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LIVID-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408).

Additional exemplary Cas9 molecules are a Cas9 molecule of *Neisseria meningitidis* (Hou et al., PNAS Early Edition 2013, 1-6) and an *S. aureus* cas9 molecule.

In certain embodiments, a Cas9 molecule or Cas9 polypeptide comprises an amino acid sequence:

having about 60%, about 65%, about 70%, about 75%, about 80%, about 85%, about 90%, about 95%, about 96%, about 97%, about 98% or about 99% homology with;

differs at no more than, about 2%, about 5%, about 10%, about 15%, about 20%, about 30%, or about 40% of the amino acid residues when compared with;

differs by at least 1, 2, 5, 10 or 20 amino acids, but by no more than 100, 80, 70, 60, 50, 40 or 30 amino acids from; or identical to any Cas9 molecule sequence described herein, or to a naturally occurring Cas9 molecule sequence, e.g., a Cas9 molecule from a species listed herein (e.g., SEQ ID NOs:1, 2, 4-6, or 12) or described in Chylinski 2013. In certain embodiments, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

In certain embodiments, a Cas9 molecule or Cas9 polypeptide comprises any of the amino acid sequence of the consensus sequence of FIGS. 2A-2G, wherein "*" indicates any amino acid found in the corresponding position in the amino acid sequence of a Cas9 molecule of *S. pyogenes, S. thermophilus, S. mutans*, or *L. innocua*, and "-" indicates absent. In certain embodiments, a Cas9 molecule or Cas9 polypeptide differs from the sequence of the consensus sequence disclosed in FIGS. 2A-2G by at least 1, but no more than 2, 3, 4, 5, 6, 7, 8, 9, or 10 amino acid residues. In certain embodiments, a Cas9 molecule or Cas9 polypeptide comprises the amino acid sequence of SEQ ID NO:2. In other embodiments, a Cas9 molecule or Cas9 polypeptide differs from the sequence of SEQ ID NO:2 by at least 1, but no more than 2, 3, 4, 5, 6, 7, 8, 9, or 10 amino acid residues.

A comparison of the sequence of a number of Cas9 molecules indicate that certain regions are conserved. These are identified below as:

region 1 (residues 1 to 180, or in the case of region 1'residues 120 to 180)
region 2 (residues 360 to 480);
region 3 (residues 660 to 720);
region 4 (residues 817 to 900); and
region 5 (residues 900 to 960).

In certain embodiments, a Cas9 molecule or Cas9 polypeptide comprises regions 1-5, together with sufficient additional Cas9 molecule sequence to provide a biologically active molecule, e.g., a Cas9 molecule having at least one activity described herein. In certain embodiments, each of regions 1-5, independently, have about 50%, about 60%, about 70%, about 80%, about 85%, about 90%, about 95%, about 96%, about 97%, about 98% or about 99% homology with the corresponding residues of a Cas9 molecule or Cas9 polypeptide described herein, e.g., a sequence from FIGS. 2A-2G.

In certain embodiments, a Cas9 molecule or Cas9 polypeptide comprises an amino acid sequence referred to as region 1:

having about 50%, about 60%, about 70%, about 80%, about 85%, about 90%, about 95%, about 96%, about 97%, about 98% or about 99% homology with amino acids 1-180 (the numbering is according to the motif sequence in FIG. 2; 52% of residues in the four Cas9 sequences in FIGS. 2A-2G are conserved) of the amino acid sequence of Cas9 of *S. pyogenes*;

differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans*, or *Listeria innocua*; or is identical to amino acids 1-180 of the amino acid sequence of Cas9 of *S. pyogenes, S. thermophilus, S. mutans*, or *L. innocua*.

In certain embodiments, a Cas9 molecule or Cas9 polypeptide comprises an amino acid sequence referred to as region 1':

having about 55%, about 60%, about 65%, about 70%, about 75%, about 80%, about 85%, about 90%, about 95%, about 96%, about 97%, about 98% or about 99% homology with amino acids 120-180 (55% of residues in the four Cas9 sequences in FIG. 2 are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans*, or *L. innocua*; or is identical to amino acids 120-180 of the amino acid sequence of Cas9 of *S. pyogenes, S. thermophilus, S. mutans*, or *L. innocua*.

In certain embodiments, a Cas9 molecule or Cas9 polypeptide comprises an amino acid sequence referred to as region 2:

having about 50%, about 55%, about 60%, about 65%, about 70%, about 75%, about 80%, about 85%, about 90%, about 95%, about 96%, about 97%, about 98% or about 99% homology with amino acids 360-480 (52% of residues in the four Cas9 sequences in FIG. 2 are conserved) of the amino acid sequence of Cas9 of *S. pyogenes, S. thermophilus, S. mutans*, or *L. innocua;* differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans*, or *L. innocua*; or is identical to amino acids 360-480 of the amino acid sequence of Cas9 of *S. pyogenes, S. thermophilus, S. mutans*, or *L. innocua*.

In certain embodiments, a Cas9 molecule or Cas9 polypeptide comprises an amino acid sequence referred to as region 3:

having about 55%, about 60%, about 65%, about 70%, about 75%, about 80%, about 85%, about 90%, about 95%, about 96%, about 97%, about 98%, or about 99% homology with amino acids 660-720 (56% of residues in the four Cas9 sequences in FIG. 2 are conserved) of the amino acid sequence of Cas9 of *S. pyogenes, S. thermophilus, S. mutans* or *L. innocua;* differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua*; or is identical to amino acids 660-720 of the amino acid sequence of Cas9 of *S. pyogenes, S. thermophilus, S. mutans* or *L. innocua*.

In certain embodiments, a Cas9 molecule or Cas9 polypeptide comprises an amino acid sequence referred to as region 4:

having about 50%, about 55%, about 60%, about 65%, about 70%, about 75%, about 80%, about 85%, about 90%, about 95%, about 96%, about 97%, about 98%, or about 99% homology with amino acids 817-900 (55% of residues in the four Cas9 sequences in FIGS. 2A-2G are conserved) of the amino acid sequence of Cas9 of *S. pyogenes, S. thermophilus, S. mutans*, or *L. innocua;* differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans*, or *L. innocua*; or is identical to amino acids 817-900 of the amino acid sequence of Cas9 of *S. pyogenes, S. thermophilus, S. mutans*, or *L. innocua*.

In certain embodiments, a Cas9 molecule or Cas9 polypeptide comprises an amino acid sequence referred to as region 5:

having about 50%, about 55%, about 60%, about 65%, about 70%, about 75%, about 80%, about 85%, about 90%, about 95%, about 96%, about 97%, about 98%, or about 99% homology with amino acids 900-960 (60% of residues in the four Cas9 sequences in FIGS. 2A-2G are conserved)

of the amino acid sequence of Cas9 of *S. pyogenes, S. thermophilus, S. mutans*, or *L. innocua*;

differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans*, or *L. innocua*; or is identical to amino acids 900-960 of the amino acid sequence of Cas9 of *S. pyogenes, S. thermophilus, S. mutans*, or *L. innocua*.

7.4 Engineered or Altered Cas9

Cas9 molecules and Cas9 polypeptides described herein can possess any of a number of properties, including nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In certain embodiments, a Cas9 molecule or Cas9 polypeptide can include all or a subset of these properties. In certain embodiments, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In certain embodiments, an engineered Cas9 molecule or Cas9 polypeptide can have an alteration that alters its size, e.g., a deletion of amino acid sequence that reduces its size, e.g., without significant effect on one or more, or any Cas9 activity. In certain embodiments, an engineered Cas9 molecule or Cas9 polypeptide can comprise an alteration that affects PAM recognition. In certain embodiments, an engineered Cas9 molecule is altered to recognize a PAM sequence other than that recognized by the endogenous wild-type PI domain. In certain embodiments, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring, Cas9 molecules or Cas9 polypeptides, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In certain embodiments, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental, Cas9 molecule.

In certain embodiments, a mutation or mutations do not have a substantial effect on a Cas9 activity, e.g. a Cas9 activity described herein. In certain embodiments, a mutation or mutations have a substantial effect on a Cas9 activity, e.g. a Cas9 activity described herein.

7.5 Modified-Cleavage Cas9

In certain embodiments, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

In certain embodiments, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In certain embodiments, an eaCas9 molecule or eaCas9 polypeptide comprises an active, or cleavage competent, HNH-like domain (e.g., an HNH-like domain described herein, e.g., SEQ ID NOs:24-28) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIG. 2A-2G or an aspartic acid at position 10 of SEQ ID NO:2, e.g., can be substituted with an alanine. In certain embodiments, the eaCas9 molecule or eaCas9 polypeptide differs from wild-type in the N-terminal RuvC-like domain and does not cleave the target nucleic acid, or cleaves with significantly less efficiency, e.g., less than about 20%, about 10%, about 5%, about 1% or about 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes, S. aureus*, or *S. thermophilus*. In certain embodiments, the reference Cas9 molecule is the naturally occurring Cas9 molecule having the closest sequence identity or homology.

In certain embodiments, an eaCas9 molecule or eaCas9 polypeptide comprises an inactive, or cleavage incompetent, HNH domain and an active, or cleavage competent, N-terminal RuvC-like domain (e.g., a RuvC-like domain described herein, e.g., SEQ ID NOs:15-23). Exemplary inactive, or cleavage incompetent HNH-like domains can have a mutation at one or more of: a histidine in an HNH-like domain, e.g., a histidine shown at position 856 of the consensus sequence disclosed in FIGS. 2A-2G, e.g., can be substituted with an alanine; and one or more asparagines in an HNH-like domain, e.g., an asparagine shown at position 870 of the consensus sequence disclosed in FIGS. 2A-2G and/or at position 879 of the consensus sequence disclosed in FIGS. 2A-2G, e.g., can be substituted with an alanine. In certain embodiments, the eaCas9 differs from wild-type in the HNH-like domain and does not cleave the target nucleic acid, or cleaves with significantly less efficiency, e.g., less than about 20%, about 10%, about 5%, about 1% or about 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes, S. aureus*, or *S. thermophilus*. In certain embodiments, the reference Cas9 molecule is the naturally occurring Cas9 molecule having the closest sequence identity or homology.

In certain embodiments, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In certain embodiments, a mutation(s) is present in a RuvC domain. In certain embodiments, a mutation(s) is present in an HNH domain. In certain embodiments, mutations are present in both a RuvC domain and an HNH domain.

Exemplary mutations that may be made in the RuvC domain with reference to the *S. pyogenes* Cas9 sequence include: D10A, E762A, and/or D986A. Exemplary mutations that may be made in the HNH domain with reference to the *S. pyogenes* Cas9 sequence include: H840A, N854A, and/or N863A. Exemplary mutations that may be made in the RuvC domain with reference to the *S. aureus* Cas9 sequence include: D10A (see, e.g., SEQ ID NO:10). Exemplary mutations that may be made in the HNH domain with reference to the *S. aureus* Cas9 sequence include: N580A (see, e.g., SEQ ID NO:11).

Whether or not a particular sequence, e.g., a substitution, may affect one or more activity, such as targeting activity, cleavage activity, etc., can be evaluated or predicted, e.g., by evaluating whether the mutation is conservative. In certain embodiments, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In certain embodiments, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of *S aureus* or *S. pyogenes*, as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S aureus* or *S. pyogenes*); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S aureus* or *S. pyogenes*); or the ability to cleave a nucleic acid molecule, e.g., a double stranded or single stranded nucleic acid molecule, can be eliminated. In certain embodiments, the nickase is *S. aureus* Cas9-derived nickase comprising the sequence of SEQ ID NO:10 (D10A) or SEQ ID NO:11 (N580A) (Friedland 2015).

In certain embodiments, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In certain embodiments, the altered Cas9 molecule or Cas9 polypeptide comprises a sequence in which:

the sequence corresponding to the fixed sequence of the consensus sequence disclosed in FIGS. 2A-2G differs at no more than about 1%, about 2%, about 3%, about 4%, about 5%, about 10%, about 15%, or about 20% of the fixed residues in the consensus sequence disclosed in FIGS. 2A-2G; and the sequence corresponding to the residues identified by "*" in the consensus sequence disclosed in FIGS. 2A-2G differs at no more than about 1%, about 2%, about 3%, about 4%, about 5%, about 10%, about 15%, about 20%, about 25%, about 30%, about 35%, or about 40% of the "*" residues from the corresponding sequence of naturally occurring Cas9 molecule, e.g., an *S. pyogenes, S. thermophilus, S. mutans*, or *L. innocua* Cas9 molecule.

In certain embodiments, the altered Cas9 molecule or Cas9 polypeptide is an eaCas9 molecule or eaCas9 polypeptide comprising the amino acid sequence of *S. pyogenes* Cas9 disclosed in FIGS. 2A-2G with one or more amino acids that differ from the sequence of *S. pyogenes* (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G.

In certain embodiments, the altered Cas9 molecule or Cas9 polypeptide is an eaCas9 molecule or eaCas9 polypeptide comprising the amino acid sequence of *S. thermophilus* Cas9 disclosed in FIGS. 2A-2G with one or more amino acids that differ from the sequence of *S. thermophilus* (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G.

In certain embodiments, the altered Cas9 molecule or Cas9 polypeptide is an eaCas9 molecule or eaCas9 polypeptide comprising the amino acid sequence of *S. mutans* Cas9 disclosed in FIGS. 2A-2G with one or more amino acids that differ from the sequence of *S. mutans* (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G.

In certain embodiments, the altered Cas9 molecule or Cas9 polypeptide is an eaCas9 molecule or eaCas9 polypeptide comprising the amino acid sequence of *L. innocua* Cas9 disclosed in FIGS. 2A-2G with one or more amino acids that differ from the sequence of *L. innocua* (e.g., substitutions) at one or more residues (e.g., 2, 3, 5, 10, 15, 20, 30, 50, 70, 80, 90, 100, or 200 amino acid residues) represented by an "*" in the consensus sequence disclosed in FIGS. 2A-2G.

In certain embodiments, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of *S. pyogenes* comprising an N-terminal RuvC-like domain can be fused to a fragment of Cas9 molecule of a species other than *S. pyogenes* (e.g., *S. thermophilus*) comprising an HNH-like domain.

7.6 Cas9 with Altered or No PAM Recognition

Naturally occurring Cas9 molecules can recognize specific PAM sequences, for example the PAM recognition sequences described above for, e.g., *S. pyogenes, S. thermophilus, S. mutans*, and *S. aureus*.

In certain embodiments, a Cas9 molecule or Cas9 polypeptide has the same PAM specificities as a naturally occurring Cas9 molecule. In certain embodiments, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes in order to decrease off-target sites and/or improve specificity; or eliminate a PAM recognition requirement. In certain embodiments, a Cas9 molecule or Cas9 polypeptide can be altered, e.g., to increase length of PAM recognition sequence and/or improve Cas9 specificity to high level of identity (e.g., about 98%, about 99% or about 100% match between gRNA and a PAM sequence), e.g., to decrease off-target sites and/or increase specificity. In certain embodiments, the length of the PAM recognition sequence is at least 4, 5, 6, 7, 8, 9, 10 or 15 amino acids in length. In certain embodiments, the Cas9 specificity requires at least about 90%, about 95%, about 96%, about 97%, about 98%, or about 99% homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described (see, e.g., Esvelt 2011). Candidate Cas9 molecules can be evaluated, e.g., by methods described below.

7.7 Size-Optimized Cas9

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., an *S. aureus* or *S. pyogenes* Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in certain embodiments is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

7.8 Identifying Regions Suitable for Deletion

Suitable regions of Cas9 molecules for deletion can be identified by a variety of methods. Naturally-occurring orthologous Cas9 molecules from various bacterial species can be modeled onto the crystal structure of *S. pyogenes* Cas9 (Nishimasu 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

7.9 Nucleic Acids Encoding Cas9 Molecules

Nucleic acids encoding the Cas9 molecules or Cas9 polypeptides, e.g., an eaCas9 molecule or eaCas9 polypeptides are provided herein. Exemplary nucleic acids encoding Cas9 molecules or Cas9 polypeptides have been described previously (see, e.g., Cong 2013; Wang 2013; *Mali* 2013; Jinek 2012).

In certain embodiments, a nucleic acid encoding a Cas9 molecule or Cas9 polypeptide can be a synthetic nucleic acid sequence. For example, the synthetic nucleic acid molecule can be chemically modified, e.g., as described herein. In certain embodiments, the Cas9 mRNA has one or more (e.g., all of the following properties: it is capped, polyadenylated, substituted with 5-methylcytidine and/or pseudouridine.

Additionally or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

Additionally or alternatively, a nucleic acid encoding a Cas9 molecule or Cas9 polypeptide may comprise a nuclear localization sequence (NLS). Nuclear localization sequences are known in the art.

An exemplary codon optimized nucleic acid sequence encoding a Cas9 molecule of *S. pyogenes* is set forth in SEQ ID NO:3. The corresponding amino acid sequence of an *S. pyogenes* Cas9 molecule is set forth in SEQ ID NO:2. In certain embodiments, the *S. pyogenes* Cas9 molecule is an *S. pyogenes* Cas9 variant. In certain embodiments, the *S. pyogenes* Cas9 variant is a EQR variant that has a sequence set forth in SEQ ID NO: 208. In certain embodiments, the *S. pyogenes* Cas9 variant is a VRER variant that has a sequence set forth in SEQ ID NO: 209.

Exemplary codon optimized nucleic acid sequences encoding an *S. aureus* Cas9 molecule are set forth in SEQ ID NOs:7-9, 206 and 207. In certain embodiments, the Cas9 molecule is a mutant *S. aureus* Cas9 molecule comprising a D10A mutation. In certain embodiments, the mutant *S.* aureus Cas9 molecule comprising a D10A mutation has a sequence set forth in SEQ ID NO: 10. In certain embodiments, the Cas9 molecule is a mutant *S. aureus* Cas9 molecule comprising a N580 mutation. In certain embodiments, the mutant *S. aureus* Cas9 molecule comprising a N580 mutation has a sequence set forth in SEQ ID NO: 11. An amino acid sequence of an *S. aureus* Cas9 molecule is set forth in SEQ ID NO:6.

If any of the above Cas9 sequences are fused with a peptide or polypeptide at the C-terminus, it is understood that the stop codon can be removed.

7.10 Other Cas Molecules and Cas Polypeptides

Various types of Cas molecules or Cas polypeptides can be used to practice the inventions disclosed herein. In certain embodiments, Cas molecules of Type II Cas systems are used. In certain embodiments, Cas molecules of other Cas systems are used. For example, Type I or Type III Cas molecules may be used. Exemplary Cas molecules (and Cas systems) have been described previously (see, e.g., Haft 2005 and Makarova 2011). Exemplary Cas molecules (and Cas systems) are also shown in Table 13.

TABLE 13

Cas Systems

| Gene name[‡] | System type or subtype | Name from Haft 2005[§] | Structure of encoded protein (PDB accessions)[¶] | Families (and superfamily) of encoded protein[#][**] | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |

TABLE 13-continued

| Cas Systems | | | | | |
|---|---|---|---|---|---|
| Gene name‡ | System type or subtype | Name from Haft 2005§ | Structure of encoded protein (PDB accessions)¶ | Families (and superfamily) of encoded protein#** | Representatives |
| cas8a1 | Subtype I-A‡‡ | cmx1, cst1, csx8, csx13 and CXXC-CXXC | NA | BH0338-like | LA3191§§ and PG2018§§ |
| cas8a2 | Subtype I-A‡‡ | csa4 and csx9 | NA | PH0918 | AF0070, AF1873, MJ0385, PF0637, PH0918 and SSO1401 |
| cas8b | Subtype I-B‡‡ | csh1 and TM1802 | NA | BH0338-like | MTH1090 and TM1802 |
| cas8c | Subtype I-C‡‡ | csd1 and csp2 | NA | BH0338-like | BH0338 |
| cas9 | Type II‡‡ | csn1 and csx12 | NA | COG3513 | FTN_0757 and SPy1046 |
| cas10 | Type III‡‡ | cmr2, csm1 and csx11 | NA | COG1353 | MTH326, Rv2823c§§ and TM1794§§ |
| cas10d | Subtype I-D‡‡ | csc3 | NA | COG1353 | slr7011 |
| csy1 | Subtype I-F‡‡ | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E‡‡ | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A‡‡ | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |

TABLE 13-continued

Cas Systems

| Gene name‡ | System type or subtype | Name from Haft 2005§ | Structure of encoded protein (PDB accessions)¶ | Families (and superfamily) of encoded protein#** | Representatives |
|---|---|---|---|---|---|
| csb2 | Subtype I-U§§ | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype I-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2171 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

8. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule have been described previously (Jinek 2012).

8.1 Binding and Cleavage Assay: Testing Cas9 Endonuclease Activity

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μL. Reactions are initiated by the addition of 1 μL target DNA (10 nM) and incubated for 1 h at 37° C. Reactions are quenched by the addition of 20 μL of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

8.2 Binding Assay: Testing the Binding of Cas9 Molecule to Target DNA

Exemplary methods for evaluating the binding of Cas9 molecule to target DNA have been described previously, e.g., in Jinek et al., SCIENCE 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1×TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 µL. Cas9 protein molecule is programmed with equimolar amounts of pre-annealed gRNA molecule and titrated from 100 µM to 1 µM. Radiolabeled DNA is added to a final concentration of 20 µM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

8.3 Differential Scanning Flourimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Technologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with 2 uM Cas9 in optimal buffer from assay 1 above and incubating at RT for 10' in a 384 well plate. An equal volume of optimal buffer+10×SYPRO Orange® (Life Technologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

9. Genome Editing Approaches

Described herein are compositions, genome editing systems and methods for targeted alteration (e.g., knockout) of the RS1, RL2, and/or LAT gene(s), e.g., one or both alleles of the RS1, RL2, and/or LAT gene(s), e.g., using one or more of the approaches or pathways described herein, e.g., using NHEJ. Described herein are also methods for targeted knockdown of the RS1, RL2, and/or LAT gene(s).

9.1 NHEJ Approaches for Gene Targeting

In certain embodiments of the methods provided herein, NHEJ-mediated alteration is used to alter an HSV RS1 target position, an HSV RL2 target position, or an HSV LAT target position. As described herein, nuclease-induced non-homologous end-joining (NHEJ) can be used to target gene-specific knockouts. Nuclease-induced NHEJ can also be used to remove (e.g., delete) sequence insertions in a gene of interest.

In certain embodiments, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein. The indel mutations generated by NHEJ are unpredictable in nature; however, at a given break site certain indel sequences are favored and are over represented in the population, likely due to small regions of microhomology. The lengths of deletions can vary widely; they are most commonly in the 1-50 bp range, but can reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs (e.g., motifs less than or equal to 50 nucleotides in length) as long as the generation of a specific final sequence is not required. If a double-strand break is targeted near to a target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. In this way, DNA segments as large as several hundred kilobases can be deleted. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

9.1.1 Placement of Double Strand or Single Strand Breaks Relative to the Target Position In certain embodiments, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In certain embodiments, the cleavage site is between 0-30 bp away from the target position (e.g., less than 30, 25, 20, 15, 10, 9, 8, 7, 6, 5, 4, 3, 2 or 1 bp from the target position).

In certain embodiments, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In certain embodiments, the gRNAs are configured to position cuts at the same position, or within a few nucleotides of one another, on different strands, essentially mimicking a double strand break. In certain embodiments, the closer nick is between 0-30 bp away from the target position (e.g., less than 30, 25, 20, 15, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In certain embodiments, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In certain embodiments, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In certain embodiments, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair can ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20, or 10 bp).

9.2 HDR Repair, HDR-Mediated Knock-in, and Template Nucleic Acids

In certain embodiments of the methods provided herein, HDR-mediated sequence alteration is used to alter the sequence of one or more nucleotides in a RS1, RL2 or LAT gene using an exogenously provided template nucleic acid (also referred to herein as a donor construct). In certain embodiments, HDR-mediated alteration of an HSV RS1 target position, an HSV RL2 target position, or an HSV LAT target position occurs by HDR with an exogenously provided donor template or template nucleic acid. For example, the donor construct or template nucleic acid provides for alteration of an HSV RS1 target position, an HSV RL2 target position, or an HSV LAT target position. In certain embodiments, a plasmid donor is used as a template for homologous recombination. In certain embodiments, a single stranded donor template is used as a template for alteration of the HSV RS1 target position, HSV RL2 target position, or HSV LAT target position sition by alternate methods of HDR (e.g., single strand annealing) between the target sequence and the donor template. Donor template-effected alteration of an HSV RS1 target position, an HSV RL2 target position, or an HSV LAT target position depends on cleavage by a Cas9 molecule. Cleavage by Cas9 can comprise a double strand break or two single strand breaks.

In certain embodiments, HDR-mediated sequence alteration is used to alter the sequence of one or more nucleotides in a RS1, RL2 or LAT gene without using an exogenously provided template nucleic acid. In certain embodiments, alteration of an HSV RS1 target position, an HSV RL2 target position, or an HSV LAT target position target position occurs by HDR with endogenous genomic donor sequence. For example, the endogenous genomic donor sequence provides for alteration of the RL2, LAT, or RS1 target position. In certain embodiments, the endogenous genomic donor sequence is located on the same chromosome as the target sequence. In certain embodiments, the endogenous genomic donor sequence is located on a different chromosome from the target sequence. Alteration of an HSV RS1 target position, an HSV RL2 target position, or an HSV LAT target position by endogenous genomic donor sequence depends on cleavage by a Cas9 molecule. Cleavage by Cas9 can comprise a double strand break or two single strand breaks.

In certain embodiments of the methods provided herein, HDR-mediated alteration is used to alter a single nucleotide in a RL2, LAT, or RS1 gene. These embodiments may utilize either one double-strand break or two single-strand breaks. In certain embodiments, a single nucleotide alteration is incorporated using (1) one double-strand break, (2) two single-strand breaks, (3) two double-strand breaks with a break occurring on each side of the target position, (4) one double-strand break and two single strand breaks with the double strand break and two single strand breaks occurring on each side of the target position, (5) four single-strand breaks with a pair of single-strand breaks occurring on each side of the target position, or (6) one single-strand break.

In certain embodiments, wherein a single-stranded template nucleic acid (e.g., a donor template) is used, the target position can be altered by alternative HDR.

Donor template-effected alteration of an HSV RS1 target position, an HSV RL2 target position, or an HSV LAT target position depends on cleavage by a Cas9 molecule. Cleavage by Cas9 can comprise a nick, a double-strand break, or two single-strand breaks, e.g., one on each strand of the target nucleic acid. After introduction of the breaks on the target nucleic acid, resection occurs at the break ends resulting in single stranded overhanging DNA regions.

In canonical HDR, a double-stranded donor template is introduced, comprising homologous sequence to the target nucleic acid that can either be directly incorporated into the target nucleic acid or used as a template to change the sequence of the target nucleic acid. After resection at the break, repair can progress by different pathways, e.g., by the double Holliday junction model (or double-strand break repair, DSBR, pathway) or the synthesis-dependent strand annealing (SDSA) pathway. In the double Holliday junction model, strand invasion by the two single stranded overhangs of the target nucleic acid to the homologous sequences in the donor template occurs, resulting in the formation of an intermediate with two Holliday junctions. The junctions migrate as new DNA is synthesized from the ends of the invading strand to fill the gap resulting from the resection. The end of the newly synthesized DNA is ligated to the resected end, and the junctions are resolved, resulting in alteration of the target nucleic acid. Crossover with the donor template may occur upon resolution of the junctions. In the SDSA pathway, only one single stranded overhang invades the donor template and new DNA is synthesized from the end of the invading strand to fill the gap resulting from resection. The newly synthesized DNA then anneals to the remaining single stranded overhang, new DNA is synthesized to fill in the gap, and the strands are ligated to produce the altered DNA duplex.

In alternative HDR, a single strand donor template, e.g., template nucleic acid, is introduced. A nick, single strand break, or double strand break at the target nucleic acid, for altering a desired target position, is mediated by a Cas9 molecule, e.g., described herein, and resection at the break occurs to reveal single stranded overhangs. Incorporation of the sequence of the template nucleic acid to alter an HSV RS1 target position, an HSV RL2 target position, or an HSV LAT target position typically occurs by the SDSA pathway, as described above.

Additional details on template nucleic acids are provided in Section IV entitled "Template nucleic acids" in International Application PCT/US2014/057905.

In certain embodiments, double strand cleavage is effected by a Cas9 molecule having cleavage activity associated with an HNH-like domain and cleavage activity associated with a RuvC-like domain, e.g., an N-terminal RuvC-like domain, e.g., a wild-type Cas9. Such embodiments require only a single gRNA.

In certain embodiments, one single-strand break, or nick, is effected by a Cas9 molecule having nickase activity, e.g., a Cas9 nickase as described herein (such as a D10A Cas9 nickase). A nicked target nucleic acid can be a substrate for alt-HDR.

In certain embodiments, two single-strand breaks, or nicks, are effected by a Cas9 molecule having nickase activity, e.g., cleavage activity associated with an HNH-like domain or cleavage activity associated with an N-terminal RuvC-like domain. Such embodiments usually require two gRNAs, one for placement of each single-strand break. In certain embodiments, the Cas9 molecule having nickase activity cleaves the strand to which the gRNA hybridizes, but not the strand that is complementary to the strand to which the gRNA hybridizes. In certain embodiments, the Cas9 molecule having nickase activity does not cleave the strand to which the gRNA hybridizes, but rather cleaves the strand that is complementary to the strand to which the gRNA hybridizes.

In certain embodiments, the nickase has HNH activity, e.g., a Cas9 molecule having the RuvC activity inactivated, e.g., a Cas9 molecule having a mutation at D10, e.g., the D10A mutation (see, e.g., SEQ ID NO:10). D10A inactivates RuvC; therefore, the Cas9 nickase has (only) HNH activity and can cut on the strand to which the gRNA hybridizes (e.g., the complementary strand, which does not have the NGG PAM on it). In certain embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In certain embodiments, a Cas9 molecule having an N863 mutation, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA). In certain embodiments, a Cas9 molecule having an N580 mutation, e.g., the N580A mutation, mutation can be used as a nickase. N580A inactivates HNH therefore the Cas9 nickase has (only) RuvC activity and cuts on the non-complementary strand (the strand that has the NGG PAM and whose sequence is identical to the gRNA).

In certain embodiments, in which a nickase and two gRNAs are used to position two single strand nicks, one nick is on the + strand and one nick is on the − strand of the target nucleic acid. The PAMs can be outwardly facing. The gRNAs can be selected such that the gRNAs are separated by, from about 0-50, 0-100, or 0-200 nucleotides. In certain embodiments, there is no overlap between the target sequences that are complementary to the targeting domains of the two gRNAs. In certain embodiments, the gRNAs do not overlap and are separated by as much as 50, 100, or 200 nucleotides. In certain embodiments, the use of two gRNAs can increase specificity, e.g., by decreasing off-target binding (Ran 2013).

In certain embodiments, a single nick can be used to induce HDR, e.g., alt-HDR. In certain embodiments, a single nick can be used to increase the ratio of HR to NHEJ at a given cleavage site. In certain embodiments, a single strand break is formed in the strand of the target nucleic acid to which the targeting domain of said gRNA is complementary. In certain embodiments, a single strand break is formed in the strand of the target nucleic acid other than the strand to which the targeting domain of said gRNA is complementary.

9.2.1 Placement of Double Strand or Single Strand Breaks Relative to the Target Position A double strand break or single strand break in one of the strands should be sufficiently close to an HSV RS1 target position, an HSV RL2 target position, or an HSV LAT target position that an alteration is produced in the desired region. In certain embodiments, the distance is not more than 50, 100, 200, 300, 350 or 400 nucleotides. In certain embodiments, the break should be sufficiently close to target position such that the target position is within the region that is subject to exonuclease-mediated removal during end resection. If the distance between the HSV RS1 target position, HSV RL2 target position, or HSV LAT target position and a break is too great, the sequence desired to be altered may not be included in the end resection and, therefore, may not be altered, as donor sequence, either exogenously provided donor sequence or endogenous genomic donor sequence, in certain embodiments is only used to alter sequence within the end resection region.

In certain embodiments, the methods described herein introduce one or more breaks near an HSV RS1 target position, an HSV RL2 target position, or an HSV LAT target position. In certain of these embodiments, two or more breaks are introduced that flank an HSV RS1 target position, an HSV RL2 target position, or an HSV LAT target position. The two or more breaks remove (e.g., delete) a genomic sequence including an HSV RS1 target position, an HSV RL2 target position, or an HSV LAT target position. All methods described herein result in altering an HSV RS1 target position, an HSV RL2 target position, or an HSV LAT target position within a RS1, RL2, or LAT gene.

In certain embodiments, the gRNA targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, or 200 nucleotides of the region desired to be altered, e.g., a mutation. The break, e.g., a double strand or single strand break, can be positioned upstream or downstream of the region desired to be altered, e.g., a mutation. In certain embodiments, a break is positioned within the region desired to be altered, e.g., within a region defined by at least two mutant nucleotides. In certain embodiments, a break is positioned immediately adjacent to the region desired to be altered, e.g., immediately upstream or downstream of a mutation.

In certain embodiments, a single strand break is accompanied by an additional single strand break, positioned by a second gRNA molecule, as discussed below. For example, the targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150, or 200 nucleotides of a target position. In certain embodiments, the first and second gRNA molecules are configured such that, when guiding a Cas9 nickase, a single strand break can be accompanied by an additional single strand break, positioned by a second gRNA, sufficiently close to one another to result in alteration of the desired region. In certain embodiments, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In certain embodiments, the two gRNA molecules are configured to position cuts at the same position, or within a few nucleotides of one another, on different strands, e.g., essentially mimicking a double strand break.

In certain embodiments in which a gRNA (unimolecular (or chimeric) or modular gRNA) and Cas9 nuclease induce a double strand break for the purpose of inducing HDR-mediated sequence alteration, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In certain embodiments, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In certain embodiments, one can promote HDR by using nickases to generate a break with overhangs. While not wishing to be bound by theory, the single stranded nature of the overhangs can enhance the cell's likelihood of repairing the break by HDR as opposed to, e.g., NHEJ. Specifically, in certain embodiments, HDR is promoted by selecting a first gRNA that targets a first nickase to a first target sequence, and a second gRNA that targets a second nickase to a second target sequence which is on the opposite DNA strand from the first target sequence and offset from the first nick.

In certain embodiments, the targeting domain of a gRNA molecule is configured to position a cleavage event sufficiently far from a preselected nucleotide that the nucleotide is not altered. In certain embodiments, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

9.2.2 Placement of a First Break and a Second Break Relative to Each Other

In certain embodiments, a double strand break can be accompanied by an additional double strand break, positioned by a second gRNA molecule, as is discussed below.

In certain embodiments, a double strand break can be accompanied by two additional single strand breaks, positioned by a second gRNA molecule and a third gRNA molecule.

In certain embodiments, a first and second single strand breaks can be accompanied by two additional single strand breaks positioned by a third gRNA molecule and a fourth gRNA molecule.

When two or more gRNAs are used to position two or more cleavage events, e.g., double strand or single strand breaks, in a target nucleic acid, the two or more cleavage events may be made by the same or different Cas9 proteins. For example, when two gRNAs are used to position two double stranded breaks, a single Cas9 nuclease may be used to create both double stranded breaks. When two or more gRNAs are used to position two or more single stranded breaks (nicks), a single Cas9 nickase may be used to create the two or more nicks. When two or more gRNAs are used to position at least one double stranded break and at least one single stranded break, two Cas9 proteins may be used, e.g., one Cas9 nuclease and one Cas9 nickase. In certain embodiments, two or more Cas9 proteins are used, and the two or more Cas9 proteins may be delivered sequentially to control specificity of a double stranded versus a single stranded break at the desired position in the target nucleic acid.

In certain embodiments, the targeting domain of the first gRNA molecule and the targeting domain of the second gRNA molecules are complementary to opposite strands of the target nucleic acid molecule. In certain embodiments, the gRNA molecule and the second gRNA molecule are configured such that the PAMs are oriented outward.

In certain embodiments, two gRNA are selected to direct Cas9-mediated cleavage at two positions that are a preselected distance from each other. In certain embodiments, the two points of cleavage are on opposite strands of the target nucleic acid. In certain embodiments, the two cleavage points form a blunt ended break, and in other embodiments, they are offset so that the DNA ends comprise one or two overhangs (e.g., one or more 5' overhangs and/or one or more 3' overhangs). In certain embodiments, each cleavage event is a nick. In certain embodiments, the nicks are close enough together that they form a break that is recognized by the double stranded break machinery (as opposed to being recognized by, e.g., the SSBr machinery). In certain embodiments, the nicks are far enough apart that they create an overhang that is a substrate for HDR, i.e., the placement of the breaks mimics a DNA substrate that has experienced some resection. For instance, in certain embodiments the nicks are spaced to create an overhang that is a substrate for processive resection. In certain embodiments, the two breaks are spaced within 25-65 nucleotides of each other. The two breaks may be, e.g., about 25, 30, 35, 40, 45, 50, 55, 60, or 65 nucleotides of each other. The two breaks may be, e.g., at least about 25, 30, 35, 40, 45, 50, 55, 60, or 65 nucleotides of each other. The two breaks may be, e.g., at most about 30, 35, 40, 45, 50, 55, 60, or 65 nucleotides of each other. In certain embodiments, the two breaks are about 25-30, 30-35, 35-40, 40-45, 45-50, 50-55, 55-60, or 60-65 nucleotides of each other.

In certain embodiments, the break that mimics a resected break comprises a 3' overhang (e.g., generated by a DSB and a nick, where the nick leaves a 3' overhang), a 5' overhang (e.g., generated by a DSB and a nick, where the nick leaves a 5' overhang), a 3' and a 5' overhang (e.g., generated by three cuts), two 3' overhangs (e.g., generated by two nicks that are offset from each other), or two 5' overhangs (e.g., generated by two nicks that are offset from each other).

In certain embodiments in which two gRNAs (independently, unimolecular (or chimeric) or modular gRNA) complexing with Cas9 nickases induce two single strand breaks for the purpose of inducing HDR-mediated alteration, the closer nick is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, or 75 to 100 bp) away from the target position and the two nicks can ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20, 10, or 5 bp away from each other). In certain embodiments, the cleavage site is between 0-100 bp (e.g., 0 to 75, 0 to 50, 0 to 25, 25 to 100, 25 to 75, 25 to 50, 50 to 100, 50 to 75, or 75 to 100 bp) away from the target position.

In certain embodiments, two gRNAs, e.g., independently, unimolecular (or chimeric) or modular gRNA, are configured to position a double-strand break on both sides of a target position. In certain embodiments, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In certain embodiments, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair can ideally be within 0-500 bp of the target position (e.g., no more than 450, 400, 350, 300, 250, 200, 150, 100, 50 or 25 bp from the target position). When nickases are used, the two nicks in a pair are, in certain embodiments, within 25-65 bp of each other (e.g., between 25 to 55, 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, or 20 or 10 bp).

When two gRNAs are used to target Cas9 molecules to breaks, different combinations of Cas9 molecules are envisioned. In certain embodiments, a first gRNA is used to target a first Cas9 molecule to a first target position, and a second gRNA is used to target a second Cas9 molecule to a second target position. In certain embodiments, the first Cas9 molecule creates a nick on the first strand of the target nucleic acid, and the second Cas9 molecule creates a nick on the opposite strand, resulting in a double stranded break (e.g., a blunt ended cut or a cut with overhangs).

Different combinations of nickases can be chosen to target one single stranded break to one strand and a second single stranded break to the opposite strand. When choosing a combination, one can take into account that there are nickases having one active RuvC-like domain, and nickases having one active HNH domain. In certain embodiments, a RuvC-like domain cleaves the non-complementary strand of the target nucleic acid molecule. In certain embodiments, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one can choose two gRNAs that bind to opposite strands of the target. In more detail, in certain embodiments a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, in certain embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain can cleave the non-complementary strand and the Cas9 molecule with the HNH domain can cleave the complementary strand, resulting in a double stranded break.

9.2.3 Homology Arms of the Donor Template

A homology arm should extend at least as far as the region in which end resection may occur, e.g., in order to allow the resected single stranded overhang to find a complementary region within the donor template. The overall length could be limited by parameters such as plasmid size or viral packaging limits. In certain embodiments, a homology arm does not extend into repeated elements, e.g., Alu repeats or LINE repeats.

Exemplary homology arm lengths include at least 50, 100, 250, 500, 750, 1000, 2000, 3000, 4000, or 5000 nucleotides. In certain embodiments, the homology arm length is 50-100, 100-250, 250-500, 500-750, 750-1000, 1000-2000, 2000-3000, 3000-4000, or 4000-5000 nucleotides.

A template nucleic acid, as that term is used herein, refers to a nucleic acid sequence which can be used in conjunction with a Cas9 molecule and a gRNA molecule to alter the structure of an HSV RS1 target position, an HSV RL2 target position, or an HSV LAT target position. In certain embodiments, the HSV RS1 target position, HSV RL2 target position, or HSV LAT target position target position can be a site between two nucleotides, e.g., adjacent nucleotides, on the target nucleic acid into which one or more nucleotides is added. Alternatively, the HSV RS1 target position, HSV RL2 target position, or HSV LAT target position target position may comprise one or more nucleotides that are altered by a template nucleic acid.

In certain embodiments, the target nucleic acid is modified to have some or all of the sequence of the template nucleic acid, typically at or near cleavage site(s). In certain embodiments, the template nucleic acid is single stranded. In certain embodiments, the template nucleic acid is double stranded. In certain embodiments, the template nucleic acid is DNA, e.g., double stranded DNA. In certain embodiments, the template nucleic acid is single stranded DNA. In certain embodiments, the template nucleic acid is encoded on the same vector backbone, e.g. AAV genome, plasmid DNA, as the Cas9 and gRNA. In certain embodiments, the template nucleic acid is excised from a vector backbone in vivo, e.g., it is flanked by gRNA recognition sequences. In certain embodiments, the template nucleic acid comprises endogenous genomic sequence.

In certain embodiments, the template nucleic acid alters the structure of the target position by participating in an HDR event. In certain embodiments, the template nucleic acid alters the sequence of the target position. In certain embodiments, the template nucleic acid results in the incorporation of a modified, or non-naturally occurring base into the target nucleic acid.

Typically, the template sequence undergoes a breakage mediated or catalyzed recombination with the target sequence. In certain embodiments, the template nucleic acid includes sequence that corresponds to a site on the target sequence that is cleaved by an eaCas9 mediated cleavage event. In certain embodiments, the template nucleic acid includes sequence that corresponds to both a first site on the target sequence that is cleaved in a first Cas9 mediated event, and a second site on the target sequence that is cleaved in a second Cas9 mediated event.

A template nucleic acid typically comprises the following components:

[5' homology arm]-[replacement sequence]-[3' homology arm].

The homology arms provide for recombination into the chromosome, thus replacing the undesired element, e.g., a mutation or signature, with the replacement sequence. In certain embodiments, the homology arms flank the most distal cleavage sites.

In certain embodiments, the 3' end of the 5' homology arm is the position next to the 5' end of the replacement sequence. In certain embodiments, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In certain embodiments, the 5' end of the 3' homology arm is the position next to the 3' end of the replacement sequence. In certain embodiments, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In certain embodiments, to alter one or more nucleotides at an HSV RS1 target position, an HSV RL2 target position, or an HSV LAT target position, the homology arms, e.g., the 5' and 3' homology arms, may each comprise about 1000 bp of sequence flanking the most distal gRNAs (e.g., 1000 bp of sequence on either side of the HSV RS1 target position, HSV RL2 target position, or HSV LAT target position).

In certain embodiments, one or both homology arms may be shortened to avoid including certain sequence repeat elements, e.g., Alu repeats or LINE elements. For example, a 5' homology arm may be shortened to avoid a sequence repeat element. In certain embodiments, a 3' homology arm may be shortened to avoid a sequence repeat element. In certain embodiments, both the 5' and the 3' homology arms may be shortened to avoid including certain sequence repeat elements.

In certain embodiments, template nucleic acids for altering the sequence of an HSV RS1 target position, an HSV RL2 target position, or an HSV LAT target position may be designed for use as a single-stranded oligonucleotide, e.g., a single-stranded oligodeoxynucleotide (ssODN). When using a ssODN, 5' and 3' homology arms may range up to about 200 bp in length, e.g., at least 25, 50, 75, 100, 125, 150, 175, or 200 bp in length. Longer homology arms can also be for ssODNs as improvements in oligonucleotide synthesis continue to be made. In certain embodiments, a longer homology arm is made by a method other than chemical synthesis, e.g., by denaturing a long double stranded nucleic acid and purifying one of the strands, e.g., by affinity for a strand-specific sequence anchored to a solid substrate.

In certain embodiments, alt-HDR proceeds more efficiently when the template nucleic acid has extended homology 5' to the nick (i.e., in the 5' direction of the nicked strand). Accordingly, in certain embodiments, the template nucleic acid has a longer homology arm and a shorter homology arm, wherein the longer homology arm can anneal 5' of the nick. In certain embodiments, the arm that can anneal 5' to the nick is at least 25, 50, 75, 100, 125, 150, 175, or 200, 300, 400, 500, 600, 700, 800, 900, 1000, 1500, 2000, 3000, 4000, or 5000 nucleotides from the nick or the 5' or 3' end of the replacement sequence. In certain embodiments, the arm that can anneal 5' to the nick is at least about 10%, about 20%, about 30%, about 40%, or about 50% longer than the arm that can anneal 3' to the nick. In certain embodiments, the arm that can anneal 5' to the nick is at least 2×, 3×, 4×, or 5× longer than the arm that can anneal 3' to the nick. Depending on whether a ssDNA template can anneal to the intact strand or the nicked strand, the homology arm that anneals 5' to the nick may be at the 5' end of the ssDNA template or the 3' end of the ssDNA template, respectively.

Similarly, in certain embodiments, the template nucleic acid has a 5' homology arm, a replacement sequence, and a 3' homology arm, such that the template nucleic acid has extended homology to the 5' of the nick. For example, the 5' homology arm and 3' homology arm may be substantially the same length, but the replacement sequence may extend farther 5' of the nick than 3' of the nick. In certain embodiments, the replacement sequence extends at least about 10%, about 20%, about 30%, about 40%, about 50%, 2×, 3×, 4×, or 5× further to the 5' end of the nick than the 3' end of the nick.

In certain embodiments, alt-HDR proceeds more efficiently when the template nucleic acid is centered on the nick. Accordingly, in certain embodiments, the template nucleic acid has two homology arms that are essentially the same size. For instance, the first homology arm of a template nucleic acid may have a length that is within about 10%, about 9%, about 8%, about 7%, about 6%, about 5%, about 4%, about 3%, about 2%, or about 1% of the second homology arm of the template nucleic acid.

Similarly, in certain embodiments, the template nucleic acid has a 5' homology arm, a replacement sequence, and a 3' homology arm, such that the template nucleic acid extends substantially the same distance on either side of the nick. For example, the homology arms may have different lengths, but the replacement sequence may be selected to compensate for this. For example, the replacement sequence may extend further 5' from the nick than it does 3' of the nick, but the homology arm 5' of the nick is shorter than the homology arm 3' of the nick, to compensate. The converse is also possible, e.g., that the replacement sequence may extend further 3' from the nick than it does 5' of the nick, but the homology arm 3' of the nick is shorter than the homology arm 5' of the nick, to compensate.

9.2.4 Template Nucleic Acids

In certain embodiments, the template nucleic acid is double stranded. In certain embodiments, the template nucleic acid is single stranded. In certain embodiments, the template nucleic acid comprises a single stranded portion and a double stranded portion. In certain embodiments, the template nucleic acid comprises about 50 to 100 bp, e.g., 55 to 95, 60 to 90, 65 to 85, or 70 to 80 bp, homology on either side of the nick and/or replacement sequence. In certain embodiments, the template nucleic acid comprises about 50, 55, 60, 65, 70, 75, 80, 85, 90, 95, or 100 bp homology 5' of the nick or replacement sequence, 3' of the nick or replacement sequence, or both 5' and 3' of the nick or replacement sequences.

In certain embodiments, the template nucleic acid comprises about 150 to 200 bp, e.g., 155 to 195, 160 to 190, 165 to 185, or 170 to 180 bp, homology 3' of the nick and/or replacement sequence. In certain embodiments, the template nucleic acid comprises about 150, 155, 160, 165, 170, 175, 180, 185, 190, 195, or 200 bp homology 3' of the nick or replacement sequence. In certain embodiments, the template nucleic acid comprises less than about 100, 90, 80, 70, 60, 50, 40, 30, 20, 15, or 10 bp homology 5' of the nick or replacement sequence.

In certain embodiment, the template nucleic acid comprises about 150 to 200 bp, e.g., 155 to 195, 160 to 190, 165 to 185, or 170 to 180 bp, homology 5' of the nick and/or replacement sequence. In certain embodiment, the template nucleic acid comprises about 150, 155, 160, 165, 170, 175, 180, 185, 190, 195, or 200 bp homology 5' of the nick or replacement sequence. In certain embodiments, the template nucleic acid comprises less than about 100, 90, 80, 70, 60, 50, 40, 30, 20, 15, or 10 bp homology 3' of the nick or replacement sequence.

In certain embodiments, the template nucleic acid comprises a nucleotide sequence, e.g., of one or more nucleotides, that can be added to or can template a change in the target nucleic acid. In other embodiments, the template nucleic acid comprises a nucleotide sequence that may be used to modify the target position.

The template nucleic acid may comprise a replacement sequence. In certain embodiments, the template nucleic acid comprises a 5' homology arm. In certain embodiments, the template nucleic acid comprises a 3' homology arm.

In certain embodiments, the template nucleic acid is linear double stranded DNA. The length may be, e.g., about 150-200 bp, e.g., about 150, 160, 170, 180, 190, or 200 bp. The length may be, e.g., at least 150, 160, 170, 180, 190, or 200 bp. In certain embodiments, the length is no greater than 150, 160, 170, 180, 190, or 200 bp. In certain embodiments, a double stranded template nucleic acid has a length of about 160 bp, e.g., about 155-165, 150-170, 140-180, 130-190, 120-200, 110-210, 100-220, 90-230, or 80-240 bp.

The template nucleic acid can be linear single stranded DNA. In certain embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the plus strand of the target nucleic acid, (iv) linear single stranded DNA that can anneal to the minus strand of the target nucleic acid, or more than one of the preceding. The length may be, e.g., about 150-200 nucleotides, e.g., about 150, 160, 170, 180, 190, or 200 nucleotides. The length may be, e.g., at least 150, 160, 170, 180, 190, or 200 nucleotides. In certain embodiments, the length is no greater than 150, 160, 170, 180, 190, or 200 nucleotides. In certain embodiments, a single stranded template nucleic acid has a length of about 160 nucleotides, e.g., about 155-165, 150-170, 140-180, 130-190, 120-200, 110-210, 100-220, 90-230, or 80-240 nucleotides.

In certain embodiments, the template nucleic acid is circular double stranded DNA, e.g., a plasmid. In certain embodiments, the template nucleic acid comprises about 500 to 1000 bp of homology on either side of the replacement sequence and/or the nick. In certain embodiments, the template nucleic acid comprises about 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In certain embodiments, the template nucleic acid comprises at least 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In certain embodiments, the template nucleic acid comprises no more than 300, 400, 500, 600, 700, 800, 900, 1000, 1500, or 2000 bp of homology 5' of the nick or replacement sequence, 3' of the nick or replacement sequence, or both 5' and 3' of the nick or replacement sequence.

In certain embodiments, one or both homology arms may be shortened to avoid including certain sequence repeat elements, e.g., Alu repeats, LINE elements. For example, a 5' homology arm may be shortened to avoid a sequence repeat element, while a 3' homology arm may be shortened to avoid a sequence repeat element. In certain embodiments, both the 5' and the 3' homology arms may be shortened to avoid including certain sequence repeat elements.

In certain embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In certain embodiments, the template nucleic acid comprises about 150 to 1000 nucleotides of homology on either side of the replacement sequence and/or the nick. In certain embodiments, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In certain embodiments, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In certain embodiments, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In certain embodiments, the template nucleic acid is a lentiviral vector, e.g., an DLV (integration deficiency lentivirus). In certain embodiments, the template nucleic acid comprises about 500 to 1000 bp of homology on either side of the replacement sequence and/or the nick. In certain embodiments, the template nucleic acid comprises about 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In certain embodiments, the template nucleic acid comprises at least 300, 400, 500, 600, 700, 800, 900, 1000, 1500, or 2000 bp of homology 5' of the nick or replacement sequence, 3' of the nick or replacement sequence, or both 5' and 3' of the nick or replacement sequence. In certain embodiments, the template nucleic acid comprises no more than 300, 400, 500, 600, 700, 800, 900, 1000, 1500, or 2000 bp of homology 5' of the nick or replacement sequence, 3' of the nick or replacement sequence, or both 5' and 3' of the nick or replacement sequence.

In certain embodiments, the template nucleic acid comprises one or more mutations, e.g., silent mutations, which prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In certain embodiments, the template nucleic acid comprises at most 2, 3, 4, 5, 10, 20, 30, or 50 silent mutations relative to the corresponding sequence in the genome of the cell to be altered. In certain embodiments, the cDNA comprises one or more mutations, e.g., silent mutations that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In certain embodiments, the template nucleic acid comprises at most 2, 3, 4, 5, 10, 20, 30, or 50 silent mutations relative to the corresponding sequence in the genome of the cell to be altered.

In certain embodiments, the 5' and 3' homology arms each comprise a length of sequence flanking the nucleotides corresponding to the replacement sequence. In certain embodiments, a template nucleic acid comprises a replacement sequence flanked by a 5' homology arm and a 3' homology arm each independently comprising 10 or more, 20 or more, 50 or more, 100 or more, 150 or more, 200 or more, 250 or more, 300 or more, 350 or more, 400 or more, 450 or more, 500 or more, 550 or more, 600 or more, 650 or more, 700 or more, 750 or more, 800 or more, 850 or more, 900 or more, 1000 or more, 1100 or more, 1200 or more, 1300 or more, 1400 or more, 1500 or more, 1600 or more, 1700 or more, 1800 or more, 1900 or more, or 2000 or more nucleotides. In certain embodiments, a template nucleic acid comprises a replacement sequence flanked by a 5' homology arm and a 3' homology arm each independently comprising at least 50, 100, or 150 nucleotides, but not long enough to include a repeated element. In certain embodiments, a template nucleic acid comprises a replacement sequence flanked by a 5' homology arm and a 3' homology arm each independently comprising 5 to 100, 10 to 150, or 20 to 150 nucleotides. In certain embodiments, the replacement sequence optionally comprises a promoter and/or polyA signal.

9.3 Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter a target nucleic acid sequence. Instead, the complementary repeat sequence is utilized.

9.4 Other DNA Repair Pathways 9.4.1 SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott 2008, and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are 'damaged.' End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, "gap filling" might continue displacing two or more nucleotides (displacement of up to 12 bases have been reported). FEN1 is an endonuclease that removes the displaced 5'-residues. Multiple DNA polymerases, including Polβ, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I. Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

9.4.2 MMR (Mismatch Repair)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch repair (MMR) operates on mispaired DNA bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutLa which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

9.4.3 Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the desired nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Polβ that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5' ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5' flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

9.4.4 Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

9.4.5 Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

9.4.6 Other Pathways

Several other DNA repair pathways exist in mammals.

Translesion synthesis (TLS) is a pathway for repairing a single stranded break left after a defective replication event and involves translesion polymerases, e.g., DNA polβ and Rev1.

Error-free postreplication repair (PRR) is another pathway for repairing a single stranded break left after a defective replication event.

9.5 Targeted Knockdown

Unlike CRISPR/Cas-mediated gene knockout, which permanently eliminates expression by mutating the gene (e.g., a RS1, RL2, or LAT gene) at the DNA level, CRISPR/Cas knockdown allows for temporary reduction of gene expression through the use of artificial transcription factors. Mutating key residues in both DNA cleavage domains of the Cas9 protein (e.g. the D10A and H840A mutations) results in the generation of a catalytically inactive Cas9 (eiCas9 which is also known as dead Cas9 or dCas9) molecule. A catalytically inactive Cas9 complexes with a gRNA and localizes to the DNA sequence specified by that gRNA's targeting domain, however, it does not cleave the target DNA. Fusion of the dCas9 to an effector domain, e.g., a transcription repression domain, enables recruitment of the effector to any DNA site specified by the gRNA. Although an enzymatically inactive (eiCas9) Cas9 molecule itself can block transcription when recruited to early regions in the coding sequence, more robust repression can be achieved by fusing a transcriptional repression domain (for example KRAB, SID or ERD) to the Cas9 and recruiting it to the target knockdown position, e.g., within 1000 bp of sequence 3' of the start codon or within 500 bp of a promoter region 5' of the start codon of a gene (e.g., a RL2, LAT, or RS1 gene). It is likely that targeting DNAseI hypersensitive sites (DHSs) of the promoter may yield more efficient gene repression or activation because these regions are more likely to be accessible to the Cas9 protein and are also more likely to harbor sites for endogenous transcription factors. Especially for gene repression, blocking the binding site of an endogenous transcription factor would aid in downregulating gene expression. In certain embodiments, one or more eiCas9 molecules may be used to block binding of one or more endogenous transcription factors. In certain embodiments, an eiCas9 molecule can be fused to a chromatin modifying protein. Altering chromatin status can result in decreased expression of the target gene. One or more eiCas9 molecules fused to one or more chromatin modifying proteins may be used to alter chromatin status.

In certain embodiments, a gRNA molecule can be targeted to a known transcription response elements (e.g., promoters, enhancers, etc.), a known upstream activating sequences (UAS), and/or sequences of unknown or known function that are suspected of being able to control expression of the target DNA.

CRISPR/Cas-mediated gene knockdown can be used to reduce expression of an unwanted allele or transcript. In certain embodiments, permanent destruction of the gene is not ideal. In these embodiments, site-specific repression may be used to temporarily reduce or eliminate expression. In certain embodiments, the off-target effects of a Cas-repressor may be less severe than those of a Cas-nuclease as a nuclease can cleave any DNA sequence and cause mutations whereas a Cas-repressor may only have an effect if it targets the promoter region of an actively transcribed gene. However, while nuclease-mediated knockout is permanent, repression may only persist as long as the Cas-repressor is present in the cells. Once the repressor is no longer present, it is likely that endogenous transcription factors and gene regulatory elements would restore expression to its natural state.

9.6 Examples of gRNAs in Genome Editing Methods gRNA molecules as described herein can be used with Cas9 molecules that generate a double strand break or a single strand break to alter the sequence of a target nucleic acid, e.g., a target position or target genetic signature. gRNA molecules useful in these methods are described below.

In certain embodiments, the gRNA, e.g., a chimeric gRNA, is configured such that it comprises one or more of the following properties;

(a) it can position, e.g., when targeting a Cas9 molecule that makes double strand breaks, a double strand break (i) within 50, 100, 150, 200, 250, 300, 350, 400, 450, or 500 nucleotides of a target position, or (ii) sufficiently close that the target position is within the region of end resection;

(b) it has a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and (c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. aureus*, or *N. meningitidis* tail and proximal domain, or a sequence that differs by no more than 1, 2, 3, 4, 5; 6, 7, 8, 9 or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. aureus*, or *N. meningitidis* gRNA, or a sequence that differs by no more than 1, 2, 3, 4, 5; 6, 7, 8, 9 or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. aureus*, or *N. meningitidis* gRNA, or a sequence that differs by no more than 1, 2, 3, 4, 5; 6, 7, 8, 9 or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. aureus*, or *N. meningitidis* tail domain, or a sequence that differs by no more than 1, 2, 3, 4, 5; 6, 7, 8, 9 or 10 nucleotides therefrom; or (c)(v) the tail domain comprises 15, 20, 25, 30, 35, 40 nucleotides or all of the corresponding portions of a naturally occurring tail domain, e.g., a naturally occurring *S. pyogenes, S. aureus*, or *N. meningitidis* tail domain.

In certain embodiments, the gRNA is configured such that it comprises properties: a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(ii), and c(i); a(i), b(ii), and c(ii); a(i), b(iii), and c(i); a(i), b(iii), and c(ii); a(i), b(iv), and c(i); a(i), b(iv), and c(ii); a(i), b(v), and c(i); a(i), b(v), and c(ii); a(i), b(vi), and c(i); a(i), b(vi), and c(ii); a(i), b(vii), and c(i); a(i), b(vii), and c(ii); a(i), b(viii), and c(i); a(i), b(viii), and c(ii); a(i), b(ix), and c(i); a(i), b(ix), and c(ii); a(i), b(x), and c(i); a(i), b(x), and c(ii); a(i), b(xi), or c(i); a(i), b(xi), and c(ii).

In certain embodiments, the gRNA, e.g., a chimeric gRNA, is configured such that it comprises one or more of the following properties:

(a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

(b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and (c)(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. aureus*, or *N. meningitidis* tail and proximal domain, or a sequence that differs by no more than 1, 2, 3, 4, 5, 6, 7, 8, 9 or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. aureus*, or *N. meningitidis* gRNA, or a sequence that differs by no more than 1, 2, 3, 4, 5; 6, 7, 8, 9 or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. aureus*, or *N. meningitidis* gRNA, or a sequence that differs by no more than 1, 2, 3, 4, 5; 6, 7, 8, 9 or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. aureus*, or *N. meningitidis* tail domain, or a sequence that differs by no more than 1, 2, 3, 4, 5; 6, 7, 8, 9 or 10 nucleotides therefrom; or (c)(v) the tail domain comprises 15, 20, 25, 30, 35, 40 nucleotides or all of the corresponding portions of a naturally occurring tail domain, e.g., a naturally occurring *S. pyogenes, S. aureus*, or *N. meningitidis* tail domain.

In certain embodiments, the gRNA is configured such that it comprises properties: a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(ii), and c(i); a(i), b(ii), and c(ii); a(i), b(iii), and c(i); a(i), b(iii), and c(ii); a(i), b(iv), and c(i); a(i), b(iv), and c(ii); a(i), b(v), and c(i); a(i), b(v), and c(ii); a(i), b(vi), and c(i); a(i), b(vi), and c(ii); a(i), b(vii), and c(i); a(i), b(vii), and c(ii); a(i), b(viii), and c(i); a(i), b(viii), and c(ii); a(i), b(ix), and c(i); a(i), b(ix), and c(ii); a(i), b(x), and c(i); a(i), b(x), and c(ii); a(i), b(xi), and c(i); a(i), b(xi), and c(ii).

In certain embodiments, the gRNA is used with a Cas9 nickase molecule having HNH activity, e.g., a Cas9 molecule having the RuvC activity inactivated, e.g., a Cas9 molecule having a mutation at D10, e.g., the D10A mutation. In certain embodiments, the gRNA is used with a Cas9 nickase molecule having RuvC activity, e.g., a Cas9 molecule having the HNH activity inactivated, e.g., a Cas9 molecule having a mutation at 840, e.g., the H840A. In certain embodiments, the gRNAs are used with a Cas9 nickase molecule having RuvC activity, e.g., a Cas9 molecule having the HNH activity inactivated, e.g., a Cas9 molecule having a mutation at N863, e.g., the N863A mutation. In certain embodiments, the gRNAs are used with a Cas9 nickase molecule having RuvC activity, e.g., a Cas9 molecule having the HNH activity inactivated, e.g., a Cas9 molecule having a mutation at N580, e.g., the N580A mutation.

In certain embodiments, a pair of gRNAs, e.g., a pair of chimeric gRNAs, comprising a first and a second gRNA, is configured such that they comprise one or more of the following properties;

(a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

(b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides;

(c) (i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. aureus*, or *N. meningitidis* tail and proximal domain, or a sequence that differs by no more than 1, 2, 3, 4, 5; 6, 7, 8, 9 or 10 nucleotides therefrom;

(c)(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. aureus*, or *N. meningitidis* gRNA, or a sequence that differs by no more than 1, 2, 3, 4, 5; 6, 7, 8, 9 or 10 nucleotides therefrom;

(c)(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. aureus*, or *N. meningitidis* gRNA, or a sequence that differs by no more than 1, 2, 3, 4, 5; 6, 7, 8, 9 or 10 nucleotides therefrom;

(c)(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. aureus*, or *N. meningitidis* tail domain; or, or a sequence that differs by no more than 1, 2, 3, 4, 5; 6, 7, 8, 9 or 10 nucleotides therefrom; or (c)(v) the tail domain comprises 15, 20, 25, 30, 35, 40 nucleotides or all of the corresponding portions of a naturally occurring tail domain, e.g., a naturally occurring *S. pyogenes, S. aureus*, or *N. meningitidis* tail domain;

(d) the gRNAs are configured such that, when hybridized to target nucleic acid, they are separated by 0-50, 0-100, 0-200, at least 10, at least 20, at least 30 or at least 50 nucleotides;

(e) the breaks made by the first gRNA and second gRNA are on different strands; and (f) the PAMs are facing outwards.

In certain embodiments, one or both of the gRNAs is configured such that it comprises properties: a and b(i); a and b(ii); a and b(iii); a and b(iv); a and b(v); a and b(vi); a and b(vii); a and b(viii); a and b(ix); a and b(x); a and b(xi); a and c; a, b, and c; a(i), b(i), and c(i); a(i), b(i), and c(ii); a(i), b(i), c, and d; a(i), b(i), c, and e; a(i), b(i), c, d, and e; a(i), b(ii), and c(i); a(i), b(ii), and c(ii); a(i), b(ii), c, and d; a(i), b(ii), c, and e; a(i), b(ii), c, d, and e; a(i), b(iii), and c(i); a(i), b(iii), and c(ii); a(i), b(iii), c, and d; a(i), b(iii), c, and e; a(i), b(iii), c, d, and e; a(i), b(iv), and c(i); a(i), b(iv), and c(ii); a(i), b(iv), c, and d; a(i), b(iv), c, and e; a(i), b(iv), c, d, and e; a(i), b(v), and c(i); a(i), b(v), and c(ii); a(i), b(v), c, and d; a(i), b(v), c, and e; a(i), b(v), c, d, and e; a(i), b(vi), and c(i); a(i), b(vi), and c(ii); a(i), b(vi), c, and d; a(i), b(vi), c, and e; a(i), b(vi), c, d, and e; a(i), b(vii), and c(i); a(i), b(vii), and c(ii); a(i), b(vii), c, and d; a(i), b(vii), c, and e; a(i), b(vii), c, d, and e; a(i), b(viii), and c(i); a(i), b(viii), and c(ii); a(i), b(viii), c, and d; a(i), b(viii), c, and e; a(i), b(viii), c, d, and e; a(i), b(ix), and c(i); a(i), b(ix), and c(ii); a(i), b(ix), c, and d; a(i), b(ix), c, and e; a(i), b(ix), c, d, and e; a(i), b(x), and c(i); a(i), b(x), and c(ii); a(i), b(x), c, and d; a(i), b(x), c, and e; a(i), b(x), c, d, and e; a(i), b(xi), and c(i); a(i), b(xi), and c(ii); a(i), b(xi), c, and d; a(i), b(xi), c, and e; a(i), b(xi), c, d, and e.

In certain embodiments, the gRNAs are used with a Cas9 nickase molecule having HNH activity, e.g., a Cas9 molecule having the RuvC activity inactivated, e.g., a Cas9 molecule having a mutation at D10, e.g., the D10A mutation. In certain embodiments, the gRNAs are used with a Cas9 nickase molecule having RuvC activity, e.g., a Cas9 molecule having the HNH activity inactivated, e.g., a Cas9 molecule having a mutation at H840, e.g., the H840A mutation. In certain embodiments, the gRNAs are used with a Cas9 nickase molecule having RuvC activity, e.g., a Cas9 molecule having the HNH activity inactivated, e.g., a Cas9 molecule having a mutation at N863, e.g., the N863A mutation. In certain embodiments, the gRNAs are used with a Cas9 nickase molecule having RuvC activity, e.g., a Cas9 molecule having the HNH activity inactivated, e.g., a Cas9 molecule having a mutation at N580, e.g., the N580A mutation.

10. Target Cells

Cas9 molecules (e.g., an eaCas9 molecule or an eiCas9 molecule) or Cas9 fusion protein and gRNA molecules, e.g., a Cas9 molecule/gRNA molecule complex, can be used to manipulate a cell, e.g., to edit a target nucleic acid, in a wide variety of cells.

In certain embodiments, a cell is manipulated by editing (e.g., introducing a mutation in) one or more target genes, e.g., an HSV-1 or HSV-2 genes, e.g., one, two, or three of RS1, RL2 and/or LAT genes. In certain embodiments, the cell is infected with HSV-1 and/or HSV-2. In certain embodiments, the cell is from a subject having an HSV-1 and/or HSV-2 infection. In certain embodiments, the cell or subject has a latent HSV-1 and/or HSV-2 infection. In certain embodiments, the expression of one or more target genes (e.g., one or more target genes described herein, e.g., one, two, or three of RS1, RL2 and/or LAT genes) is modulated, e.g., in vivo.

The Cas9 and gRNA molecules described herein can be delivered to a target cell, e.g., a cell described herein. In certain embodiments, the target cell is an epithelial cell, e.g., an epithelial cell of the oropharynx (including, e.g., an epithelial cell of the nose, gums, lips, tongue or pharynx), an epithelial cell of the finger or fingernail bed, or an epithelial cell of the ano-genital area (including, e.g., an epithelial cell of the penis, scrotum, vulva, vagina, cervix, anus or thighs). In certain embodiments, the target cell is a neuronal cell, e.g., a cranial ganglion neuron (e.g. a trigeminal ganglion neuron, e.g., an oculomotor nerve ganglion neuron, e.g., an abducens nerve ganglion neuron, e.g., a trochlear nerve ganglion neuron), e.g. a cervical ganglion neuron, e.g., a sacral ganglion neuron, a sensory ganglion neuron, a cortical neuron, a cerebellar neuron or a hippocampal neuron. In certain embodiments, the target cell is an optic cell, e.g. an epithelial cell of the eye, e.g. an epithelial cell of the eyelid, e.g., a conjunctival cell, e.g., a conjunctival epithelial cell, e.g., a corneal keratocyte, e.g., a limbus cell, e.g., a corneal epithelial cell, e.g., a corneal stromal cell, e.g., a ciliary body cell, e.g., a scleral cell, e.g., a lens cell, e.g., a choroidal cell, e.g., a retinal cell, e.g., a rod photoreceptor cell, e.g., a cone photoreceptor cell, e.g., a retinal pigment epithelium cell, e.g., a horizontal cell, e.g., an amacrine cell, e.g., a ganglion cell.

11. Delivery, Formulations and Routes of Administration

The components, e.g., a Cas9 molecule, one or more gRNA molecules (e.g., a Cas9 molecule/gRNA molecule complex), and a donor template nucleic acid, or all three, can be delivered, formulated, or administered in a variety of forms, see, e.g., Tables 14 and 15. In certain embodiments, the Cas9 molecule, one or more gRNA molecules (e.g., two gRNA molecules) are present together in a genome editing system. In certain embodiments, the sequence encoding the Cas9 molecule and the sequence(s) encoding the two or more (e.g., 2, 3, 4, or more) different gRNA molecules are present on the same nucleic acid molecule, e.g., an AAV vector. In certain embodiments, two sequences encoding the Cas9 molecules and the sequences encoding the two or more (e.g., 2, 3, 4, or more) different gRNA molecules are present on the same nucleic acid molecule, e.g., an AAV vector. When a Cas9 or gRNA component is encoded as DNA for delivery, the DNA can typically include a control region, e.g., comprising a promoter, to effect expression. Useful promoters for Cas9 molecule sequences include CMV, EFS, EF-1a, MSCV, PGK, and CAG, the Skeletal Alpha Actin promoter, the Muscle Creatine Kinase promoter, the Dystrophin promoter, the Alpha Myosin Heavy Chain promoter, and the Smooth Muscle Actin promoter. In certain embodiments, the promoter is a constitutive promoter. In certain embodiments, the promoter is a tissue specific promoter. Useful promoters for gRNAs include T7.H1, EF-1a, 7SK, U6, U1 and tRNA promoters. Promoters with similar or dissimilar strengths can be selected to tune the expression of components. Sequences encoding a Cas9 molecule can comprise a nuclear localization signal (NLS), e.g., an SV40 NLS. In certain embodiments, the sequence encoding a Cas9 molecule comprise at least two nuclear localization signals. In certain embodiments a promoter for a Cas9 molecule or a gRNA molecule can be, independently, inducible, tissue specific, or cell specific. Table 14 provides examples of how the components can be formulated, delivered, or administered.

TABLE 14

| | | Elements | |
|---|---|---|---|
| Cas9 Molecule(s) | gRNA Molecule(s) | Donor Template Nucleic Acid | Comments |
| DNA | DNA | DNA | In certain embodiments, a Cas9 molecule (e.g., an eaCas9 or eiCas9 molecule) and a gRNA are transcribed from DNA. In certain embodiments, they are encoded on separate molecules. In certain embodiments, the donor template is provided as a separate DNA molecule. |
| DNA | DNA | | In certain embodiments, a Cas9 molecule (e.g., an eaCas9 or eiCas9 molecule) and a gRNA are transcribed from DNA. In certain embodiments, they are encoded on separate molecules. In certain embodiments, the donor template is |

TABLE 14-continued

| Cas9 Molecule(s) | gRNA Molecule(s) | Donor Template Nucleic Acid | Comments |
|---|---|---|---|
| | DNA | DNA | provided on the same DNA molecule that encodes the gRNA. In certain embodiments, a Cas9 molecule (e.g., an eaCas9 or eiCas9 molecule) and a gRNA are transcribed from DNA, here from a single molecule. In certain embodiments, the donor template is provided as a separate DNA molecule. |
| DNA | | DNA | In certain embodiments, a Cas9 molecule (e.g., an eaCas9 or eiCas9 molecule), and a gRNA are transcribed from DNA. In certain embodiments, they are encoded on separate molecules. In certain embodiments, the donor template is provided on the same DNA molecule that encodes the Cas9. |
| DNA | RNA | DNA | In certain embodiments, a Cas9 molecule (e.g., an eaCas9 or eiCas9 molecule) is transcribed from DNA, and a gRNA is provided as in vitro transcribed or synthesized RNA. In certain embodiments, the donor template is provided as a separate DNA molecule. |
| DNA | | RNA | In certain embodiments, a Cas9 molecule (e.g., an eaCas9 or eiCas9 molecule) is transcribed from DNA, and a gRNA is provided as in vitro transcribed or synthesized RNA. In certain embodiments, the donor template is provided on the same DNA molecule that encodes the Cas9. |
| mRNA | RNA | DNA | In certain embodiments, a Cas9 molecule (e.g., an eaCas9 or eiCas9 molecule) is translated from in vitro transcribed mRNA, and a gRNA is provided as in vitro transcribed or synthesized RNA. In certain embodiments, the donor template is provided as a DNA molecule. |
| mRNA | DNA | DNA | In certain embodiments, a Cas9 molecule (e.g., an eaCas9 or eiCas9 molecule) is translated from in vitro transcribed mRNA, and a gRNA is transcribed from DNA. In certain embodiments, the donor template is provided as a separate DNA molecule. |
| mRNA | DNA | | In certain embodiments, a Cas9 molecule (e.g., an eaCas9 or eiCas9 molecule) is translated from in vitro transcribed mRNA, and a gRNA is transcribed from DNA. In certain embodiments, the donor template is provided on the same DNA molecule that encodes the gRNA. |
| Protein | DNA | DNA | In certain embodiments, a Cas9 molecule (e.g., an eaCas9 or eiCas9 molecule) is provided as a protein, and a gRNA is transcribed from DNA. In certain embodiments, the donor template is provided as a separate DNA molecule. |
| Protein | | DNA | In certain embodiments, a Cas9 molecule (e.g., an eaCas9 or eiCas9 molecule) is provided as a protein, and a gRNA is transcribed from DNA. In certain embodiments, the donor template is provided on the same DNA molecule that encodes the gRNA. |
| Protein | RNA | DNA | In certain embodiments (e.g., an eaCas9 or eiCas9 molecule) is provided as a protein, and a gRNA is provided as transcribed or synthesized RNA. This delivery method is referred to as "RNP delivery". In certain embodiments, the donor template is provided as a DNA molecule. |

Table 15 summarizes various delivery methods for the components of a Cas system, e.g., the Cas9 molecule component and the gRNA molecule component, as described herein.

TABLE 15

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |

TABLE 15-continued

| | Delivery Vector/Mode | Delivery into Non-Dividing Cells | Duration of Expression | Genome Integration | Type of Molecule Delivered |
|---|---|---|---|---|---|
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

11.1 DNA-Based Delivery of a Cas9 Molecule and or One or More gRNA Molecule

Nucleic acid compositions encoding Cas9 molecules (e.g., eaCas9 molecules or eiCas9 molecules), gRNA molecules, a donor template nucleic acid, or any combination (e.g., two or all) thereof can be administered to subjects or delivered into cells by art-known methods or as described herein. For example, Cas9-encoding and/or gRNA-encoding DNA, as well as donor template nucleic acids can be delivered, e.g., by vectors (e.g., viral or non-viral vectors), non-vector based methods (e.g., using naked DNA or DNA complexes), or a combination thereof.

Nucleic acid compositions encoding Cas9 molecules (e.g., eaCas9 molecules or eiCas9 molecules) and/or gRNA molecules can be conjugated to molecules (e.g., N-acetylgalactosamine) promoting uptake by the target cells (e.g., the target cells described herein). Donor template molecules can likewise be conjugated to molecules (e.g., N-acetylgalactosamine) promoting uptake by the target cells (e.g., the target cells described herein).

In certain embodiments, the Cas9- and/or gRNA-encoding DNA is delivered by a vector (e.g., viral vector/virus or plasmid).

Vectors can comprise a sequence that encodes a Cas9 molecule and/or a gRNA molecule, and/or a donor template with high homology to the region (e.g., target sequence) being targeted. In certain embodiments, the donor template comprises all or part of a target sequence. Exemplary donor templates are a repair template, e.g., a gene correction template, or a gene mutation template, e.g., point mutation (e.g., single nucleotide (nt) substitution) template). A vector can also comprise a sequence encoding a signal peptide (e.g., for nuclear localization, nucleolar localization, or mitochondrial localization), fused, e.g., to a Cas9 molecule sequence. For example, the vectors can comprise a nuclear localization sequence (e.g., from SV40) fused to the sequence encoding the Cas9 molecule.

One or more regulatory/control elements, e.g., promoters, enhancers, introns, polyadenylation signals, a Kozak consensus sequences, internal ribosome entry sites (IRES), a 2A sequence, and splice acceptor or donor can be included in the vectors. In certain embodiments, the promoter is recognized by RNA polymerase II (e.g., a CMV promoter). In other embodiments, the promoter is recognized by RNA polymerase III (e.g., a U6 promoter). In certain embodiments, the promoter is a regulated promoter (e.g., inducible promoter). In certain embodiments, the promoter is a constitutive promoter. In certain embodiments, the promoter is a tissue specific promoter. In certain embodiments, the promoter is a viral promoter. In certain embodiments, the promoter is a non-viral promoter.

In certain embodiments, the vector or delivery vehicle is a viral vector (e.g., for generation of recombinant viruses). In certain embodiments, the virus is a DNA virus (e.g., dsDNA or ssDNA virus). In certain embodiments, the virus is an RNA virus (e.g., an ssRNA virus). In certain embodiments, the virus infects dividing cells. In other embodiments, the virus infects non-dividing cells. Exemplary viral vectors/viruses include, e.g., retroviruses, lentiviruses, adenovirus, adeno-associated virus (AAV), vaccinia viruses, poxviruses, and herpes simplex viruses.

In certain embodiments, the virus infects dividing cells. In other embodiments, the virus infects non-dividing cells. In certain embodiments, the virus infects both dividing and non-dividing cells. In certain embodiments, the virus can integrate into the host genome. In certain embodiments, the virus is engineered to have reduced immunity, e.g., in human. In certain embodiments, the virus is replication-competent. In other embodiments, the virus is replication-defective, e.g., having one or more coding regions for the genes necessary for additional rounds of virion replication and/or packaging replaced with other genes or deleted. In certain embodiments, the virus causes transient expression of the Cas9 molecule or molecules and/or the gRNA molecule or molecules. In other embodiments, the virus causes long-lasting, e.g., at least 1 week, 2 weeks, 1 month, 2 months, 3 months, 6 months, 9 months, 1 year, 2 years, or permanent expression, of the Cas9 molecule or molecules and/or the gRNA molecule or molecules. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In certain embodiments, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

Exemplary viral vectors/viruses include, e.g., retroviruses, lentiviruses, adenovirus, adeno-associated virus (AAV), vaccinia viruses, poxviruses, and herpes simplex viruses.

In certain embodiments, the Cas9- and/or gRNA-encoding sequence is delivered by a recombinant retrovirus. In certain embodiments, the retrovirus (e.g., Moloney murine leukemia virus) comprises a reverse transcriptase, e.g., that allows integration into the host genome. In certain embodiments, the retrovirus is replication-competent. In other embodiments, the retrovirus is replication-defective, e.g., having one of more coding regions for the genes necessary for additional rounds of virion replication and packaging replaced with other genes, or deleted.

In certain embodiments, the Cas9- and/or gRNA-encoding nucleic acid sequence is delivered by a recombinant lentivirus. In certain embodiments, the donor template nucleic acid is delivered by a recombinant retrovirus. For example, the lentivirus is replication-defective, e.g., does not comprise one or more genes required for viral replication.

In certain embodiments, the Cas9- and/or gRNA-encoding nucleic acid sequence is delivered by a recombinant adenovirus. In certain embodiments, the donor template nucleic acid is delivered by a recombinant adenovirus. In certain embodiments, the adenovirus is engineered to have reduced immunity in human.

In certain embodiments, the Cas9- and/or gRNA-encoding nucleic acid sequence is delivered by a recombinant AAV. In certain embodiments, the donor template nucleic acid is delivered by a recombinant AAV. In certain embodiments, the AAV does not incorporate its genome into that of a host cell, e.g., a target cell as describe herein. In certain embodiments, the AAV can incorporate at least part of its genome into that of a host cell, e.g., a target cell as described herein. In certain embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh10, and pseudotyped AAV, such as AAV2/8, AAV2/5 and AAV2/6 can also be used in the disclosed methods. In certain embodiments, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In certain embodiments, the Cas9- and/or gRNA-encoding nucleic acid sequence is delivered in a re-engineered AAV capsid, e.g., with about 50% or greater, e.g., about 60% or greater, about 70% or greater, about 80% or greater, about 90% or greater, or about 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In certain embodiments, the Cas9- and/or gRNA-encoding nucleic acid sequence is delivered by a chimeric AAV capsid. In certain embodiments, the donor template nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9.

In certain embodiments, the AAV is a self-complementary adeno-associated virus (scAAV), e.g., a scAAV that packages both strands which anneal together to form double stranded DNA.

In certain embodiments, the Cas9- and/or gRNA-encoding DNA is delivered by a hybrid virus, e.g., a hybrid of one or more of the viruses described herein. In certain embodiments, the hybrid virus is hybrid of an AAV (e.g., of any AAV serotype), with a Bocavirus, B19 virus, porcine AAV, goose AAV, feline AAV, canine AAV, or MVM.

A packaging cell is used to form a virus particle that is capable of infecting a target cell. Exemplary packaging cells include 293 cells, which can package adenovirus, and ψ2 or PA317 cells, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed, e.g., components for a Cas9 molecule, e.g., two Cas9 components. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In certain embodiments, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In certain embodiments, the viral vector is capable of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as peptide ligands, single chain antibodies, growth factors); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In certain embodiments, the viral vector achieves cell type specific expression. For example, a tissue-specific promoter can be constructed to restrict expression of the transgene (Cas9 and gRNA) to only the target cell. The specificity of the vector can also be mediated by microRNA-dependent control of transgene expression. In certain embodiments, the viral vector has increased efficiency of fusion of the viral vector and a target cell membrane. For example, a fusion protein such as fusion-competent hemagglutin (HA) can be incorporated to increase viral uptake into cells. In certain embodiments, the viral vector has the ability of nuclear localization. For example, a virus that requires the breakdown of the nuclear envelope (during cell division) and therefore can not infect a non-diving cell can be altered to incorporate a nuclear localization peptide in the matrix protein of the virus thereby enabling the transduction of non-proliferating cells.

In certain embodiments, the Cas9- and/or gRNA-encoding nucleic acid sequence is delivered by a non-vector based method (e.g., using naked DNA or DNA complexes). For example, the DNA can be delivered, e.g., by organically modified silica or silicate (Ormosil), electroporation, transient cell compression or squeezing (e.g., as described in Lee, et al, 2012, Nano Lett 12: 6322-27), gene gun, sonoporation, magnetofection, lipid-mediated transfection, dendrimers, inorganic nanoparticles, calcium phosphates, or a combination thereof.

In certain embodiments, delivery via electroporation comprises mixing the cells with the Cas9- and/or gRNA-encoding DNA in a cartridge, chamber or cuvette and applying one or more electrical impulses of defined duration and amplitude. In certain embodiments, delivery via electroporation is performed using a system in which cells are mixed with the Cas9- and/or gRNA-encoding DNA in a vessel connected to a device (e.g., a pump) which feeds the mixture into a cartridge, chamber or cuvette wherein one or more electrical impulses of defined duration and amplitude are applied, after which the cells are delivered to a second vessel.

In certain embodiments, the Cas9- and/or gRNA-encoding nucleic acid sequence is delivered by a combination of a vector and a non-vector based method. In certain embodiments, the donor template nucleic acid is delivered by a combination of a vector and a non-vector based method. For example, virosomes combine liposomes combined with an inactivated virus (e.g., HIV or influenza virus), which can result in more efficient gene transfer, e.g., in respiratory epithelial cells than either viral or liposomal methods alone.

In certain embodiments, the delivery vehicle is a non-viral vector. In certain embodiments, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In certain embodiments, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 16.

TABLE 16

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |

TABLE 16-continued

Lipids Used for Gene Transfer

| Lipid | Abbreviation | Feature |
|---|---|---|
| Cholesterol | | Helper |
| N-[1-(2,3-Dioleyloxy)propyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysylaspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 17.

TABLE 17

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |

TABLE 17-continued

Polymers Used for Gene Transfer

| Polymer | Abbreviation |
| --- | --- |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In certain embodiments, the vehicle has targeting modifications to increase target cell update of nanoparticles and liposomes, e.g., cell specific antigens, monoclonal antibodies, single chain antibodies, aptamers, polymers, sugars (e.g., N-acetylgalactosamine (GalNAc)), and cell penetrating peptides. In certain embodiments, the vehicle uses fusogenic and endosome-destabilizing peptides/polymers. In certain embodiments, the vehicle undergoes acid-triggered conformational changes (e.g., to accelerate endosomal escape of the cargo). In certain embodiments, a stimuli-cleavable polymer is used, e.g., for release in a cellular compartment. For example, disulfide-based cationic polymers that are cleaved in the reducing cellular environment can be used.

In certain embodiments, the delivery vehicle is a biological non-viral delivery vehicle. In certain embodiments, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In certain embodiments, the vehicle is a genetically modified bacteriophage (e.g., engineered phages having large packaging capacity, less immunogenic, containing mammalian plasmid maintenance sequences and having incorporated targeting ligands). In certain embodiments, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In certain embodiments, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes-subject (i.e., patient) derived membrane-bound nanovesicle (30-100 nm) of endocytic origin (e.g., can be produced from various cell types and can therefore be taken up by cells without the need of for targeting ligands).

In certain embodiments, one or more nucleic acid molecules (e.g., DNA molecules) other than the components of a Cas system, e.g., the Cas9 molecule component or components and/or the gRNA molecule component or components described herein, are delivered. In certain embodiments, the nucleic acid molecule is delivered at the same time as one or more of the components of the Cas system are delivered. In certain embodiments, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In certain embodiments, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component or components and/or the gRNA molecule component or components can be delivered by electroporation, e.g., such that the toxicity caused by nucleic acids (e.g., DNAs) can be reduced. In certain embodiments, the nucleic acid molecule encodes a therapeutic protein, e.g., a protein described herein. In certain embodiments, the nucleic acid molecule encodes an RNA molecule, e.g., an RNA molecule described herein.

11.2 Delivery of a RNA Encoding a Cas9 Molecule

RNA encoding Cas9 molecules (e.g., eaCas9 molecules or eiCas9 molecules) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, transient cell compression or squeezing (e.g., as described in Lee, et al., 2012, Nano Lett 12: 6322-27), lipid-mediated transfection, peptide-mediated delivery, or a combination thereof. Cas9-encoding and/or gRNA-encoding RNA can be conjugated to molecules to promote uptake by the target cells (e.g., target cells described herein).

In certain embodiments, delivery via electroporation comprises mixing the cells with the RNA encoding Cas9 molecules (e.g., eaCas9 molecules, eiCas9 molecules or eiCas9 fusion proteins) and/or gRNA molecules with or without donor template nucleic acid molecules, in a cartridge, chamber or cuvette and applying one or more electrical impulses of defined duration and amplitude. In certain embodiments, delivery via electroporation is performed using a system in which cells are mixed with the RNA encoding Cas9 molecules (e.g., eaCas9 molecules, eiCas9 molecules or eiCas9 fusion proteins) and/or gRNA molecules with or without donor template nucleic acid molecules, in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

11.3 Delivery of a Cas9 Molecule Protein

Cas9 molecules (e.g., eaCas9 molecules or eiCas9 molecules) can be delivered into cells by art-known methods or as described herein. For example, Cas9 protein molecules can be delivered, e.g., by microinjection, electroporation, transient cell compression or squeezing (e.g., as described in Lee, et al, 2012, Nano Lett 12: 6322-27), lipid-mediated transfection, peptide-mediated delivery, or a combination thereof. Delivery can be accompanied by DNA encoding a gRNA or by a gRNA. Cas9 protein can be conjugated to molecules promoting uptake by the target cells (e.g., target cells described herein).

In certain embodiments, delivery via electroporation comprises mixing the cells with the Cas9 molecules (e.g., eaCas9 molecules, eiCas9 molecules or eiCas9 fusion proteins) and/or gRNA molecules with or without donor nucleic acid, in a cartridge, chamber or cuvette and applying one or more electrical impulses of defined duration and amplitude. In certain embodiments, delivery via electroporation is performed using a system in which cells are mixed with the Cas9 molecules (e.g., eaCas9 molecules, eiCas9 molecules or eiCas9 fusion proteins) and/or gRNA molecules in a vessel connected to a device (e.g., a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

11. 4 RNP Delivery of Cas9 Molecule Protein and gRNA

In certain embodiments, the Cas9 molecule and gRNA molecule are delivered to target cells via Ribonucleoprotein (RNP) delivery. In certain embodiments, the Cas9 molecule is provided as a protein, and the gRNA molecule is provided as transcribed or synthesized RNA. The gRNA molecule can be generated by chemical synthesis. In certain embodiments, the gRNA molecule forms a RNP complex with the Cas9 molecule protein under suitable condition prior to delivery to the target cells. The RNP complex can be delivered to the target cells by any suitable methods known in the art, e.g., by electroporation, lipid-mediated transfection, protein or DNA-based shuttle, mechanical force, or hydraulic force. In certain embodiments, the RNP complex is delivered to the target cells by electroporation.

11.5 Route of Administration

Systemic modes of administration include oral and parenteral routes. Parenteral routes include, by way of example, intravenous, intrarterial, intraosseous, intramuscular, intradermal, subcutaneous, intranasal and intraperitoneal routes. Components administered systemically may be modified or formulated to target the components to epithelial or neuronal cells.

Local modes of administration include, by way of example, intrathecal, intraspinal, intra-cerebroventricular, and intraparenchymal (e.g., into the parenchyma of the brain or spinal cord).

In certain embodiments, local modes of administration include intra-parenchymal into the dorsal root ganglion at the level of the trigeminal nerve. In certain embodiments, local modes of administration include intra-parenchymal into the dorsal root ganglion at the level of the sacral ganglia. In certain embodiments, local modes of administration include intra-parenchymal into the dorsal root ganglion at the level of the lumbar ganglia. In certain embodiments, local modes of administration include intra-parenchymal into the dorsal root ganglion at the level of the thoracic ganglia. In certain embodiments, local modes of administration include intra-parenchymal into the dorsal root ganglion at the level of the cervical ganglia, e.g., superior cervical ganglion, e.g., middle cervical ganglion, e.g., inferior cervical ganglion. In certain embodiments, local modes of administration include intra-parenchymal into the dorsal root ganglion at the level of the cranial nerve ganglia, e.g. cranial nerve ganglia I-XII.

In certain embodiments, significantly smaller amounts of the components (compared with systemic approaches) may exert an effect when administered locally compared to when administered systemically (for example, intravenously). Local modes of administration can reduce or eliminate the incidence of potentially toxic side effects that may occur when therapeutically effective amounts of a component are administered systemically.

In certain embodiments, components described herein are delivered to epithelial cells, e.g., epithelial cells of the oropharynx (including, e.g., epithelial cells of the nose, gums, lips, tongue or pharynx), epithelial cells of the finger or fingernail bed, or epithelial cells of the ano-genital area (including, e.g., epithelial cells of the penis, vulva, vagina or anus). In certain embodiments, components described herein are delivered to the eye (including, e.g., corneal epithelium, e.g., corneal stroma, e.g., epithelium of upper and lower eyelid, e.g., lens).

Administration may be provided as a periodic bolus or as continuous infusion from an internal reservoir or from an external reservoir (for example, from an intravenous bag). Components may be administered locally, for example, by continuous release from a sustained release drug delivery device.

Administration may be provided as continuous infusion from an internal reservoir (for example, from an implant disposed at an intra- or extra-ocular location (see, U.S. Pat. Nos. 5,443,505 and 5,766,242)) or from an external reservoir (for example, from an intravenous bag). Components may be administered locally, for example, by continuous release from a sustained release drug delivery device immobilized to an inner wall of the eye or via targeted transscleral controlled release into the choroid (see, for example, PCT/US00/00207, PCT/US02/14279, Ambati et al. (2000) Invest. Ophthalmol. Vis. Sci. 41:1181-1185, and Ambati et al. (2000) Invest. Ophthalmol. Vis. Sci. 41:1186-1191). A variety of devices suitable for administering components locally to the inside of the eye are known in the art. See, for example, U.S. Pat. Nos. 6,251,090, 6,299,895, 6,416,777, 6,413,540, and PCT/US00/28187.

In certain embodiments, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly (caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for injection. Typically the microspheres are composed of a polymer of lactic acid and glycolic acid, which are structured to form hollow spheres. The spheres can be approximately 15-30 microns in diameter and can be loaded with components described herein.

11.6 Bi-Modal or Differential Delivery of Components

Separate delivery of the components of a Cas system, e.g., the Cas9 molecule or Cas9-fusion protein component and the gRNA molecule component, and more particularly, delivery of the components by differing modes, can enhance performance, e.g., by improving tissue specificity and safety. In certain embodiments, the Cas9 molecule is a Cas9 variant. For example, and not by way of limitation, the Cas9 variant can be a S. pyogenes Cas9 variant or a S. aureus Cas9 variant. In certain embodiments, the S. pyogenes Cas9 variant is the EQR variant. In certain embodiments, the S. pyogenes Cas9 variant is the VRER variant.

In certain embodiments, the Cas9 molecule (e.g., eaCas9 or eiCas9 molecule) or Cas9-fusion protein and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, or gRNA molecule. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In certain embodiments, a gRNA molecule can be delivered by such modes. The Cas9 molecule component can be delivered by a mode which results in less persistence or less exposure to the body or a particular compartment or tissue or organ.

More generally, in certain embodiments, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In certain embodiments, the first pharmacodynamic or pharmacokinetic property, e.g., distribution, persistence or exposure, is more limited than the second pharmacodynamic or pharmacokinetic property.

In certain embodiments, the first mode of delivery is selected to optimize, e.g., minimize, a pharmacodynamic or pharmacokinetic property, e.g., distribution, persistence or exposure.

In certain embodiments, the second mode of delivery is selected to optimize, e.g., maximize, a pharmacodynamic or pharmcokinetic property, e.g., distribution, persistence or exposure.

In certain embodiments, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In certain embodiments, the second mode of delivery comprises a relatively transient element, e.g., an RNA or protein.

In certain embodiments, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule (e.g., an eaCas9 molecule or an eiCas9 molecule), is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules (e.g., eaCas9 or eiCas9 molecules) or Cas9-fusion proteins, by less persistent modes can reduce immunogenicity, as peptides from the bacterially-derived Cas enzyme are displayed on the surface of the cell by MEW molecules. A two-part delivery system can alleviate these drawbacks.

Differential delivery modes can be used to deliver components to different, but overlapping target regions. The formation active complex is minimized outside the overlap of the target regions. Thus, in certain embodiments, a first component, e.g., a gRNA molecule is delivered by a first delivery mode that results in a first spatial, e.g., tissue, distribution. A second component, e.g., a Cas9 molecule (e.g., an eaCas9 molecule or an eiCas9 molecule) is delivered by a second delivery mode that results in a second spatial, e.g., tissue, distribution. In certain embodiments, the first mode comprises a first element selected from a liposome, nanoparticle, e.g., polymeric nanoparticle, and a nucleic acid, e.g., viral vector. The second mode comprises a second element selected from the group. In certain embodiments, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule (e.g., eaCas9 molecule or eiCas9 molecule) is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

11. 7 Ex Vivo Delivery

In certain embodiments, each component of the genome editing system described in Table 14 are introduced into a cell which is then introduced into the subject, e.g., cells are removed from a subject, manipulated ex vivo and then introduced into the subject. Methods of introducing the components can include, e.g., any of the delivery methods described in Table 15.

12. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In certain embodiments, every base of a gRNA is modified, e.g., all bases have a modified phosphate group, e.g., all are phosphorothioate groups. In certain embodiments, all, or substantially all, of the phosphate groups of a unimolecular or modular gRNA molecule are replaced with phosphorothioate groups.

In certain embodiments, modified nucleotides, e.g., nucleotides having modifications as described herein, can be incorporated into a nucleic acid, e.g., a "modified nucleic acid." In certain embodiments, the modified nucleic acids comprise one, two, three or more modified nucleotides. In certain embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in certain embodiments, the modified nucleic acids described herein can contain one or more modified nucleosides or nucleotides, e.g., to introduce stability toward nucleases.

In certain embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In certain embodiments, the modified nucleosides, modified nucleotides, and modified nucleic acids described herein can disrupt binding of a major groove interacting partner with the nucleic acid. In certain embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

12.1 Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In certain embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

12.2 Phosphate Backbone Modifications 12.2.1 the Phosphate Group

In certain embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In certain embodiments, the modification of the phosphate backbone can include alterations that result in either an uncharged linker or a charged linker with unsymmetrical charge distribution.

Examples of modified phosphate groups include phosphorothioate, phosphoroselenates, borano phosphates, borano phosphate esters, hydrogen phosphonates, phosphoroamidates, alkyl or aryl phosphonates and phosphotriesters. In certain embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In certain embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

12.2.2 Replacement of the Phosphate Group

The phosphate group can be replaced by non-phosphorus containing connectors. In certain embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methyl enedimethylhydrazo and methyleneoxymethylimino.

12.2.3 Replacement of the Ribophosphate Backbone

Scaffolds that can mimic nucleic acids can also be constructed wherein the phosphate linker and ribose sugar are replaced by nuclease resistant nucleoside or nucleotide surrogates. In certain embodiments, the nucleobases can be tethered by a surrogate backbone. Examples can include, without limitation, the morpholino, cyclobutyl, pyrrolidine and peptide nucleic acid (PNA) nucleoside surrogates.

12.3 Sugar Modifications

The modified nucleosides and modified nucleotides can include one or more modifications to the sugar group. For example, the 2' hydroxyl group (OH) can be modified or replaced with a number of different "oxy" or "deoxy" substituents. In certain embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In certain embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In certain embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In certain embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

12.4 Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In certain embodiments, the nucleobase can include, for example, naturally-occurring and synthetic derivatives of a base.

12.4.1 Uracil

In certain embodiments, the modified nucleobase is a modified uracil. Exemplary nucleobases and nucleosides having a modified uracil include without limitation pseudouridine (w), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s2U), 5-propynyl-uridine, 1-propynyl-pseudouridine, 5-taurinomethyl-uridine (τcm$^5$U), 1-taurinomethyl-pseudouridine, 5-taurinomethyl-2-thio-uridine(τm$^5$s2U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s2U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp$^3$U), 1-methyl-3-(3-amino-3-carboxypropyl) pseudouridine (acp$^3$ψ), 5-(isopentenylaminomethyl)uridine (inm$^5$U), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), 5-(isopentenylaminomethyl)-2'-O-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

12.4.2 Cytosine

In certain embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), α-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), 5-formyl-2'-O-methyl-cytidine (f$^5$Cm), N4,N4,2'-O-trimethyl-cytidine (m$^4_2$Cm), 1-thio-cytidine, 2'-F-ara-cytidine, 2'-F-cytidine, and 2'-OH-ara-cytidine.

12.4.3 Adenine

In certain embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m$^1$A), 2-methyl-adenosine (m$^2$A), N6-methyl-adenosine (m$^6$A), 2-methylthio-N6-methyl-adenosine (ms$^2$m$^6$A), N6-isopentenyl-adenosine (i$^6$A), 2-methylthio-N6-isopentenyl-adenosine (ms$^2$i$^6$A), N6-(cis-hydroxyisopentenyl)adenosine (io$^6$A), 2-methyl-thio-N6-(cis-hydroxyisopentenyl)adenosine (ms2io$^6$A), N6-glycinylcarbamoyl-adenosine (g$^6$A), N6-threonylcarbamoyl-adenosine (t$^6$A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenosine, 2-methylthio-adenosine, 2-methoxy-adenosine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

12.4.4 Guanine

In certain embodiments, the modified nucleobase is a modified guanine. Exemplary nucleobases and nucleosides having a modified guanine include without limitation inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2, N2,7-dimethyl-guanosine (m²,2,7G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, O⁶-methyl-guanosine, O⁶-Methyl-2'-deoxyguanosine, 2'-F-ara-guanosine, and 2'-F-guanosine.

12.5 Exemplary Modified gRNAs

In certain embodiments, the modified nucleic acids can be modified gRNAs. It is to be understood that any of the gRNAs described herein can be modified in accordance with this section, including any gRNA that comprises a targeting domain comprising a nucleotide sequence selected from SEQ ID NOS: 208 to 58749.

As discussed above, transiently expressed or delivered nucleic acids can be prone to degradation by, e.g., cellular nucleases. Accordingly, in one aspect the modified gRNA molecules described herein can contain one or more modified nucleosides or nucleotides which introduce stability toward nucleases. In certain embodiments, certain modified gRNA molecules described herein can exhibit a reduced innate immune response when introduced into a population of cells, particularly the cells disclosed herein. As noted above, the term "innate immune response" includes a cellular response to exogenous nucleic acids, including single stranded nucleic acids, generally of viral or bacterial origin, which involves the induction of cytokine expression and release, particularly the interferons, and cell death.

While some of the exemplary modification discussed in this section may be included at any position within the gRNA sequence, in certain embodiments, a gRNA molecule comprises a modification at or near its 5' end (e.g., within 1-10, 1-5, or 1-2 nucleotides of its 5' end). In certain embodiments, a gRNA comprises a modification at or near its 3' end (e.g., within 1-10, 1-5, or 1-2 nucleotides of its 3' end). In certain embodiments, a gRNA molecule comprises both a modification at or near its 5' end and a modification at or near its 3' end.

In certain embodiments, the 5' end of the gRNA molecule lacks a 5' triphosphate group. In certain embodiments, the 5' end of the targeting domain lacks a 5' triphosphate group. In certain embodiments, the 5' end of the gRNA molecule includes a 5' cap. In certain embodiments, the 5' end of the targeting domain includes a 5' cap. In certain embodiments, the gRNA molecule lacks a 5' triphosphate group. In certain embodiments, the gRNA molecule comprises a targeting domain and the 5' end of the targeting domain lacks a 5' triphosphate group. In certain embodiments, gRNA molecule includes a 5' cap. In certain embodiments, the gRNA molecule comprises a targeting domain and the 5' end of the targeting domain includes a 5' cap.

In certain embodiments, the 5' end of a gRNA is modified by the inclusion of a eukaryotic mRNA cap structure or cap analog (e.g., without limitation, a G(5)ppp(5)G cap analog, a m7G(5)ppp(5)G cap analog, or a 3'-O-Me-m7G(5)ppp(5)G anti reverse cap analog (ARCA)). In certain embodiments, the 5' cap comprises a modified guanine nucleotide that is linked to the remainder of the gRNA molecule via a 5'-5' triphosphate linkage. In certain embodiments, the 5' cap analog comprises two optionally modified guanine nucleotides that are linked via a 5'-5' triphosphate linkage. In certain embodiments, the 5' end of the gRNA molecule has the chemical formula:

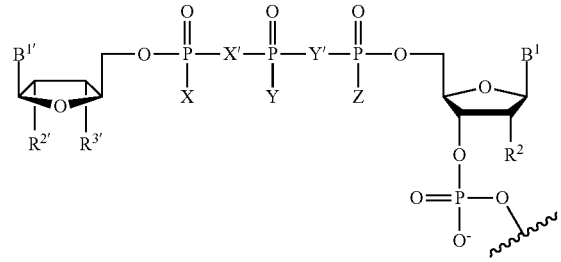

wherein:
each of $R^1$ and $B^{1'}$ is independently

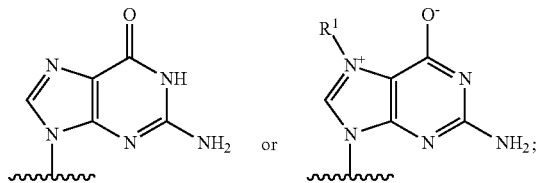

each $R^1$ is independently $C_{1-4}$ alkyl, optionally substituted by a phenyl or a 6-membered heteroaryl;
each of $R^2$, $R^{2'}$, and $R^{3'}$ is independently H, F, OH, or $O-C_{1-4}$ alkyl;
each of X, Y, and Z is independently O or S; and
each of X' and Y' is independently O or $CH_2$.

In certain embodiments, each $R^1$ is independently $-CH_3$, $-CH_2CH_3$, or $-CH_2C_6H_5$.

In certain embodiments, R¹ is —CH₃.
In certain embodiments, B¹' is

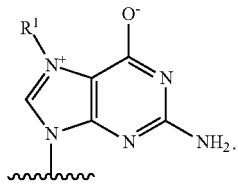

In certain embodiments, each of R², R²', and R³' is independently H, OH, or O—CH₃.

In certain embodiments, each of X, Y, and Z is O.

In certain embodiments, X' and Y' are O.

In certain embodiments, the 5' end of the gRNA molecule has the chemical formula:

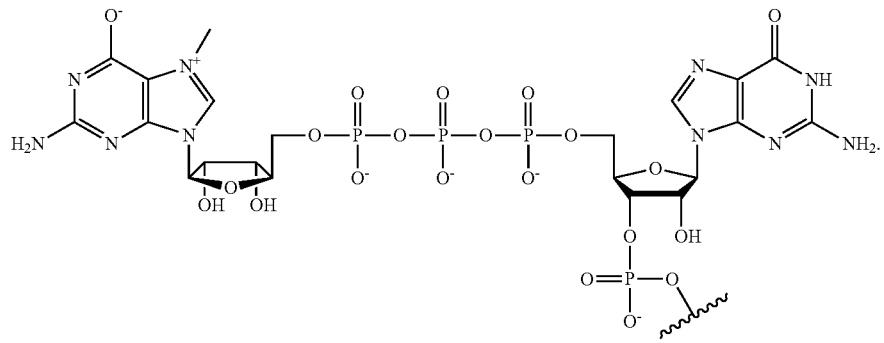

In certain embodiments, the 5' end of the gRNA molecule has the chemical formula:

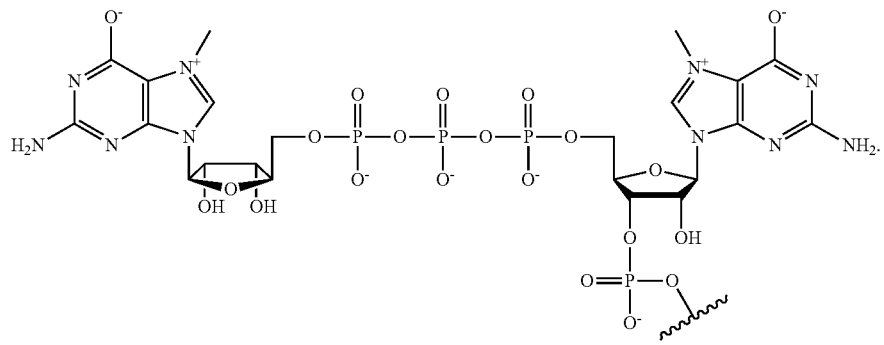

In certain embodiments, the 5' end of the gRNA molecule has the chemical formula:

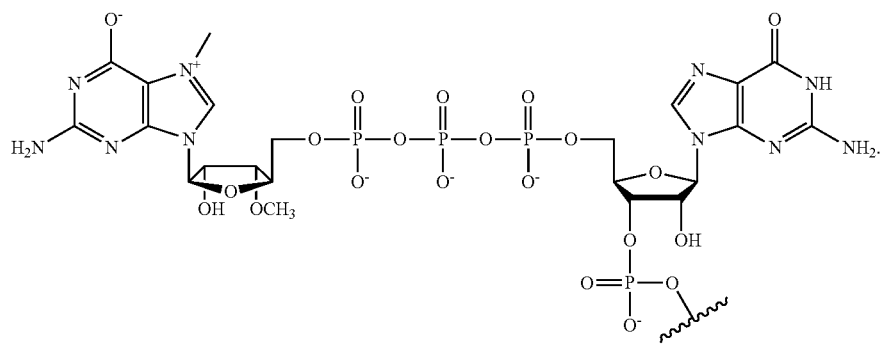

In certain embodiments, the 5' end of the gRNA molecule has the chemical formula:

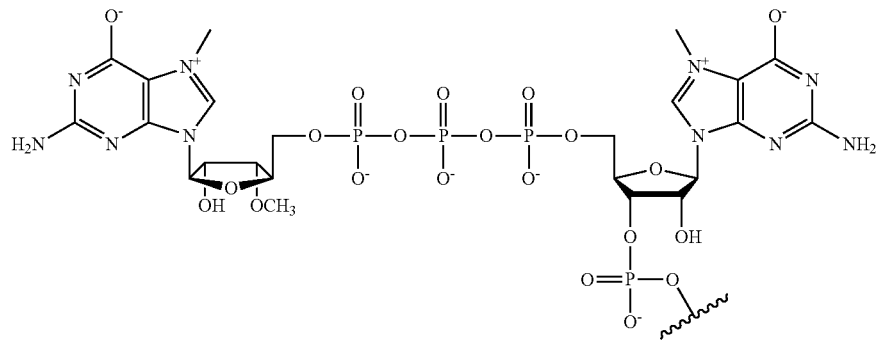

In certain embodiments, X is S, and Y and Z are O.
In certain embodiments, Y is S, and X and Z are O.
In certain embodiments, Z is S, and X and Y are O.
In certain embodiments, the phosphorothioate is the Sp diastereomer.
In certain embodiments, X' is CH$_2$, and Y' is O.
In certain embodiments, X' is O, and Y' is CH$_2$.
In certain embodiments, the 5' cap comprises two optionally modified guanine nucleotides that are linked via an optionally modified 5'-5' tetraphosphate linkage.
In certain embodiments, the 5' end of the gRNA molecule has the chemical formula:

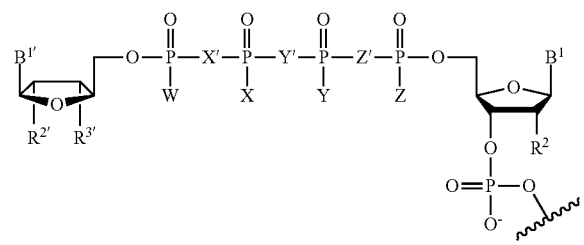

wherein:
each of R$^1$ and B$^{1'}$ is independently

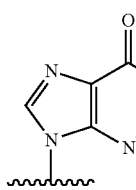 or 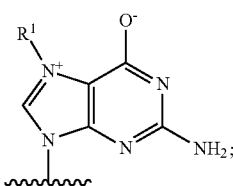

each R$^1$ is independently C$_{1-4}$ alkyl, optionally substituted by a phenyl or a 6-membered heteroaryl;
each of R$^2$, R$^{2'}$, and R$^{3'}$ is independently H, F, OH, or O—C$_{1-4}$ alkyl;
each of W, X, Y, and Z is independently O or S; and
each of X', Y', and Z' is independently O or CH$_2$.
In certain embodiments, each R$^1$ is independently —CH$_3$, —CH$_2$CH$_3$, or —CH$_2$C$_6$H$_5$.
In certain embodiments, R$^1$ is —CH$_3$.

In certain embodiments, B$^{1'}$ is

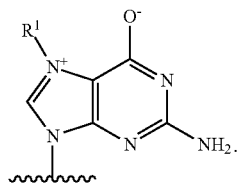

In certain embodiments, each of R$^2$, R$^{2'}$, and R$^{3'}$ is independently H, OH, or O—CH$_3$.
In certain embodiments, each of W, X, Y, and Z is O.
In certain embodiments, each of X', Y', and Z' are O.
In certain embodiments, X' is CH$_2$, and Y' and Z' are O.
In certain embodiments, Y' is CH$_2$, and X' and Z' are O.
In certain embodiments, Z' is CH$_2$, and X' and Y' are O.
In certain embodiments, the 5' cap comprises two optionally modified guanine nucleotides that are linked via an optionally modified 5'-5' pentaphosphate linkage.
In certain embodiments, the 5' end of the gRNA molecule has the chemical formula:

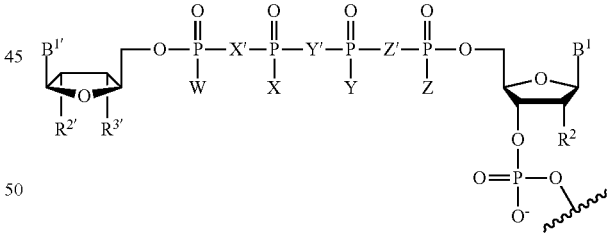

wherein:
each of B$^1$ and B$^{1'}$ is independently

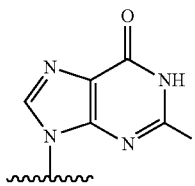 or 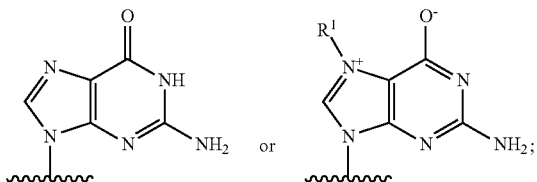

each R$^1$ is independently C$_{1-4}$ alkyl, optionally substituted by a phenyl or a 6-membered heteroaryl;

each of $R^2$, $R^{2'}$, and $R^{3'}$ is independently H, F, OH, or O—$C_{1-4}$ alkyl;

each of V, W, X, Y, and Z is independently O or S; and each of W', X', Y', and Z' is independently O or $CH_2$.

In certain embodiments, each $R^1$ is independently —$CH_3$, —$CH_2CH_3$, or —$CH_2C_6H_5$.

In certain embodiments, $R^1$ is —$CH_3$.

In certain embodiments, $B^{1'}$ is

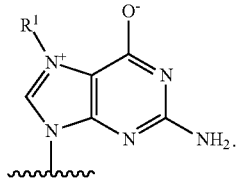

In certain embodiments, each of $R^2$, $R^{2'}$, and $R^{3'}$ is independently H, OH, or O—$CH_3$.

In certain embodiments, each of V, W, X, Y, and Z is O.

In certain embodiments, each of W', X', Y', and Z' is O.

As used herein, the term "5' cap" encompasses traditional mRNA 5' cap structures but also analogs of these. For example, in addition to the 5' cap structures that are encompassed by the chemical structures shown above, one may use, e.g., tetraphosphate analogs having a methylene-bis (phosphonate) moiety (e.g., see Rydzik, A M et al., (2009) Org Biomol Chem 7(22):4763-76), analogs having a sulfur substitution for a non-bridging oxygen (e.g., see Grudzien-Nogalska, E. et al, (2007) RNA 13(10): 1745-1755), N7-benzylated dinucleoside tetraphosphate analogs (e.g., see Grudzien, E. et al., (2004) RNA 10(9): 1479-1487), or anti-reverse cap analogs (e.g., see U.S. Pat. No. 7,074,596 and Jemielity, J. et al., (2003) RNA 9(9): 1 108-1 122 and Stepinski, J. et al., (2001) RNA 7(10):1486-1495). The present application also encompasses the use of cap analogs with halogen groups instead of OH or OMe (e.g., see U.S. Pat. No. 8,304,529); cap analogs with at least one phosphorothioate (PS) linkage (e.g., see U.S. Pat. No. 8,153,773 and Kowalska, J. et al., (2008) RNA 14(6): 1 1 19-1131); and cap analogs with at least one boranophosphate or phosphoroselenoate linkage (e.g., see U.S. Pat. No. 8,519,110); and alkynyl-derivatized 5' cap analogs (e.g., see U.S. Pat. No. 8,969,545).

In general, the 5' cap can be included during either chemical synthesis or in vitro transcription of the gRNA. In certain embodiments, a 5' cap is not used and the gRNA (e.g., an in vitro transcribed gRNA) is instead modified by treatment with a phosphatase (e.g., calf intestinal alkaline phosphatase) to remove the 5' triphosphate group.

The presently disclosed subject matter also provides for methods, genome editing system and compositions for gene editing by using gRNAs which comprise a 3' polyA tail (also called a polyA tract herein). Such gRNAs may, for example, be prepared by adding a polyA tail to a gRNA molecule precursor using a polyadenosine polymerase following in vitro transcription of the gRNA molecule precursor. For example, in certain embodiments, a polyA tail may be added enzymatically using a polymerase such as E. coli polyA polymerase (E-PAP). gRNAs including a polyA tail may also be prepared by in vitro transcription from a DNA template. In certain embodiments, a polyA tail of defined length is encoded on a DNA template and transcribed with the gRNA via an RNA polymerase (such as T7 RNA polymerase). gRNAs with a polyA tail may also be prepared by ligating a polyA oligonucleotide to a gRNA molecule precursor following in vitro transcription using an RNA ligase or a DNA ligase with or without a splinted DNA oligonucleotide complementary to the gRNA molecule precursor and the polyA oligonucleotide. For example, in certain embodiments, a polyA tail of defined length is synthesized as a synthetic oligonucleotide and ligated on the 3' end of the gRNA with either an RNA ligase or a DNA ligase with or without a splinted DNA oligonucleotide complementary to the guide RNA and the polyA oligonucleotide. gRNAs including the polyA tail may also be prepared synthetically, in one or several pieces that are ligated together by either an RNA ligase or a DNA ligase with or without one or more splinted DNA oligonucleotides.

In certain embodiments, the polyA tail is comprised of fewer than 50 adenine nucleotides, for example, fewer than 45 adenine nucleotides, fewer than 40 adenine nucleotides, fewer than 35 adenine nucleotides, fewer than 30 adenine nucleotides, fewer than 25 adenine nucleotides or fewer than 20 adenine nucleotides. In certain embodiments the polyA tail is comprised of between 5 and 50 adenine nucleotides, for example between 5 and 40 adenine nucleotides, between 5 and 30 adenine nucleotides, between 10 and 50 adenine nucleotides, or between 15 and 25 adenine nucleotides. In certain embodiments, the polyA tail is comprised of about 20 adenine nucleotides.

The presently disclosed subject matter also provides for methods, genome editing system and compositions for gene editing (e.g., ex vivo gene editing) by using gRNAs which include one or more modified nucleosides or nucleotides that are described herein.

While some of the exemplary modifications discussed in this section may be included at any position within the gRNA sequence, in certain embodiments, a gRNA comprises a modification at or near its 5' end (e.g., within 1-10, 1-5, or 1-2 nucleotides of its 5' end). In certain embodiments, a gRNA comprises a modification at or near its 3' end (e.g., within 1-10, 1-5, or 1-2 nucleotides of its 3' end). In certain embodiments, a gRNA comprises both a modification at or near its 5' end and a modification at or near its 3' end.

In certain embodiments, a gRNA molecule (e.g., an in vitro transcribed gRNA) comprises a targeting domain which is complementary with a target domain from a gene expressed in a eukaryotic cell, wherein the gRNA molecule is modified at its 5' end and comprises a 3' polyA tail. The gRNA molecule may, for example, lack a 5' triphosphate group (e.g., the 5' end of the targeting domain lacks a 5' triphosphate group). In certain embodiments, a gRNA (e.g., an in vitro transcribed gRNA) is modified by treatment with a phosphatase (e.g., calf intestinal alkaline phosphatase) to remove the 5' triphosphate group and comprises a 3' polyA tail as described herein. The gRNA molecule may alternatively include a 5' cap (e.g., the 5' end of the targeting domain includes a 5' cap). In certain embodiments, a gRNA (e.g., an in vitro transcribed gRNA) contains both a 5' cap structure or cap analog and a 3' polyA tail as described herein. In certain embodiments, the 5' cap comprises a modified guanine nucleotide that is linked to the remainder of the gRNA molecule via a 5'-5' triphosphate linkage. In certain embodiments, the 5' cap comprises two optionally modified guanine nucleotides that are linked via an optionally modified 5'-5' triphosphate linkage (e.g., as described above). In certain embodiments, the polyA tail is comprised of between 5 and 50 adenine nucleotides, for example between 5 and 40 adenine nucleotides, between 5 and 30 adenine nucleotides, between 10 and 50 adenine nucleotides, between 15 and 25 adenine nucleotides, fewer than 30 adenine nucleotides, fewer than 25 adenine nucleotides or about 20 adenine nucleotides.

In certain embodiments, the presently disclosed subject matter provides for a gRNA molecule comprising a targeting domain which is complementary with a target domain from a gene expressed in a eukaryotic cell, wherein the gRNA molecule comprises a 3' polyA tail which is comprised of fewer than 30 adenine nucleotides (e.g., fewer than 25 adenine nucleotides, between 15 and 25 adenine nucleotides, or about 20 adenine nucleotides). In certain embodiments, these gRNA molecules are further modified at their 5' end (e.g., the gRNA molecule is modified by treatment with a phosphatase to remove the 5' triphosphate group or modified to include a 5' cap as described herein).

In certain embodiments, gRNAs can be modified at a 3' terminal U ribose. In certain embodiments, the 5' end and a 3' terminal U ribose of the gRNA are modified (e.g., the gRNA is modified by treatment with a phosphatase to remove the 5' triphosphate group or modified to include a 5' cap as described herein).

For example, the two terminal hydroxyl groups of the U ribose can be oxidized to aldehyde groups and a concomitant opening of the ribose ring to afford a modified nucleoside as shown below:

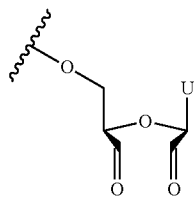

wherein "U" can be an unmodified or modified uridine.

In certain embodiments, the 3' terminal U can be modified with a 2'3' cyclic phosphate as shown below:

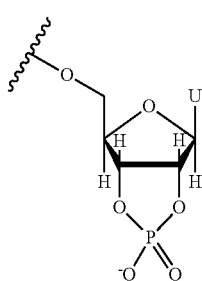

wherein "U" can be an unmodified or modified uridine.

In certain embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines, cytidines and guanosines can be replaced with modified adenosines, cytidines and guanosines, e.g., with modifications at the 8-position, e.g., 8-bromo guanosine, or with any of the modified adenosines, cytidines or guanosines described herein.

In certain embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclylamino, arylamino, diarylamino, heteroarylamino, diheteroarylamino, or amino acid); or cyano (—CN). In certain embodiments, the phosphate backbone can be modified as described herein, e.g., with a phosphothioate group. In certain embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In certain embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclylamino, arylamino, diarylamino, heteroarylamino, or diheteroarylamino, ethylenediamine, or polyamino) and aminoalkoxy or $O(CH_2)_n$-amino (wherein amino can be, e.g., $NH_2$; alkylamino, dialkylamino, heterocyclylamino, arylamino, diarylamino, heteroarylamino, or diheteroarylamino, ethylenediamine, or polyamino).

In certain embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-(3'→2')).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In certain embodiments, a gRNA comprises a 4'-S, 4'-Se or a 4'-C-aminomethyl-2'-O-Me modification.

In certain embodiments, deaza nucleotides, e.g., 7-deaza-adenosine, can be incorporated into the gRNA. In certain embodiments, 0- and N-alkylated nucleotides, e.g., N6-methyl adenosine, can be incorporated into the gRNA. In certain embodiments, one or more or all of the nucleotides in a gRNA molecule are deoxynucleotides.

12.6 miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. In certain embodiments, this down regulation occurs by either reducing nucleic acid molecule stability or inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative and are not intended to limit the scope or content of the invention in any way.

Example 1: Evaluation of Candidate Guide RNAs (gRNAs)

The suitability of candidate gRNAs can be evaluated as described in this example. Although described for a chimeric gRNA, the approach can also be used to evaluate modular gRNAs.

Cloning gRNAs into Vectors

For each gRNA, a pair of overlapping oligonucleotides is designed and obtained.

Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters maybe used to drive in vivo transcription (e.g. H1 promoter) or for in vitro transcription (e.g., a T7 promoter).

Cloning gRNAs in Linear dsDNA Molecule (STITCHR)

For each gRNA, a single oligonucleotide is designed and obtained. The U6 promoter and the gRNA scaffold (e.g. including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Each gRNA to be tested is transfected, along with a plasmid expressing Cas9 and a small amount of a GFP-expressing plasmid into human cells. In preliminary experiments, these cells can be immortalized human cell lines such as 293T, K562 or U2OS. Alternatively, primary human cells may be used. In this case, cells may be relevant to the eventual therapeutic cell target. The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation (such as Lonza Nucleofection). Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, mini-prepped and sequenced with a single primer. Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Assessment of Gene Targeting by NHEJ

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of viral copies have undergone NHEJ-induced indels that result in a frameshift or large deletion or insertion that would be expected to destroy gene function. If the goal is to remove a specific sequence motif, sequencing may be used to assess what percent of viral copies have undergone NHEJ-induced deletions that span this sequence.

Example 3: Assessment of Activity of Individual gRNAs Targeting a Synthetic HSV-1 Construct A plasmid containing HSV-1 sequences was constructed as a reporter to measure Cas9-mediated cleavage of target DNA. This reporter plasmid, pAF025, encodes a Green Fluorescent Protein (GFP) driven by a CMV promoter. The target HSV-1 sequences were inserted in frame with the GFP, at its N-terminus, with a P2A self-cleaving peptide sequence between them.

gRNA molecules were identified using a custom guide RNA design software based on the public tool cas-offinder (Bae et al. Bioinformatics. 2014; 30(10): 1473-1475). Each gRNA molecules tested in this example and listed in Tables 18 and 19 were generated as a STITCHR product and co-transfected with a plasmid expressing the *S. aureus* Cas9 (pAF003) into HEK293FT cells. The pAF003 plasmid encodes the *S. aureus* Cas9, with N-terminal and C-terminal nuclear localization signals (NLS) and a C-terminal triple flag tag, driven by a CMV promoter. gRNA and Cas9-encoding DNA were introduced into cells along with target plasmid pAF025 by Minis TransIT-293 transfection reagent. Two days post-transfection, cells were removed from their growth plates by trypsinization, washed in PBS buffer, and analyzed with a BD Accuri Flow Cytometer.

Figure 9:
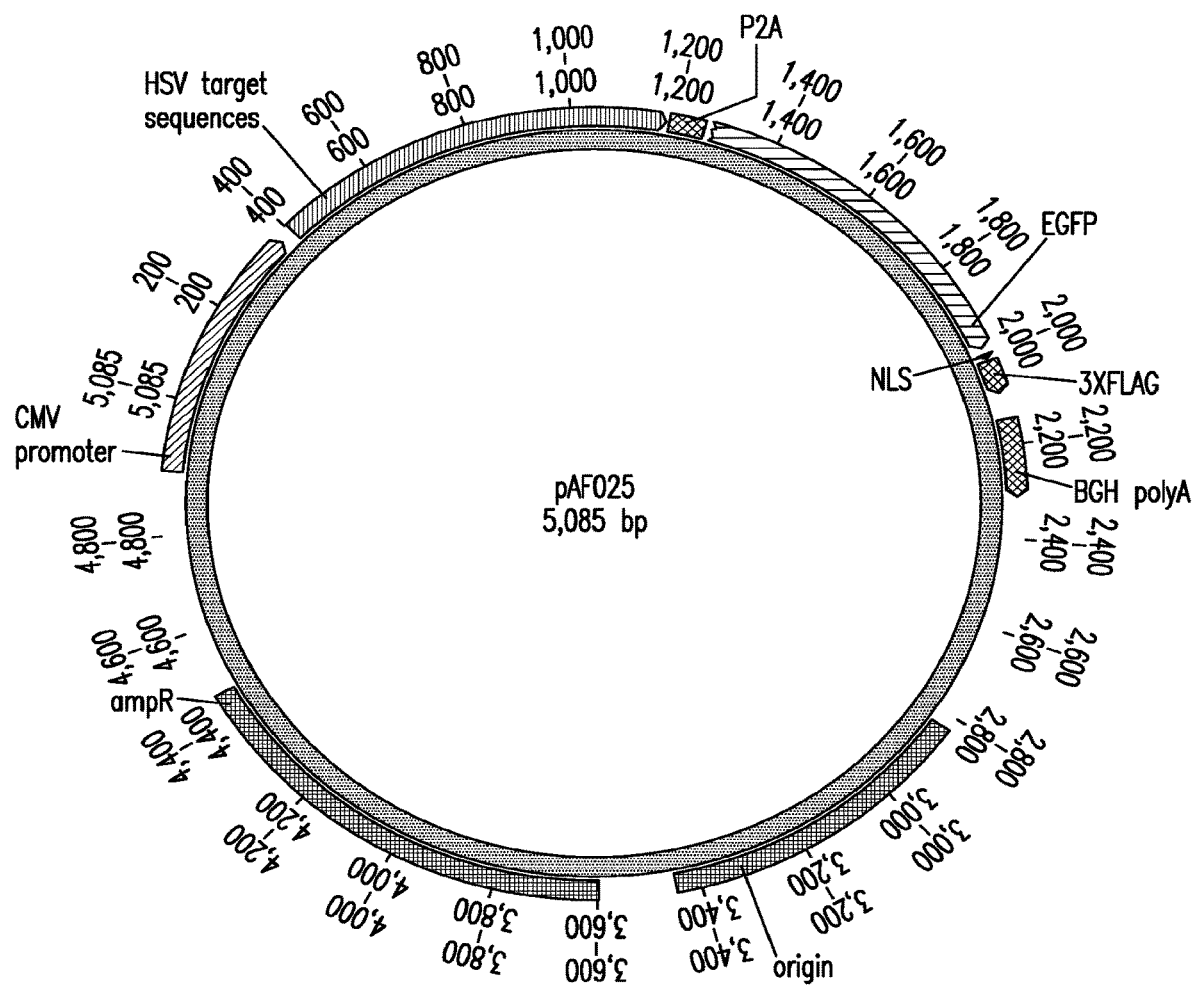
FIG. 9 is a schematic representation of the pAF025 plasmid map.
Figure 10A:
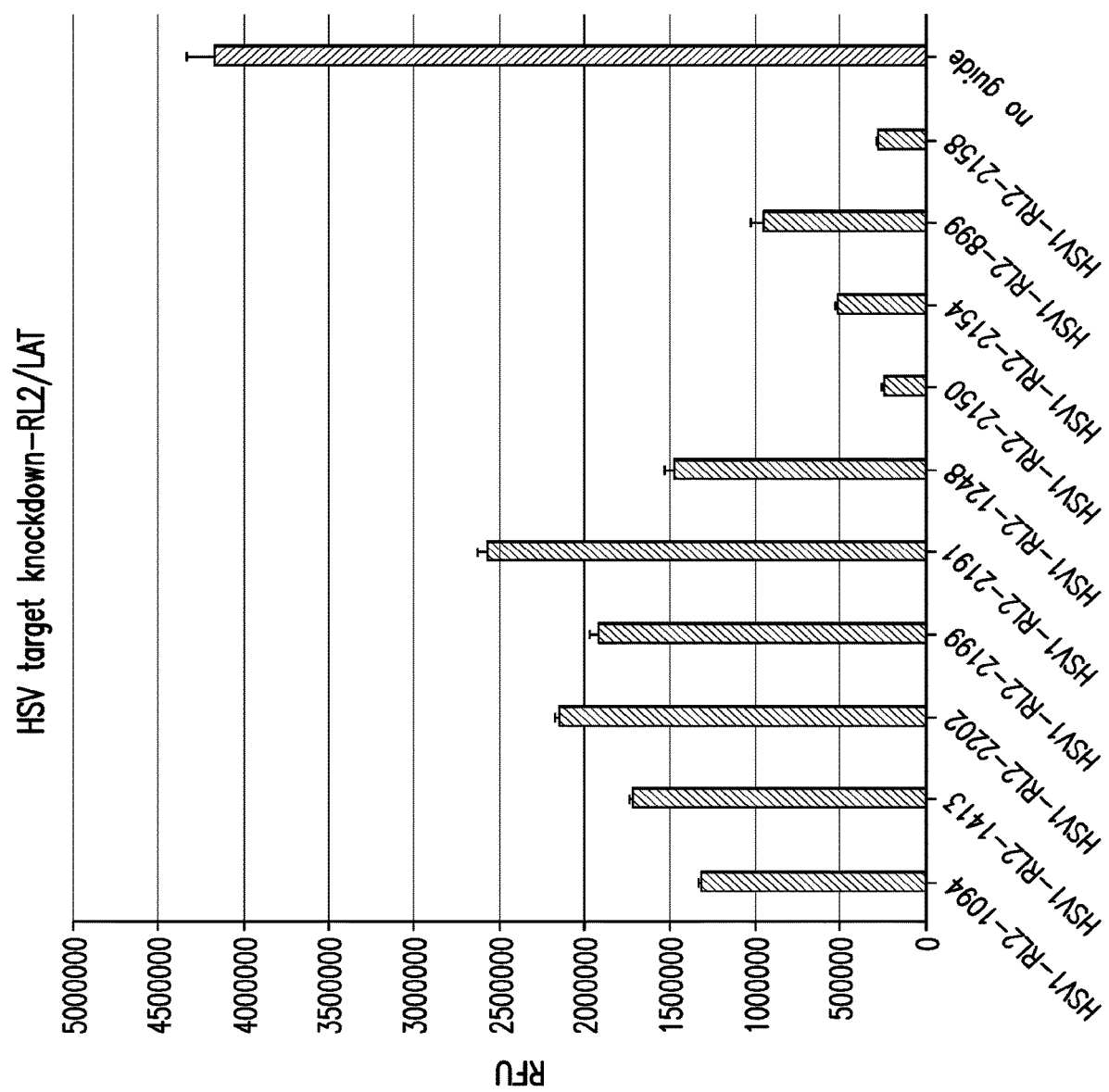
FIGS. 10A-10B show Cas9-mediated cleavage of HSV-1 target sequences in plasmid pAF025. (A) shows HSV1 target knockdown of RL2/LAT by gRNAs listed in Table 18
Figure 10B:
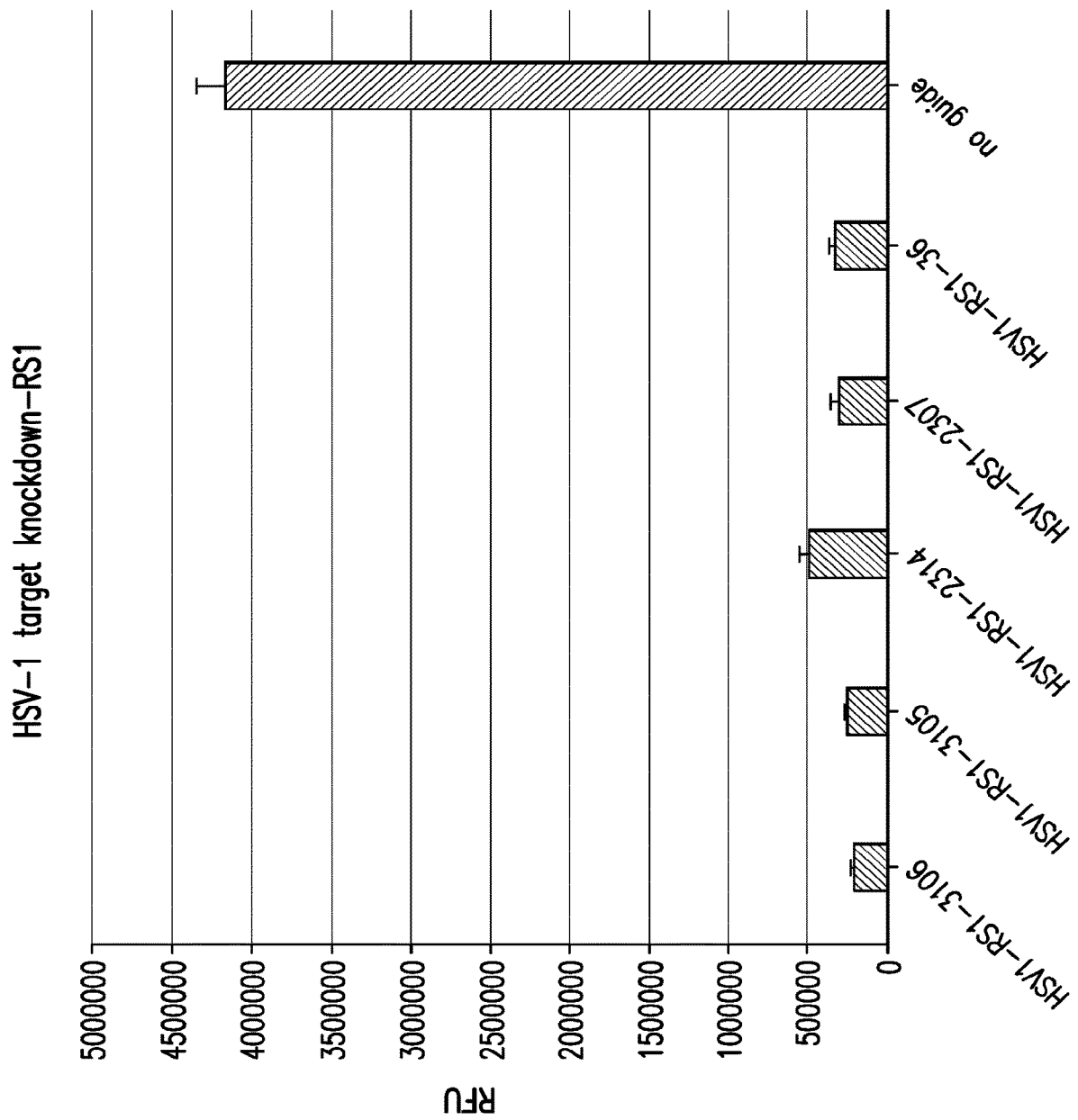

FIG. 9 shows the plasmid map for pAF025. FIGS. 10A-10B show the reduction in GFP expression as measured by mean fluorescence (or relative fluorescence units, RFU) of the transfected cell population due to Cas9-mediated cleavage of the HSV-1 target sequences in plasmid pAF025. Table 18 lists the gRNAs shown in FIG. 10A, and Table 19 lists the gRNAs shown in FIG. 10B.

TABLE 18

(gRNAs shown in FIG. 10A)

| gRNA name | SEQ ID NO. for the nucleotide sequence of the targeting domain of the gRNA |
|---|---|
| HSV1-RL2-1094 | GAGGCCGCCGAGGACGUCAG (SEQ ID NO: 23519) |
| HSV1-RL2-1413 | GGGGGGGUUGGGGUUGGGGU (SEQ ID NO: 23587) |
| HSV1-RL2-2202 | GCCCCUCCGGGGGGUUGGGGU (SEQ ID NO: 23583) |
| HSV1-RL2-2199 | GUCUGGCCCCUCCGGGGGGU (SEQ ID NO: 23580) |
| HSV1-RL2-2191 | GGGGGGCGUCUGGCCCCUCCGG (SEQ ID NO: 23571) |

TABLE 18-continued (gRNAs shown in FIG. 10A)

| gRNA name | SEQ ID NO. for the nucleotide sequence of the targeting domain of the gRNA |
|---|---|
| HSV1-RL2-1248 | GGGGCGUCUGGCCCCUCCGG (SEQ ID NO: 23569) |
| HSV1-RL2-2150 | GCCCCCCCGGCCCUGAGUCGGAGG (SEQ ID NO: 23527) |
| HSV1-RL2-2154 | GCCUGUGGGGAGAGGCCGGGG (SEQ ID NO: 23531) |
| HSV1-RL2-899 | GGGGGAGUCGCUGAUCACUA (SEQ ID NO: 23489) |
| HSV1-RL2-2158 | GUCUCUGUUGUUUGCAAGGGGG (SEQ ID NO: 23535) |

TABLE 19

(gRNAs shown in FIG. 10B)

| gRNA name | SEQ ID NO. for the nucleotide sequence of the targeting domain of the gRNA |
|---|---|
| HSV1-RS1-3106 | GCGUCAUCGACCUCGUCGGACU (SEQ ID NO: 3363) |
| HSV1-RS1-3105 | GUCAUCGACCUCGUCGGACU (SEQ ID NO: 3362) |
| HSV1-RS1-2314 | GCGACAGGCGGUCCGUGGGGU (SEQ ID NO: 2522) |
| HSV1-RS1-2307 | GGGCGCGGCGACAGGCGGUCCG (SEQ ID NO: 2515) |
| HSV1-RS1-36 | GCGCGGCGACAGGCGGUCCG (SEQ ID NO: 243) |

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (58749 sequences)

SEQ ID NO: 1 - protein, 1345 aa, Streptococcus mutans
  misc_feature (10)..(21): N-terminal RuvC-like domain
  misc_feature (759)..(766): RuvC-like domain
  misc_feature (837)..(863): HNH-like domain
  misc_feature (982)..(989): RuvC-like domain
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1368 aa, Streptococcus pyogenes [sequence omitted]

SEQ ID NO: 3 - DNA, 4107 bp, Streptococcus pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 4 - protein, 1388 aa, Streptococcus thermophilus
  misc_feature (10)..(21): N-terminal RuvC-like domain
  misc_feature (760)..(767): RuvC-like domain
  misc_feature (844)..(870): HNH-like domain
  misc_feature (989)..(996): RuvC-like domain
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 5 - protein, 1334 aa, Listeria innocua
  misc_feature (10)..(21): N-terminal RuvC-like domain
  misc_feature (762)..(769): RuvC-like domain
  misc_feature (840)..(866): HNH-like domain
  misc_feature (985)..(992): RuvC-like domain
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 6 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 8 - DNA, 3159 bp, Staphylococcus aureus
atgaagcggaactacatcctgggcctggacatcggcatcaccagcgtgggctacggcatcatcgactacgagacacgggacgtgatcgatgccggcgtgcggctgttcaaagaggccaacgtggaaaacaacgagggcaggcggagcaagagaggcgccagaaggctgaagcggcggaggcggcatagaatccagagagtgaagaagctgctgttcgactacaacctgctgaccgaccacagcgagctgagcggcatcaacccctacgaggccagagtgaagggcctgagccagaagctgagcgaggaagagttctctgccgccctgctgcacctggccaagagaagaggcgtgcacaacgtgaacgaggtggaagaggacaccggcaacgagctgtccaccaaagagcagatcagccggaacagcaaggccctggaagagaaatacgtggccgaactgcagctggaacggctgaagaaagacggcgaagtgcggggcagcatcaacagattcaagaccagcgactacgtgaaagaagccaaacagctgctgaaggtgcagaaggcctaccaccagctggaccagagcttcatcgacacctacatcgacctgctggaaacccggcggacctactatgagggacctggcgagggcagccccttcggctggaaggacatcaaagaatggtacgagatgctgatgggccactgcacctacttccccgaggaactgcggagcgtgaagtacgcctacaacgccgacctgtacaacgccctgaacgacctgaacaatctcgtgatcaccagggacgagaacgagaagctggaatattacgagaagttccagatcatcgagaacgtgttcaagcagaagaagaagcccaccctgaagcagatcgccaaagaaatcctcgtgaacgaagaggatattaagggctacagagtgaccagcaccggcaagcccgagttcaccaacctgaaggtgtaccacgacatcaaggacattaccgcccggaaagagattattgagaacgccgagctgctggatcagattgccaagatcctgaccatctaccagagcagcgaggacatccaggaagaactgaccaatctgaactccgagctgacccaggaagagatcgagcagatctctaatctgaagggctataccggcacccacaacctgagcctgaaggccatcaacctgatcctggacgagctgtggcacaccaacgacaaccagatcgctatcttcaaccggctgaagctggtgcccaagaaggtggacctgtcccagcagaaagagatccccaccaccctggtggacgacttcatcctgagccccgtcgtgaagagaagcttcatccagagcatcaaagtgatcaacgccatcatcaagaagtacggcctgcccaacgacatcattatcgagctggcccgcgagaagaactccaaggacgcccagaaaatgatcaacgagatgcagaagcggaaccggcagaccaacgagcggatcgaggaaatcatccggaccaccggcaaagagaacgccaagtacctgatcgagaagatcaagctgcacgacatgcaggaaggcaagtgcctgtacagcctggaagccatccctctggaagatctgctgaacaaccccttcaactatgaggtggaccacatcatccccagaagcgtgtccttcgacaacagcttcaacaacaaggtgctcgtgaagcaggaagaaaacagcaagaagggcaaccggaccccattccagtacctgagcagcagcgacagcaagatcagctacgaaaccttcaagaagcacatcctgaatctggccaagggcaagggcagaatcagcaagaccaagaaagagtatctgctggaagaacgggacatcaacaggttctccgtgcagaaagacttcatcaaccggaacctggtggataccagatacgccaccagaggcctgatgaacctgctgcggagctacttcagagtgaacaacctggacgtgaaagtgaagtccatcaatggcggcttcaccagctttctgcggcggaagtggaagtttaagaaagagcggaacaaggggtacaagcaccacgccgaggacgccctgatcattgccaacgccgatttcatcttcaaagagtggaagaaactggacaaggccaaaaaagtgatggaaaaccagatgttcgaggaaaagcaggccgagagcatgcccgagatcgaaaccgagcaggagtacaaagagatcttcatcaccccccaccagatcaagcacattaaggacttcaaggactacaagtacagccaccgggtggacaagaagcctaatagagagctgattaacgacaccctgtactccacccggaaggacgacaagggcaacaccctgatcgtgaacaatctgaacggcctgtacgacaaggacaatgacaagctgaaaaagctgatcaacaagagccccgaaaagctgctgatgtaccaccacgacccccagacctaccagaaactgaagctgattatggaacagtacggcgacgagaagaatcccctgtacaagtactacgaggaaaccgggaactacctgaccaagtactccaaaaaggacaacggccccgtgatcaagaagattaagtattacggcaacaaactgaacgcccatctggacatcaccgacgactaccccaacagcagaaacaaggtcgtgaagctgtccctgaagccctacagattcgacgtgtacctggacaatggcgtgtacaagttcgtgaccgtgaagaatctggatgtgatcaaaaaagaaaactactacgaagtgaatagcaagtgctatgaggaagctaagaagctgaagaagatcagcaaccaggccgagtttatcgcctccttctacaacaacgatctgatcaagatcaacggcgagctgtatagagtgatcggcgtgaacaacgacctgctgaaccggatcgaagtgaacatgatcgacatcacctaccgcgagtacctggaaaacatgaacgacaagaggccccccaggatcattaagacaatcgcctccaagacccagagcattaagaagtacagcacagacattctgggcaacctgtatgaagtgaaatctaagaagcaccctcagatcatcaaaaagggc

SEQ ID NO: 9 - DNA, 3159 bp, Staphylococcus aureus
atgaagcgcaactacatcctcggactggacatcggcattacctccgtgggatacggcatcatcgattacgaaactagggatgtgatcgacgctggagtcaggctgttcaaagaggcgaacgtggagaacaacgaggggcggcgctcaaagaggggggcccgccggctgaagcgccgccgcagacatagaatccagcgcgtgaagaagctgctgttcgactacaaccttctgaccgaccactccgaactttccggcatcaacccatatgaggctagagtgaagggattgtcccaaaagctgtccgaggaagagttctccgccgcgttgctccacctcgccaagcgcaggggagtgcacaatgtgaacgaagtggaagaagataccggaaacgagctgtccaccaaggagcagatcagccggaactccaaggccctggaagagaaatacgtggcggaactgcaactggagcggctgaagaaagacggagaagtgcgcggctcgatcaaccgcttcaagacctcggactacgtgaaggaggccaagcagctcctgaaagtgcaaaaggcctatcaccaacttgaccagtcctttatcgatacctacatcgatctgctcgagactcggcggacttactacgagggtccaggggagggctccccatttggttggaaggatattaaggagtggtacgaaatgctgatgggacactgcacatacttccctgaggagctgcggagcgtgaaatacgcatacaacgcagacctgtacaacgcgctgaacgacctgaacaatctcgtgatcacccgggacgagaacgaaaagctcgagtattacgaaaagttccagattattgagaacgtgttcaaacagaagaagaagccgacactgaagcagattgccaaggaaatcctcgtgaacgaagaggacatcaagggctatcgagtgacctcaacgggaaagccggagttcaccaatctgaaggtctaccacgacatcaaagacattaccgcccggaaggagatcattgagaacgcggagctgttggaccagattgcgaagattctgaccatctaccaatcctccgaggatattcaggaagaactcaccaacctcaacagcgaactgacccaggaggagatagagcaaatctccaacctgaagggctacaccggaactcataacctgagcctgaaggccatcaacttgatcctggacgagctgtggcacaccaacgataaccagatcgctattttcaatcggctgaagctggtccccaagaaagtggacctctcacaacaaaaggagatccctactacccttgtggacgatttcattctgtcccccgtggtcaagagaagcttcatacagtcaatcaaagtgatcaatgccattatcaagaaatacggtctgcccaacgacattatcattgagctcgcccgcgagaagaactcgaaggacgcccagaagatgattaacgaaatgcagaagaggaaccgacagactaacgaacggatcgaagaaatcatccggaccaccgggaaggaaaacgcgaagtacctgatcgaaaagatcaagctccatgacatgcaggaaggaaagtgtctgtactcgctggaggccattccgctggaggacttgctgaacaacccttttaactacgaagtggatcatatcattccgaggagcgtgtcattcgacaattccttcaacaacaaggtcctcgtgaagcaggaggaaaactcgaagaagggaaaccgcacgccgttccagtacctgagcagcagcgactccaagatttcctacgaaaccttcaagaagcacatcctcaacctggcaaaggggaagggtcgcatctccaagaccaagaaggaatatctgctggaagaaagagacatcaacagattctccgtgcaaaaggacttcatcaaccgcaacctcgtggatactagatacgctactcggggtctgatgaacctcctgagaagctactttagagtgaacaatctggacgtgaaggtcaagtcgattaacggaggtttcacctccttcctgcggcgcaagtggaagttcaagaaggaacggaacaagggctacaagcaccacgccgaggacgccctgatcattgccaacgccgacttcatcttcaaagaatggaagaaacttgacaaggctaagaaggtcatggaaaaccagatgttcgaagaaaagcaggccgagtctatgcctgaaatcgagactgaacaggagtacaaggaaatctttattacgccacaccagatcaaacacatcaaggatttcaaggattacaagtactcacatcgcgtggacaaaaagccgaacagggaactgatcaacgacaccctctactccacccggaaggatgacaaagggaataccctcatcgtcaacaaccttaacggcctgtacgacaaggacaacgataagctgaagaagctcattaacaagtcgcccgaaaagttgctgatgtaccaccacgaccctcagacttaccagaagctcaagctgatcatggagcagtatggggacgagaaaaacccgttgtacaagtactacgaagaaactgggaattatctgactaagtactccaagaaagataacggccccgtgattaagaagattaagtactacggcaacaagctgaacgcccatctggacatcaccgatgactaccctaattcccgcaacaaggtcgtcaagctgagcctcaagccctaccggtttgatgtgtaccttgacaatggagtgtacaagttcgtgactgtgaagaaccttgacgtgatcaagaaggagaactactacgaagtcaactccaagtgctacgaggaagcaaagaagttgaagaagatctcgaaccaggccgagttcattgcctccttctataacaacgacctgattaagatcaacggcgaactgtaccgcgtcattggcgtgaacaacgatctcctgaaccgcatcgaagtgaacatgatcgacatcacttaccgggaatacctggagaatatgaacgacaagcgcccgccccggatcattaagactatcgcctcaaagacccagtcgatcaagaagtacagcaccgacatcctgggcaacctgtacgaggtcaaatcgaagaagcacccccagatcatcaagaaggga

SEQ ID NO: 10 - DNA, 3159 bp, Staphylococcus aureus
atgaaaaggaactacattctggggctggccatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 11 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagaggcctctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 12 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 13 - DNA, 3249 bp, Neisseria meningitidis
  misc_feature (1)..(3249): Exemplary codon optimized Cas9
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 14 - protein, 859 aa, Artificial Sequence
  Synthetic Cas9 consensus sequence derived from Sm, Sp, St, and Li Cas9 sequences
  misc_feature (4)..(4): Xaa can be any naturally occurring amino acid
  misc_feature (8)..(18): N-terminal RuvC-like domain
  misc_feature (21)..(21): Xaa can be any naturally occurring amino acid
  misc_feature (23)..(23): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(31): Each Xaa can independently be any naturally occurring amino acid
  misc_feature (33)..(33): Xaa can be any naturally occurring amino acid
  misc_feature (36)..(36): Xaa can be any naturally occurring amino acid
  misc_feature (45)..(45): Xaa can be any naturally occurring amino acid
  misc_feature (54)..(54): Xaa can be any naturally occurring amino acid
  misc_feature (63)..(63): Xaa can be any naturally occurring amino acid
  misc_feature (71)..(71): Xaa can be any naturally occurring amino acid
  misc_feature (75)..(75): Xaa can be any naturally occurring amino acid
  misc_feature (76)..(76): Xaa can be any naturally occurring amino acid
  misc_feature (78)..(80): Each Xaa can independently be any naturally occurring amino acid
  misc_feature (82)..(82): Xaa can be any naturally occurring amino acid
  misc_feature (84)..(84): Xaa can be any naturally occurring amino acid
  misc_feature (85)..(85): Xaa can be any naturally occurring amino acid
  misc_feature (89)..(89): Xaa can be any naturally occurring amino acid
  misc_feature (90)..(90): Xaa can be any naturally occurring amino acid
  misc_feature (98)..(98): Xaa can be any naturally occurring amino acid
  misc_feature (100)..(100): Xaa can be any naturally occurring amino acid
  misc_feature (106)..(106): Xaa can be any naturally occurring amino acid
  misc_feature (113)..(113): Xaa can be any naturally occurring amino acid
  misc_feature (116)..(116): Xaa can be any naturally occurring amino acid
  misc_feature (125)..(125): Xaa can be any naturally occurring amino acid
  misc_feature (126)..(126): Xaa can be any naturally occurring amino acid
  misc_feature (128)..(133): Each Xaa can independently be any naturally occurring amino acid
  misc_feature (135)..(135): Xaa can be any naturally occurring amino acid
  misc_feature (137)..(137): Xaa can be any naturally occurring amino acid
  misc_feature (139)..(147): Each Xaa can independently be any naturally occurring amino acid
  misc_feature (153)..(155): Each Xaa can independently be any naturally occurring amino acid
  misc_feature (157)..(157): Xaa can be any naturally occurring amino acid
  misc_feature (159)..(159): Xaa can be any naturally occurring amino acid
  misc_feature (161)..(161): Xaa can be any naturally occurring amino acid
  misc_feature (163)..(163): Xaa can be any naturally occurring amino acid
  misc_feature (166)..(168): Each Xaa can independently be any naturally occurring amino acid
  misc_feature (170)..(170): Xaa can be any naturally occurring amino acid
  misc_feature (171)..(171): Xaa can be any naturally occurring amino acid
  misc_feature (173)..(175): Each Xaa can independently be any naturally occurring amino acid
  misc_feature (177)..(177): Xaa can be any naturally occurring amino acid
  misc_feature (183)..(183): Xaa can be any naturally occurring amino acid
  misc_feature (185)..(187): Each Xaa can independently be any naturally occurring amino acid
  misc_feature (189)..(189): Xaa can be any naturally occurring amino acid
  misc_feature (192)..(195): Each Xaa can independently be any naturally occurring amino acid
  misc_feature (198)..(198): Xaa can be any naturally occurring amino acid
  misc_feature (199)..(199): Xaa can be any naturally occurring amino acid
  misc_feature (202)..(202): Xaa can be any naturally occurring amino acid
  misc_feature (206)..(206): Xaa can be any naturally occurring amino acid
  misc_feature (207)..(207): Xaa can be any naturally occurring amino acid
  misc_feature (210)..(210): Xaa can be any naturally occurring amino acid
  misc_feature (212)..(212): Xaa can be any naturally occurring amino acid
  misc_feature (213)..(213): Xaa can be any naturally occurring amino acid
  misc_feature (219)..(219): Xaa can be any naturally occurring amino acid
  misc_feature (220)..(220): Xaa can be any naturally occurring amino acid
  misc_feature (222)..(222): Xaa can be any naturally occurring amino acid
  misc_feature (224)..(224): Xaa can be any naturally occurring amino acid
  misc_feature (226)..(226): Xaa can be any naturally occurring amino acid
  misc_feature (236)..(236): Xaa can be any naturally occurring amino acid
  misc_feature (240)..(240): Xaa can be any naturally occurring amino acid
  misc_feature (241)..(241): Xaa can be any naturally occurring amino acid
  misc_feature (244)..(246): Each Xaa can independently be any naturally occurring amino acid
  misc_feature (248)..(248): Xaa can be any naturally occurring amino acid
  misc_feature (249)..(249): Xaa can be any naturally occurring amino acid
  misc_feature (250)..(250): Xaa can be any naturally occurring amino acid
  misc_feature (252)..(254): Each Xaa can independently be any naturally occurring amino acid
  misc_feature (256)..(256): Xaa can be any naturally occurring amino acid
  misc_feature (257)..(257): Xaa can be any naturally occurring amino acid
  misc_feature (268)..(268): Xaa can be any naturally occurring amino acid
  misc_feature (271)..(271): Xaa can be any naturally occurring amino acid
  misc_feature (273)..(273): Xaa can be any naturally occurring amino acid
  misc_feature (277)..(277): Xaa can be any naturally occurring amino acid
  misc_feature (280)..(280): Xaa can be any naturally occurring amino acid
  misc_feature (281)..(281): Xaa can be any naturally occurring amino acid
  misc_feature (283)..(283): Xaa can be any naturally occurring amino acid
  misc_feature (289)..(289): Xaa can be any naturally occurring amino acid
  misc_feature (290)..(290): Xaa can be any naturally occurring amino acid
  misc_feature (292)..(294): Each Xaa can independently be any naturally occurring amino acid
  misc_feature (301)..(301): Xaa can be any naturally occurring amino acid
  misc_feature (308)..(308): Xaa can be any naturally occurring amino acid
  misc_feature (319)..(322): Each Xaa can independently be any naturally occurring amino acid
  misc_feature (328)..(328): Xaa can be any naturally occurring amino acid
  misc_feature (329)..(329): Xaa can be any naturally occurring amino acid
  misc_feature (335)..(337): Each Xaa can independently be any naturally occurring amino acid
  misc_feature (346)..(346): Xaa can be any naturally occurring amino acid
  misc_feature (347)..(347): Xaa can be any naturally occurring amino acid
  misc_feature (356)..(361): Each Xaa can independently be any naturally occurring amino acid
  misc_feature (363)..(363): Xaa can be any naturally occurring amino acid
  misc_feature (370)..(373): Each Xaa can independently be any naturally occurring amino acid
  misc_feature (375)..(375): Xaa can be any naturally occurring amino acid
  misc_feature (376)..(376): Xaa can be any naturally occurring amino acid
  misc_feature (379)..(379): Xaa can be any naturally occurring amino acid
  misc_feature (386)..(390): Each Xaa can independently be any naturally occurring amino acid
  misc_feature (393)..(393): Xaa can be any naturally occurring amino acid
  misc_feature (395)..(395): Xaa can be any naturally occurring amino acid
  misc_feature (396)..(396): Xaa can be any naturally occurring amino acid
  misc_feature (398)..(398): Xaa can be any naturally occurring amino acid
  misc_feature (400)..(400): Xaa can be any naturally occurring amino acid
  misc_feature (403)..(403): Xaa can be any naturally occurring amino acid
  misc_feature (407)..(407): Xaa can be any naturally occurring amino acid
  misc_feature (410)..(410): Xaa can be any naturally occurring amino acid
  misc_feature (411)..(411): Xaa can be any naturally occurring amino acid
  misc_feature (413)..(416): Each Xaa can independently be any naturally occurring amino acid
  misc_feature (418)..(418): Xaa can be any naturally occurring amino acid
  misc_feature (422)..(422): Xaa can be any naturally occurring amino acid
  misc_feature (428)..(428): Xaa can be any naturally occurring amino acid
  misc_feature (431)..(431): Xaa can be any naturally occurring amino acid
  misc_feature (433)..(433): Xaa can be any naturally occurring amino acid
  misc_feature (437)..(439): Each Xaa can independently be any naturally occurring amino acid
  misc_feature (445)..(445): Xaa can be any naturally occurring amino acid
  misc_feature (451)..(451): Xaa can be any naturally occurring amino acid
  misc_feature (456)..(456): Xaa can be any naturally occurring amino acid
  misc_feature (459)..(459): Xaa can be any naturally occurring amino acid
  misc_feature (465)..(469): Each Xaa can independently be any naturally occurring amino acid
  misc_feature (481)..(481): Xaa can be any naturally occurring amino acid
  misc_feature (482)..(482): Xaa can be any naturally occurring amino acid
  misc_feature (484)..(484): Xaa can be any naturally occurring amino acid
  misc_feature (490)..(490): Xaa can be any naturally occurring amino acid
  misc_feature (494)..(494): Xaa can be any naturally occurring amino acid
  misc_feature (495)..(502): RuvC-like domain
  misc_feature (497)..(497): Xaa can be any naturally occurring amino acid
  misc_feature (506)..(506): Xaa can be any naturally occurring amino acid
  misc_feature (510)..(510): Xaa can be any naturally occurring amino acid
  misc_feature (513)..(513): Xaa can be any naturally occurring amino acid
  misc_feature (514)..(514): Xaa can be any naturally occurring amino acid
  misc_feature (517)..(517): Xaa can be any naturally occurring amino acid
  misc_feature (520)..(520): Xaa can be any naturally occurring amino acid
  misc_feature (525)..(525): Xaa can be any naturally occurring amino acid
  misc_feature (526)..(526): Xaa can be any naturally occurring amino acid
  misc_feature (529)..(529): Xaa can be any naturally occurring amino acid
  misc_feature (531)..(531): Xaa can be any naturally occurring amino acid
  misc_feature (532)..(532): Xaa can be any naturally occurring amino acid
  misc_feature (534)..(534): Xaa can be any naturally occurring amino acid
  misc_feature (542)..(542): Xaa can be any naturally occurring amino acid
  misc_feature (546)..(546): Xaa can be any naturally occurring amino acid
  misc_feature (547)..(547): Xaa can be any naturally occurring amino acid
  misc_feature (553)..(553): Xaa can be any naturally occurring amino acid
  misc_feature (555)..(575): HNH-like domain
  misc_feature (556)..(556): Xaa can be any naturally occurring amino acid
  misc_feature (560)..(560): Xaa can be any naturally occurring amino acid
  misc_feature (563)..(563): Xaa can be any naturally occurring amino acid
  misc_feature (565)..(565): Xaa can be any naturally occurring amino acid
  misc_feature (567)..(567): Xaa can be any naturally occurring amino acid
  misc_feature (579)..(579): Xaa can be any naturally occurring amino acid
  misc_feature (582)..(582): Xaa can be any naturally occurring amino acid
  misc_feature (583)..(583): Xaa can be any naturally occurring amino acid
  misc_feature (585)..(585): Xaa can be any naturally occurring amino acid
  misc_feature (588)..(588): Xaa can be any naturally occurring amino acid
  misc_feature (590)..(590): Xaa can be any naturally occurring amino acid
  misc_feature (592)..(592): Xaa can be any naturally occurring amino acid
  misc_feature (594)..(596): Each Xaa can independently be any naturally occurring amino acid
  misc_feature (610)..(610): Xaa can be any naturally occurring amino acid
  misc_feature (616)..(616): Xaa can be any naturally occurring amino acid
  misc_feature (628)..(628): Xaa can be any naturally occurring amino acid
  misc_feature (631)..(631): Xaa can be any naturally occurring amino acid
  misc_feature (633)..(633): Xaa can be any naturally occurring amino acid
  misc_feature (634)..(634): Xaa can be any naturally occurring amino acid
  misc_feature (636)..(636): Xaa can be any naturally occurring amino acid
  misc_feature (638)..(641): Each Xaa can independently be any naturally occurring amino acid
  misc_feature (643)..(645): Each Xaa can independently be any naturally occurring amino acid
  misc_feature (653)..(653): Xaa can be any naturally occurring amino acid
  misc_feature (657)..(657): Xaa can be any naturally occurring amino acid
  misc_feature (659)..(659): Xaa can be any naturally occurring amino acid
  misc_feature (660)..(660): Xaa can be any naturally occurring amino acid
  misc_feature (665)..(665): Xaa can be any naturally occurring amino acid
  misc_feature (666)..(666): Xaa can be any naturally occurring amino acid
  misc_feature (668)..(668): Xaa can be any naturally occurring amino acid
  misc_feature (669)..(669): Xaa can be any naturally occurring amino acid
  misc_feature (670)..(677): RuvC-like domain
  misc_feature (680)..(680): Xaa can be any naturally occurring amino acid
  misc_feature (681)..(681): Xaa can be any naturally occurring amino acid
  misc_feature (683)..(683): Xaa can be any naturally occurring amino acid
  misc_feature (686)..(686): Xaa can be any naturally occurring amino acid
  misc_feature (696)..(696): Xaa can be any naturally occurring amino acid
  misc_feature (697)..(697): Xaa can be any naturally occurring amino acid
  misc_feature (704)..(704): Xaa can be any naturally occurring amino acid
  misc_feature (708)..(708): Xaa can be any naturally occurring amino acid
  misc_feature (710)..(710): Xaa can be any naturally occurring amino acid
  misc_feature (711)..(711): Xaa can be any naturally occurring amino acid
  misc_feature (714)..(714): Xaa can be any naturally occurring amino acid
  misc_feature (717)..(720): Each Xaa can independently be any naturally occurring amino acid
  misc_feature (722)..(722): Xaa can be any naturally occurring amino acid
  misc_feature (725)..(725): Xaa can be any naturally occurring amino acid
  misc_feature (727)..(727): Xaa can be any naturally occurring amino acid
  misc_feature (733)..(735): Each Xaa can independently be any naturally occurring amino acid
  misc_feature (740)..(740): Xaa can be any naturally occurring amino acid
  misc_feature (742)..(742): Xaa can be any naturally occurring amino acid
  misc_feature (749)..(754): Each Xaa can independently be any naturally occurring amino acid
  misc_feature (758)..(761): Each Xaa can independently be any naturally occurring amino acid
  misc_feature (763)..(768): Each Xaa can independently be any naturally occurring amino acid
  misc_feature (771)..(771): Xaa can be any naturally occurring amino acid
  misc_feature (774)..(777): Each Xaa can independently be any naturally occurring amino acid
  misc_feature (782)..(782): Xaa can be any naturally occurring amino acid
  misc_feature (784)..(786): Each Xaa can independently be any naturally occurring amino acid
  misc_feature (788)..(788): Xaa can be any naturally occurring amino acid
  misc_feature (790)..(790): Xaa can be any naturally occurring amino acid
  misc_feature (795)..(795): Xaa can be any naturally occurring amino acid
  misc_feature (799)..(799): Xaa can be any naturally occurring amino acid
  misc_feature (801)..(801): Xaa can be any naturally occurring amino acid
  misc_feature (802)..(802): Xaa can be any naturally occurring amino acid
  misc_feature (804)..(804): Xaa can be any naturally occurring amino acid
  misc_feature (806)..(813): Each Xaa can independently be any naturally occurring amino acid
  misc_feature (815)..(818): Each Xaa can independently be any naturally occurring amino acid
  misc_feature (820)..(820): Xaa can be any naturally occurring amino acid
  misc_feature (823)..(827): Each Xaa can independently be any naturally occurring amino acid
  misc_feature (829)..(829): Xaa can be any naturally occurring amino acid
  misc_feature (830)..(830): Xaa can be any naturally occurring amino acid
  misc_feature (832)..(832): Xaa can be any naturally occurring amino acid
  misc_feature (835)..(837): Each Xaa can independently be any naturally occurring amino acid
  misc_feature (842)..(844): Each Xaa can independently be any naturally occurring amino acid
  misc_feature (846)..(846): Xaa can be any naturally occurring amino acid
  misc_feature (848)..(848): Xaa can be any naturally occurring amino acid
  misc_feature (851)..(851): Xaa can be any naturally occurring amino acid
  misc_feature (857)..(857): Xaa can be any naturally occurring amino acid
  misc_feature (857)..(857): Xaa can be any naturally occurring amino acid
MKYXIGLDIGTNSVGWAVTDXYXXKXKGXXXIXKNXGLFDGTARXRTARRRRRXNRIYLQIFXEMDFFRLXSFVXXKXXXPXFXXEYHXXPTIYHLRXLXKDLRLXYLALAHXIKXRGNFLIEGXXNXXXXXXYXFXIXXXXXXXXXPEKGFXXXLXGXFXFXLEXXXKXXYXXXLXLLIGDXYXXXFXAKXXXXLSXXVTXALSXXMIXRXXHDLLKXXYXEXFXKGYAGYIDGXQFYXXKLXXXGXXXKXXXEXXLRKQRTFDNGXIPXQXHLEXAIXXQXYPFLNXXIXXXTFRIPYXVGPLAGXSFAWRKIPWNXXXXDSAFIXXMTDLPXXXVLPKHSLYXXVYNELTKVXXXXXXKXIFKRKVXXXXGXXFNXSTYHDLXXXXXLDXNXXEXIXLTXFEDXMIXXLXXXXKXLRRXYTGWGXLSXLXGIRXXXSTILDXLDNRNXMQLIXDLXFKIKQXXXXXGSPAIKKGILQXXKXVDELVXMGPXIVXEMARENQTXGNSXRKXXKEXGSXILKEXXNLXNXXLXLYYLQNGXDMYXXLDILSXYDXDHIXPQXFXDXSIDNVLSNRKDXVPXXVXKKXWXLXLXXXRKFDLTKAERGGLXDKAFIXRQLVETRQITKXVAXLXXNXDXXXXVXXXTLKSLVSXFRKXFXXLYKVXXNXXHHAHDAYLNVXXLXYPXLEEFVYGDYXXKATKFYXNIMXFXXGEXWKXXXXVXMQXNXVKKEQXXXPKNSXLXKDKYGGXXXXXXKGKXXXXIXXXXXXFLXGYXXXXLPKYXLXXXGXRXLASEXKGNXLXXLXAXXXXXXXXEXXXXFXANXXXXXLXXGXAFXXXIRRYXXXTXIXQSXTGLYEXRL

SEQ ID NO: 15 - protein, 8 aa, Artificial Sequence
  RuvC-like domain
  VARIANT (2)..(2): Xaa is Val or His
  VARIANT (3)..(3): Xaa is Ile, Leu, or Val
  VARIANT (5)..(5): Xaa is Met or Thr
IXXEXARE

SEQ ID NO: 16 - protein, 8 aa, Artificial Sequence
  RuvC-like domain
  VARIANT (3)..(3): Xaa is Ile, Leu, or Val
IVXEMARE

SEQ ID NO: 17 - protein, 8 aa, Artificial Sequence
  RuvC-like domain
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 18 - protein, 8 aa, Artificial Sequence
  RuvC-like domain
HHAHDAYL

SEQ ID NO: 19 - protein, 30 aa, Artificial Sequence
  N-terminal RuvC-like domain
  VARIANT (2)..(2): Xaa is Lys or Pro
  VARIANT (4)..(4): Xaa is Val, Leu, Ile, or Phe
  VARIANT (5)..(5): Xaa is Gly, Ala, or Ser
  VARIANT (6)..(6): Xaa is Leu, Ile, Val, or Phe
  MOD_RES (7)..(26): N-terminal RuvC-like domain, each Xaa can be any amino acid or absent, region may encompass 5-20 residues
  VARIANT (29)..(29): Xaa is Asp, Glu, Asn, or Gln
KXYXXXXXXXXXXXXXXXXXXXXXXXTDXY

SEQ ID NO: 20 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (6)..(6): Xaa is Ser, Tyr, Asn, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXXXGXXXX

SEQ ID NO: 21 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXSXGXXXX

SEQ ID NO: 22 - protein, 12 aa, Artificial Sequence
  N-terminal RuvC-like domain
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (11)..(11): Xaa is Val, Ile, Leu, Ala, Met, or His
  VARIANT (12)..(12): Any amino acid or absent
DIGXXSVGWAXX

SEQ ID NO: 23 - protein, 12 aa, Artificial Sequence
  N-terminal RuvC-like domain
  MOD_RES (12)..(12): Any non-polar alkyl amino acid or a hydroxyl amino acid
DIGTNSVGWAVX

SEQ ID NO: 24 - protein, 73 aa, Artificial Sequence
  HNH-like domain
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu, Gln, or Asp
  VARIANT (15)..(15): Xaa is Glu or Asp
  VARIANT (19)..(19): Xaa is Asp, Asn, or His
  VARIANT (20)..(20): Xaa is Tyr, Arg, or Asn
  VARIANT (23)..(23): Xaa is Gln, Asp, or Asn
  MOD_RES (25)..(64): HNH-like domain, each Xaa can be any amino acid or absent, region may encompass 15-40 residues
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 25 - protein, 27 aa, Artificial Sequence
  HNH-like domain
  VARIANT (1)..(1): Xaa is Asp, Glu, Gln, or Asn
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (9)..(9): Xaa is Ser, Ala, Asp, Thr, or Lys
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (13)..(13): Xaa is Asp, Ser, Asn, Arg, Leu, or Thr
  VARIANT (14)..(14): Xaa is Asp, Asn, or Ser
  VARIANT (15)..(15): Xaa is Ser, Ala, Thr, Gly, or Arg
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (19)..(19): Xaa is Lys, Leu, Arg, Met, Thr, or Phe
  VARIANT (20)..(20): Xaa is Val, Leu, Ile, Ala, or Thr
  VARIANT (21)..(21): Xaa is Leu, Ile, Val, or Ala
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXXXXXXXXXXNXXXXXXXXN

SEQ ID NO: 26 - protein, 27 aa, Artificial Sequence
  HNH-like domain
  VARIANT (1)..(1): Xaa is Asp or Glu
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXSXXXDDSXXNKVLXXXXXN

SEQ ID NO: 27 - protein, 27 aa, Artificial Sequence
  HNH-like domain
  VARIANT (1)..(1): Xaa is Asp or Glu
  VARIANT (3)..(3): Xaa is Asp or Glu
  VARIANT (8)..(8): Xaa is Gln, His, Arg, Lys, Tyr, Ile, Leu, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XVXHIVPXSXXXDDSXXNKVLTXXXXN

SEQ ID NO: 28 - protein, 27 aa, Artificial Sequence
  HNH-like domain
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg, Lys, or Leu
  VARIANT (22)..(22): Xaa is Thr or Val
  VARIANT (23)..(23): Xaa is Ser or Arg
  VARIANT (25)..(25): Xaa is Lys, Asp, or Ala
  VARIANT (26)..(26): Xaa is Glu, Lys, Gly, or Asn
DXDHIXPQXFXXDXSIDNXVLXXSXXN

SEQ ID NO: 29 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 31 - RNA, 96 nt, Artificial Sequence
  gRNA
  misc_feature (1)..(20): a, c, u, g, unknown or other
  misc_feature (1)..(20): targeting domain
  misc_feature (21)..(32): first complementarity domain
  misc_feature (33)..(36): linking domain
  misc_feature (37)..(50): second complementarity domain
  misc_feature (51)..(62): proximal domain
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 47 nt, Artificial Sequence
  gRNA proximal and tail domains derived from S. pyogenes
aaggcuaguccguuaucaacuugaaaaaguggcaccgagucggugcu

SEQ ID NO: 33 - RNA, 49 nt, Artificial Sequence
  gRNA proximal and tail domains
aaggcuaguccguuaucaacuugaaaaaguggcaccgagucgguggugc

SEQ ID NO: 34 - RNA, 51 nt, Artificial Sequence
  gRNA proximal and tail domains
aaggcuaguccguuaucaacuugaaaaaguggcaccgagucggugcggauc

SEQ ID NO: 35 - RNA, 31 nt, Artificial Sequence
  gRNA proximal and tail domains
aaggcuaguccguuaucaacuugaaaaagug

SEQ ID NO: 36 - RNA, 18 nt, Artificial Sequence
  gRNA proximal and tail domains
aaggcuaguccguuauca

SEQ ID NO: 37 - RNA, 12 nt, Artificial Sequence
  gRNA proximal and tail domains
aaggcuaguccg

SEQ ID NO: 38 - RNA, 102 nt, Artificial Sequence
  Unimolecular gRNA derived from S. aureus
  misc_feature (1)..(20): n is a, c, g, or u
  misc_feature (1)..(20): Targeting domain
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 39 - RNA, 42 nt, Artificial
  Modular gRNA derived from S. pyogenes
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuaugcuguuuug

SEQ ID NO: 40 - RNA, 85 nt, Artificial Sequence
  Modular gRNA derived from S. pyogenes
  misc_feature (1)..(9): 5' extension domain
  misc_feature (10)..(33): Second complementarity domain
  misc_feature (34)..(45): Proximal domain
  misc_feature (46)..(85): Tail domain
ggaaccauucaaaacagcauagcaaguuaaaauaaggcuaguccguuaucaacuugaaaaaguggcaccgagucggugcuuuuuu

SEQ ID NO: 41 - RNA, 62 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguuuuagagcuagaaauagcaaguuaaaauaaggcuaguccg

SEQ ID NO: 42 - RNA, 102 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
  misc_feature (63)..(102): Tail domain
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 43 - RNA, 75 nt, Artificial Sequence
  Unimolecular gRNA derived from S. pyogenes
  misc_feature (1)..(20): Targeting domain
  misc_feature (1)..(20): a, c, u, g, unknown or other
  misc_feature (21)..(36): First complementarity domain
  misc_feature (37)..(40): Linking domain
  misc_feature (41)..(58): Second complementarity domain
  misc_feature (59)..(70): Proximal domain
  misc_feature (71)..(75): Tail domain
nnnnnnnnnnnnnnnnnnnnguuuuagagcuaugcugaaaagcauagcaaguuaaaauaaggcuaguccguuauc

SEQ ID NO: 44 - RNA, 87 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (43)..(46): Linking domain
  misc_feature (57)..(70): Second complementarity domain
  misc_feature (71)..(82): Proximal domain
  misc_feature (83)..(87): Tail domain
nnnnnnnnnnnnnnnnnnnnguuuuagagcuaugcuguuuuggaaacaaaacagcauagcaaguuaaaauaaggcuaguccguuauc

SEQ ID NO: 45 - RNA, 42 nt, Artificial Sequence
  Modular gRNA derived from S. thermophilus
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuguguuguuucg

SEQ ID NO: 46 - RNA, 78 nt, Artificial Sequence
  Modular gRNA derived from S. thermophilus
  misc_feature (1)..(3): 5' extension domain
  misc_feature (4)..(27): Second complementarity domain
  misc_feature (28)..(40): Proximal domain
  misc_feature (41)..(78): Tail domain
gggcgaaacaacacagcgaguuaaaauaaggcuuaguccguacucaacuugaaaagguggcaccgauucgguguuuuu

SEQ ID NO: 47 - RNA, 85 nt, Artificial Sequence
  Modular gRNA derived from S. pyogenes
gaaccauucaaaacagcauagcaaguuaaaauaaggcuaguccguuaucaacuugaaaaaguggcaccgagucggugcuuuuuuu

SEQ ID NO: 48 - RNA, 96 nt, Artificial Sequence
  gRNA from S. pyogenes
  misc_feature (1)..(20): n is a, c, g, or u
  misc_feature (1)..(20): Targeting domain
nnnnnnnnnnnnnnnnnnnnguuuuagagcuagaaauagcaaguuaaaauaaggcuaguccguuaucaacuugaaaaaguggcaccgagucggugc

SEQ ID NO: 49 - RNA, 96 nt, Artificial Sequence
  gRNA
  misc_feature (1)..(20): n is a, c, g, or u
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguauuagagcuagaaauagcaaguuaauauaaggcuaguccguuaucaacuugaaaaaguggcaccgagucggugc

SEQ ID NO: 50 - RNA, 104 nt, Artificial Sequence
  gRNA
  misc_feature (1)..(20): n is a, c, g, or u
  misc_feature (1)..(20): Targeting domain
  misc_feature (21)..(36): First complementarity domain
  misc_feature (37)..(40): Linking domain
  misc_feature (41)..(58): Second complementarity domain
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 51 - RNA, 106 nt, Artificial Sequence
  gRNA
  misc_feature (1)..(20): n is a, c, g, or u
  misc_feature (1)..(20): Targeting domain
  misc_feature (21)..(37): First complementarity domain
  misc_feature (38)..(41): Linking domain
  misc_feature (42)..(60): Second complementarity domain
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 52 - protein, 12 aa, Peptoniphilus duerdenii
DIGTASVGWAVT

SEQ ID NO: 53 - protein, 12 aa, Treponema denticola
DVGTGSVGWAVT

SEQ ID NO: 54 - protein, 12 aa, S. mutans
DIGTNSVGWAVV

SEQ ID NO: 55 - protein, 12 aa, S. pyogenes
DIGTNSVGWAVI

SEQ ID NO: 56 - protein, 12 aa, L. innocua
DIGTNSVGWAVL

SEQ ID NO: 57 - protein, 12 aa, Flavobacterium branchiophilum FL-15
DLGTNSIGWAVV

SEQ ID NO: 58 - protein, 11 aa, Artificial Sequence
  N-terminal RuvC-like domain
DLGTNSIGWAI

SEQ ID NO: 59 - protein, 12 aa, Bacteroides fragilis, NCTC 9343
DLGTNSIGWALV

SEQ ID NO: 60 - protein, 12 aa, Fusobacterium nucleatum
DIGTNSVGWCVT

SEQ ID NO: 61 - protein, 12 aa, Acidaminococcus sp. D21
DIGTNSVGYAVT

SEQ ID NO: 62 - protein, 12 aa, Coprococcus catus GD-7
DMGTGSLGWAVT

SEQ ID NO: 63 - protein, 12 aa, Oenococcus kitaharae DSM 17330
DIGTSSVGWAAI

SEQ ID NO: 64 - protein, 12 aa, Catenibacterium mitsuokai DSM 15897
DLGTGSVGWAVV

SEQ ID NO: 65 - protein, 12 aa, Mycoplasma gallisepticum str. F
DLGVGSVGWAIV

SEQ ID NO: 66 - protein, 12 aa, Mycoplasma ovipneumoniae SC01
DLGIASIGWAII

SEQ ID NO: 67 - protein, 12 aa, Mycoplasma canis PG 14
DLGIASVGWAIV

SEQ ID NO: 68 - protein, 12 aa, Mycoplasma synoviae 53
DLGVASVGWSIV

SEQ ID NO: 69 - protein, 12 aa, Eubacterium rectale
DIGIASVGWAIL

SEQ ID NO: 70 - protein, 12 aa, Enterococcus faecalis TX0012
DLGISSVGWSVI

SEQ ID NO: 71 - protein, 12 aa, Ilyobacter polytropus DSM 2926
DIGIASVGWSVI

SEQ ID NO: 72 - protein, 12 aa, Ruminococcus albus 8
DVGIGSIGWAVI

SEQ ID NO: 73 - protein, 12 aa, Elusimicrobium minutum Pei191
DLGVGSIGFAIV

SEQ ID NO: 74 - protein, 12 aa, Akkermansia muciniphila
DIGYASIGWAVI

SEQ ID NO: 75 - protein, 12 aa, Artificial Sequence
  N-terminal RuvC-like domain
DTGTNSLGWAIV

SEQ ID NO: 76 - protein, 12 aa, Cand. Puniceispirillum marinum
DLGTNSIGWCLL

SEQ ID NO: 77 - protein, 12 aa, Rhodospirillum rubrum
DIGTDSLGWAVF

SEQ ID NO: 78 - protein, 12 aa, Lactobacillus rhamnosus GG
DIGSNSIGFAVV

SEQ ID NO: 79 - protein, 12 aa, Sphaerochaeta globus str. Buddy
DLGVGSIGVAVA

SEQ ID NO: 80 - protein, 12 aa, Artificial Sequence
  N-terminal RuvC-like domain
DLGIASCGWGVV

SEQ ID NO: 81 - protein, 12 aa, Mycoplasma mobile 163K
DLGIASVGWCLT

SEQ ID NO: 82 - protein, 12 aa, Streptococcus thermophilus LMD-9
DIGIGSVGVGIL

SEQ ID NO: 83 - protein, 12 aa, Staphylococcus lugdunensis M23590
DIGITSVGYGLI

SEQ ID NO: 84 - protein, 12 aa, Eubacterium dolichum DSM 3991
DIGITSVGFGII

SEQ ID NO: 85 - protein, 12 aa, Lactobacillus coryniformis KCTC 3535
DVGITSTGYAVL

SEQ ID NO: 86 - protein, 12 aa, Nitratifractor salsuginis DSM 16511
DLGITSFGYAIL

SEQ ID NO: 87 - protein, 12 aa, Bifidobacterium bifidum S17
DIGNASVGWSAF

SEQ ID NO: 88 - protein, 12 aa, Artificial Sequence
  N-terminal RuvC-like domain
DVGTNSCGWVAM

SEQ ID NO: 89 - protein, 12 aa, Acidothermus cellulolyticus 11B
DVGERSIGLAAV

SEQ ID NO: 90 - protein, 12 aa, Bifidobacterium longum DJO10A
DVGLNSVGLAAV

SEQ ID NO: 91 - protein, 12 aa, Artificial Sequence
  N-terminal RuvC-like domain
DVGLMSVGLAAI

SEQ ID NO: 92 - protein, 12 aa, Artificial Sequence
  N-terminal RuvC-like domain
DVGTFSVGLAAI

SEQ ID NO: 93 - protein, 12 aa, Staphylococcus pseudintermedius ED99
DIGTGSVGYACM

SEQ ID NO: 94 - protein, 12 aa, Artificial Sequence
  N-terminal RuvC-like domain
DLGTTSIGFAHI

SEQ ID NO: 95 - protein, 12 aa, Artificial Sequence
  N-terminal RuvC-like domain
DLGTNSIGSSVR

SEQ ID NO: 96 - protein, 12 aa, Artificial Sequence
  N-terminal RuvC-like domain
DIGTNSIGWAVI

SEQ ID NO: 97 - protein, 12 aa, Pasteurella multocida str. Pm70
DLGIASVGWAVV

SEQ ID NO: 98 - protein, 12 aa, Artificial Sequence
  N-terminal RuvC-like domain
DIGIASVGWAVL

SEQ ID NO: 99 - protein, 12 aa, Helicobacter mustelae 12198
DIGIASIGWAVI

SEQ ID NO: 100 - protein, 12 aa, Artificial Sequence
  N-terminal RuvC-like domain
DIGIASVGWAII

SEQ ID NO: 101 - protein, 12 aa, Clostridium cellulolyticum H10
DVGIASVGWAVI

SEQ ID NO: 102 - protein, 11 aa, Artificial Sequence
  N-terminal RuvC-like domain
DIGIASVGWAL

SEQ ID NO: 103 - protein, 12 aa, Neisseria meningitidis
DIGIASVGWAMV

SEQ ID NO: 104 - protein, 12 aa, Artificial Sequence
  N-terminal RuvC-like domain
DIGITSVGWAVI

SEQ ID NO: 105 - protein, 12 aa, Wolinella succinogenes DSM 1740
DLGISSLGWAIV

SEQ ID NO: 106 - protein, 12 aa, Azospirillum sp. B510
DLGTNSIGWGLL

SEQ ID NO: 107 - protein, 12 aa, Artificial Sequence
  N-terminal RuvC-like domain
DLGSTSLGWAIF

SEQ ID NO: 108 - protein, 12 aa, Campylobacter jejuni, NCTC 11168
DIGISSIGWAFS

SEQ ID NO: 109 - protein, 12 aa, Parvibaculum lavamentivorans DS-1
DIGTTSIGFSVI

SEQ ID NO: 110 - protein, 12 aa, Dinoroseobacter shibae DFL 12
DIGTSSIGWWLY

SEQ ID NO: 111 - protein, 12 aa, Nitrobacter hamburgensis X14
DLGSNSLGWFVT

SEQ ID NO: 112 - protein, 12 aa, Bradyrhizobium sp. BTAi1
DLGANSLGWFVV

SEQ ID NO: 113 - protein, 15 aa, Artificial Sequence
  N-terminal RuvC-like domain
DIGLRIGITSCGWSI

SEQ ID NO: 114 - protein, 12 aa, Artificial Sequence
  N-terminal RuvC-like domain
DMGAKYTGVFYA

SEQ ID NO: 115 - protein, 12 aa, Wolinella succinogenes DSM 1740
DLGGKNTGFFSF

SEQ ID NO: 116 - protein, 12 aa, Artificial Sequence
  N-terminal RuvC-like domain
DLGVKNTGVFSA

SEQ ID NO: 117 - protein, 12 aa, Artificial Sequence
  N-terminal RuvC-like domain
DLGAKFTGVALY

SEQ ID NO: 118 - protein, 12 aa, Legionella pneumophila str. Paris
DLGGKFTGVCLS

SEQ ID NO: 119 - protein, 12 aa, Artificial Sequence
  N-terminal RuvC-like domain
DLGGTYTGTFIT

SEQ ID NO: 120 - protein, 12 aa, S. thermophilus
DIGTNSVGWAVT

SEQ ID NO: 121 - protein, 12 aa, Eubacterium yurii
DVGTNSVGWAVT

SEQ ID NO: 122 - protein, 12 aa, Artificial Sequence
  N-terminal RuvC-like domain
DMGTNSVGWAVT

SEQ ID NO: 123 - protein, 12 aa, Solobacterium moorei F0204
DVGTSSVGWAVT

SEQ ID NO: 124 - protein, 27 aa, Treponema denticola
DIDHIYPQSKIKDDSISNRVLVCSSCN

SEQ ID NO: 125 - protein, 27 aa, Coprococcus catus GD-7
DIDHIYPQSKTMDDSLNNRVLVKKNYN

SEQ ID NO: 126 - protein, 27 aa, Peptoniphilus duerdenii
DQDHIYPKSKIYDDSLENRVLVKKNLN

SEQ ID NO: 127 - protein, 27 aa, Catenibacterium mitsuokai DSM 15897
QIDHIVPQSLVKDDSFDNRVLVVPSEN

SEQ ID NO: 128 - protein, 27 aa, S. mutans
DIDHIIPQAFIKDNSIDNRVLTSSKEN

SEQ ID NO: 129 - protein, 27 aa, S. thermophilus
DIDHIIPQAFLKDNSIDNKVLVSSASN

SEQ ID NO: 130 - protein, 27 aa, Oenococcus kitaharae DSM 17330
DIDHIIPQAYTKDNSLDNRVLVSNITN

SEQ ID NO: 131 - protein, 27 aa, L. inocua
DIDHIVPQSFITDNSIDNLVLTSSAGN

SEQ ID NO: 132 - protein, 27 aa, S. pyogenes
DVDHIVPQSFLKDDSIDNKVLTRSDKN

SEQ ID NO: 133 - protein, 27 aa, Acidaminococcus sp. D21
NIDHIYPQSMVKDDSLDNKVLVQSEIN

SEQ ID NO: 134 - protein, 27 aa, Lactobacillus rhamnosus GG
DIDHILPQSLIKDDSLDNRVLVNATIN

SEQ ID NO: 135 - protein, 27 aa, Artificial Sequence
  HNH-LIKE domain
DIDHILPQSFIKDDSLENRVLVKKAVN

SEQ ID NO: 136 - protein, 27 aa, Staphylococcus pseudintermedius ED99
EVDHIFPRSFIKDDSIDNKVLVIKKMN

SEQ ID NO: 137 - protein, 27 aa, Artificial Sequence
  HNH-LIKE domain
EVDHIIPRSYIKDDSFENKVLVYREEN

SEQ ID NO: 138 - protein, 27 aa, Bifidobacterium bifidum S17
DIDHIIPQAVTQNDSIDNRVLVARAEN

SEQ ID NO: 139 - protein, 27 aa, Mycoplasma gallisepticum str. F
EIDHIIPYSISFDDSSSNKLLVLAESN

SEQ ID NO: 140 - protein, 27 aa, Mycoplasma canis PG 14
EIDHIIPYSLCFDDSSANKVLVHKQSN

SEQ ID NO: 141 - protein, 27 aa, Ilyobacter polytropus DSM 2926
DIDHIIPYSRSMDDSYSNKVLVLSGEN

SEQ ID NO: 142 - protein, 27 aa, Artificial Sequence
  HNH-LIKE domain
DIDHIIPYSKSMDDSFNNKVLCLAEEN

SEQ ID NO: 143 - protein, 27 aa, Campylobacter jejuni
EIDHIYPYSRSFDDSYMNKVLVFTKQN

SEQ ID NO: 144 - protein, 27 aa, Clostridium cellulolyticum H10
QIDHIYPYSRSMDDSYMNKVLVLTDEN

SEQ ID NO: 145 - protein, 27 aa, Artificial Sequence
  HNH-LIKE domain
EIDHIIPFSRSFDDSLSNKILVLGSEN

SEQ ID NO: 146 - protein, 27 aa, N. meningitides
EIDHALPFSRTWDDSFNNKVLVLGSEN

SEQ ID NO: 147 - protein, 27 aa, Pasteurella multocida str. Pm70
EIDHALPFSRTWDDSFNNKVLVLASEN

SEQ ID NO: 148 - protein, 27 aa, Enterococcus faecalis TX0012
EIDHIIPISISLDDSINNKVLVLSKAN

SEQ ID NO: 149 - protein, 27 aa, Eubacterium dolichum DSM 3991
EVDHIIPISISLDDSITNKVLVTHREN

SEQ ID NO: 150 - protein, 27 aa, Artificial Sequence
  HNH-LIKE domain
QVDHALPYSRSYDDSKNNKVLVLTHEN

SEQ ID NO: 151 - protein, 27 aa, Streptococcus thermophilus LMD-9
EVDHILPLSITFDDSLANKVLVYATAN

SEQ ID NO: 152 - protein, 27 aa, Eubacterium rectale
EIDHIIPRSISFDDARSNKVLVYRSEN

SEQ ID NO: 153 - protein, 27 aa, Staphylococcus lugdunensis M23590
EVDHIIPRSVSFDNSYHNKVLVKQSEN

SEQ ID NO: 154 - protein, 27 aa, Artificial Sequence
  HNH-LIKE domain
DIDHILPYSITFDDSFRNKVLVTSQEN

SEQ ID NO: 155 - protein, 27 aa, Wolinella succinogenes DSM 1740
EIDHILPRSRSADDSFANKVLCLARAN

SEQ ID NO: 156 - protein, 27 aa, Cand. Puniceispirillum marinum
EIEHLLPFSLTLDDSMANKTVCFRQAN

SEQ ID NO: 157 - protein, 27 aa, Azospirillum sp. B510
DIDHILPFSVSLDDSAANKVVCLREAN

SEQ ID NO: 158 - protein, 27 aa, Bradyrhizobium sp. BTAi1
DIDHLIPFSISWDDSAANKVVCMRYAN

SEQ ID NO: 159 - protein, 27 aa, Nitrobacter hamburgensis X14
DIDHILPVAMTLDDSPANKIICMRYAN

SEQ ID NO: 160 - protein, 27 aa, Artificial Sequence
  HNH-LIKE domain
DVDHILPYSRTLDDSFPNRTLCLREAN

SEQ ID NO: 161 - protein, 27 aa, Artificial Sequence
  HNH-LIKE domain
EIEHILPFSRTLDDSLNNRTVAMRRAN

SEQ ID NO: 162 - protein, 27 aa, Lactobacillus coryniformis KCTC 3535
EVDHIIPYSISWDDSYTNKVLTSAKCN

SEQ ID NO: 163 - protein, 27 aa, Artificial Sequence
  HNH-LIKE domain
QVDHILPWSRFGDDSYLNKTLCTARSN

SEQ ID NO: 164 - protein, 27 aa, Ralstonia syzygii R24
QVDHILPFSKTLDDSFANKVLAQHDAN

SEQ ID NO: 165 - protein, 27 aa, Helicobacter mustelae 12198
QIDHAFPLSRSLDDSQSNKVLCLTSSN

SEQ ID NO: 166 - protein, 27 aa, Mycoplasma mobile 163K
DIDHIVPRSISFDDSFSNLVIVNKLDN

SEQ ID NO: 167 - protein, 27 aa, Mycoplasma ovipneumoniae SC01
EIEHIIPYSMSYDNSQANKILTEKAEN

SEQ ID NO: 168 - protein, 27 aa, Mycoplasma synoviae 53
EIDHVIPYSKSADDSWFNKLLVKKSTN

SEQ ID NO: 169 - protein, 27 aa, Aminomonas paucivorans DSM 12260
EMDHILPYSRSLDNGWHNRVLVHGKDN

SEQ ID NO: 170 - protein, 27 aa, Ruminococcus albus 8
EVDHIVPYSLILDNTINNKALVYAEEN

SEQ ID NO: 171 - protein, 27 aa, Artificial Sequence
  HNH-LIKE domain
EIEHVIPQSLYFDDSFSNKVICEAEVN

SEQ ID NO: 172 - protein, 27 aa, Bacteroides fragilis, NCTC 9343
DIEHIIPQARLFDDSFSNKTLEARSVN

SEQ ID NO: 173 - protein, 27 aa, Artificial Sequence
  HNH-LIKE domain
EIEHIVPKARVFDDSFSNKTLTFHRIN

SEQ ID NO: 174 - protein, 28 aa, Finegoldia magna
DKDHIIPQSMKKDDSIINNLVLVNKNAN

SEQ ID NO: 175 - protein, 27 aa, Parvibaculum lavamentivorans DS-1
EVEHIWPRSRSFDNSPRNKTLCRKDVN

SEQ ID NO: 176 - protein, 27 aa, Artificial Sequence
  HNH-LIKE domain
IVNHIIPYNRSFDDTYHNRVLTLTETK

SEQ ID NO: 177 - protein, 27 aa, Artificial Sequence
  HNH-LIKE domain
DMEHTIPKSISFDNSDQNLTLCESYYN

SEQ ID NO: 178 - protein, 27 aa, Artificial Sequence
  HNH-LIKE domain
DIEHTIPRSAGGDSTKMNLTLCSSRFN

SEQ ID NO: 179 - protein, 27 aa, Artificial Sequence
  HNH-LIKE domain
DIEHTIPRSISQDNSQMNKTLCSLKFN

SEQ ID NO: 180 - protein, 27 aa, Rhodospirillum rubrum
DIDHVIPLARGGRDSLDNMVLCQSDAN

SEQ ID NO: 181 - protein, 27 aa, Elusimicrobium minutum Pei191
DIEHLFPIAESEDNGRNNLVISHSACN

SEQ ID NO: 182 - protein, 27 aa, Sphaerochaeta globus str. Buddy
DVDHIFPRDDTADNSYGNKVVAHRQCN

SEQ ID NO: 183 - protein, 27 aa, Nitratifractor salsuginis DSM 16511
DIEHIVPQSLGGLSTDYNTIVTLKSVN

SEQ ID NO: 184 - protein, 27 aa, Acidothermus cellulolyticus 11B
ELDHIVPRTDGGSNRHENLAITCGACN

SEQ ID NO: 185 - protein, 28 aa, Bifidobacterium longum DJO10A
EMDHIVPRKGVGSTNTRTNFAAVCAECN

SEQ ID NO: 186 - protein, 28 aa, Artificial Sequence
  HNH-LIKE domain
EMDHIVPRKGVGSTNTRVNLAAACAACN

SEQ ID NO: 187 - protein, 28 aa, Artificial Sequence
  HNH-LIKE domain
EMDHIVPRAGQGSTNTRENLVAVCHRCN

SEQ ID NO: 188 - protein, 33 aa, Artificial Sequence
  HNH-LIKE domain
EIDHILPRSLIKDARGIVFNAEPNLIYASSRGN

SEQ ID NO: 189 - protein, 33 aa, Artificial Sequence
  HNH-LIKE domain
EIDHIIPRSLTGRTKKTVFNSEANLIYCSSKGN

SEQ ID NO: 190 - protein, 33 aa, Artificial Sequence
  HNH-LIKE domain
EIDHIIPRSLTLKKSESIYNSEVNLIFVSAQGN

SEQ ID NO: 191 - protein, 33 aa, Legionella pneumophila str. Paris
EIDHIYPRSLSKKHFGVIFNSEVNLIYCSSQGN

SEQ ID NO: 192 - protein, 33 aa, Wolinella succinogenes DSM 1740
EIDHILPRSHTLKIYGTVFNPEGNLIYVHQKCN

SEQ ID NO: 193 - protein, 30 aa, Artificial Sequence
  HNH-LIKE domain
ELDHIIPRSHKKYGTLNDEANLICVTRGDN

SEQ ID NO: 194 - protein, 27 aa, Akkermansia muciniphila
ELEHIVPHSFRQSNALSSLVLTWPGVN

SEQ ID NO: 195 - protein, 27 aa, Solobacterium moorei F0204
DIDHIYPRSKIKDDSITNRVLVEKDIN

SEQ ID NO: 196 - protein, 28 aa, Veillonella atypica ACS-134-V-Col7a
YDIDHIYPRSLTKDDSFDNLVLCERTAN

SEQ ID NO: 197 - protein, 28 aa, Fusobacterium nucleatum
DIDHIYPRSKVIKDDSFDNLVLVLKNEN

SEQ ID NO: 198 - protein, 27 aa, Filifactor alocis
DRDHIYPQSKIKDDSIDNLVLVNKTYN

SEQ ID NO: 199 - DNA, 5 bp, S. thermophilus
  misc_feature (1)..(1): n is a, c, g, or t
  misc_feature (4)..(4): n is a, c, g, or t
nggng

SEQ ID NO: 200 - DNA, 7 bp, S. thermophilus
  misc_feature (1)..(2): n is a, c, g, or t
nnagaaw

SEQ ID NO: 201 - DNA, 4 bp, S. mutans
  misc_feature (1)..(1): n is a, c, g, or t
naar

SEQ ID NO: 202 - DNA, 5 bp, S. aureus
  misc_feature (1)..(2): n is a, c, g, or t
nngrr

SEQ ID NO: 203 - DNA, 6 bp, S. aureus
  misc_feature (1)..(2): n is a, c, g, or t
  misc_feature (6)..(6): n is a, c, g, or t
nngrrn

SEQ ID NO: 204 - DNA, 6 bp, Artificial Sequence
  Synthetic
  misc_feature (1)..(2): n is a, c, g, or t
nngrrt

SEQ ID NO: 205 - DNA, 6 bp, Artificial Sequence
  Synthetic
  misc_feature (1)..(2): n is a, c, g, or t
nngrrv

SEQ ID NO: 206 - DNA, 3255 bp, Staphylococcus aureus
atggccccaaagaagaagcggaaggtcggtatccacggagtcccagcagccaagcggaactacatcctgggcctggacatcggcatcaccagcgtgggctacggcatcatcgactacgagacacgggacgtgatcgatgccggcgtgcggctgttcaaagaggccaacgtggaaaacaacgagggcaggcggagcaagagaggcgccagaaggctgaagcggcggaggcggcatagaatccagagagtgaagaagctgctgttcgactacaacctgctgaccgaccacagcgagctgagcggcatcaacccctacgaggccagagtgaagggcctgagccagaagctgagcgaggaagagttctctgccgccctgctgcacctggccaagagaagaggcgtgcacaacgtgaacgaggtggaagaggacaccggcaacgagctgtccaccagagagcagatcagccggaacagcaaggccctggaagagaaatacgtggccgaactgcagctggaacggctgaagaaagacggcgaagtgcggggcagcatcaacagattcaagaccagcgactacgtgaaagaagccaaacagctgctgaaggtgcagaaggcctaccaccagctggaccagagcttcatcgacacctacatcgacctgctggaaacccggcggacctactatgagggacctggcgagggcagccccttcggctggaaggacatcaaagaatggtacgagatgctgatgggccactgcacctacttccccgaggaactgcggagcgtgaagtacgcctacaacgccgacctgtacaacgccctgaacgacctgaacaatctcgtgatcaccagggacgagaacgagaagctggaatattacgagaagttccagatcatcgagaacgtgttcaagcagaagaagaagcccaccctgaagcagatcgccaaagaaatcctcgtgaacgaagaggatattaagggctacagagtgaccagcaccggcaagcccgagttcaccaacctgaaggtgtaccacgacatcaaggacattaccgcccggaaagagattattgagaacgccgagctgctggatcagattgccaagatcctgaccatctaccagagcagcgaggacatccaggaagaactgaccaatctgaactccgagctgacccaggaagagatcgagcagatctctaatctgaagggctataccggcacccacaacctgagcctgaaggccatcaacctgatcctggacgagctgtggcacaccaacgacaaccagatcgctatcttcaaccggctgaagctggtgcccaagaaggtggacctgtcccagcagaaagagatccccaccaccctggtggacgacttcatcctgagccccgtcgtgaagagaagcttcatccagagcatcaaagtgatcaacgccatcatcaagaagtacggcctgcccaacgacatcattatcgagctggcccgcgagaagaactccaaggacgcccagaaaatgatcaacgagatgcagaagcggaaccggcagaccaacgagcggatcgaggaaatcatccggaccaccggcaaagagaacgccaagtacctgatcgagaagatcaagctgcacgacatgcaggaaggcaagtgcctgtacagcctggaagccatccctctggaagatctgctgaacaaccccttcaactatgaggtggaccacatcatccccagaagcgtgtccttcgacaacagcttcaacaacaaggtgctcgtgaagcaggaagaaaacagcaagaagggcaaccggaccccattccagtacctgagcagcagcgacagcaagatcagctacgaaaccttcaagaagcacatcctgaatctggccaagggcaagggcagaatcagcaagaccaagaaagagtatctgctggaagaacgggacatcaacaggttctccgtgcagaaagacttcatcaaccggaacctggtggataccagatacgccaccagaggcctgatgaacctgctgcggagctacttcagagtgaacaacctggacgtgaaagtgaagtccatcaatggcggcttcaccagctttctgcggcggaagtggaagtttaagaaagagcggaacaaggggtacaagcaccacgccgaggacgccctgatcattgccaacgccgatttcatcttcaaagagtggaagaaactggacaaggccaaaaaagtgatggaaaaccagatgttcgaggaaaggcaggccgagagcatgcccgagatcgaaaccgagcaggagtacaaagagatcttcatcaccccccaccagatcaagcacattaaggacttcaaggactacaagtacagccaccgggtggacaagaagcctaatagagagctgattaacgacaccctgtactccacccggaaggacgacaagggcaacaccctgatcgtgaacaatctgaacggcctgtacgacaaggacaatgacaagctgaaaaagctgatcaacaagagccccgaaaagctgctgatgtaccaccacgacccccagacctaccagaaactgaagctgattatggaacagtacggcgacgagaagaatcccctgtacaagtactacgaggaaaccgggaactacctgaccaagtactccaaaaaggacaacggccccgtgatcaagaagattaagtattacggcaacaaactgaacgcccatctggacatcaccgacgactaccccaacagcagaaacaaggtcgtgaagctgtccctgaagccctacagattcgacgtgtacctggacaatggcgtgtacaagttcgtgaccgtgaagaatctggatgtgatcaaaaaagaaaactactacgaagtgaatagcaagtgctatgaggaagctaagaagctgaagaagatcagcaaccaggccgagtttatcgcctccttctacaacaacgatctgatcaagatcaacggcgagctgtatagagtgatcggcgtgaacaacgacctgctgaaccggatcgaagtgaacatgatcgacatcacctaccgcgagtacctggaaaacatgaacgacaagaggccccccaggatcattaagacaatcgcctccaagacccagagcattaagaagtacagcacagacattctgggcaacctgtatgaagtgaaatctaagaagcaccctcagatcatcaaaaagggcaaaaggccggcggccacgaaaaaggccggccaggcaaaaaagaaaaag

SEQ ID NO: 207 - DNA, 3242 bp, Staphylococcus aureus
accggtgccaccatgtacccatacgatgttccagattacgcttcgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatcttacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggctaagaattc

SEQ ID NO: 208 - RNA, 17 nt, Artificial Sequence
  Synthetic
gacgacgcccggcggga

SEQ ID NO: 209 - RNA, 17 nt, Artificial Sequence
  Synthetic
gagccgacgacgaugac

SEQ ID NO: 210 - RNA, 17 nt, Artificial Sequence
  Synthetic
gacgcagccgacgccgc

SEQ ID NO: 211 - RNA, 17 nt, Artificial Sequence
  Synthetic
gcuacgcggcgcguauc

SEQ ID NO: 212 - RNA, 17 nt, Artificial Sequence
  Synthetic
gcccagaccgcgacgag

SEQ ID NO: 213 - RNA, 17 nt, Artificial Sequence
  Synthetic
ggauacgcgccgcguag

SEQ ID NO: 214 - RNA, 17 nt, Artificial Sequence
  Synthetic
gggcaccgacgccggcg

SEQ ID NO: 215 - RNA, 17 nt, Artificial Sequence
  Synthetic
gucgcggucugggcucg

SEQ ID NO: 216 - RNA, 17 nt, Artificial Sequence
  Synthetic
gggccccccgcucgucg

SEQ ID NO: 217 - RNA, 17 nt, Artificial Sequence
  Synthetic
gggcgucgucgaggucg

SEQ ID NO: 218 - RNA, 17 nt, Artificial Sequence
  Synthetic
gucgucggcucgaaagg

SEQ ID NO: 219 - RNA, 17 nt, Artificial Sequence
  Synthetic
gucggugcccgccgcgg

SEQ ID NO: 220 - RNA, 17 nt, Artificial Sequence
  Synthetic
gucggcucgaaaggcgg

SEQ ID NO: 221 - RNA, 17 nt, Artificial Sequence
  Synthetic
gcgacaggcgguccgug

SEQ ID NO: 222 - RNA, 17 nt, Artificial Sequence
  Synthetic
gcgucgucgaggucgug

SEQ ID NO: 223 - RNA, 17 nt, Artificial Sequence
  Synthetic
gacgagcggggggcccu

SEQ ID NO: 224 - RNA, 17 nt, Artificial Sequence
  Synthetic
ggcgacaggcgguccgu

SEQ ID NO: 225 - RNA, 17 nt, Artificial Sequence
  Synthetic
guccccgucaucgucgu

SEQ ID NO: 226 - RNA, 17 nt, Artificial Sequence
  Synthetic
ggcgucgucgaggucgu

SEQ ID NO: 227 - RNA, 17 nt, Artificial Sequence
  Synthetic
ggcggcggcccgucggu

SEQ ID NO: 228 - RNA, 20 nt, Artificial Sequence
  Synthetic
gucaucgucgucggcucgaa

SEQ ID NO: 229 - RNA, 20 nt, Artificial Sequence
  Synthetic
gggcgucgggaucguccgga

SEQ ID NO: 230 - RNA, 20 nt, Artificial Sequence
  Synthetic
gcuccccgggccccaccgac

SEQ ID NO: 231 - RNA, 20 nt, Artificial Sequence
  Synthetic
gcggcccgucgguggggccc

SEQ ID NO: 232 - RNA, 20 nt, Artificial Sequence
  Synthetic
gagcccagaccgcgacgagc

SEQ ID NO: 233 - RNA, 20 nt, Artificial Sequence
  Synthetic
gacgacgcagccgacgccgc

SEQ ID NO: 234 - RNA, 20 nt, Artificial Sequence
  Synthetic
guccggggcggcgaggccgc

SEQ ID NO: 235 - RNA, 20 nt, Artificial Sequence
  Synthetic
gacgggagggcccccgcggc

SEQ ID NO: 236 - RNA, 20 nt, Artificial Sequence
  Synthetic
gccgcgacagcuggcucugc

SEQ ID NO: 237 - RNA, 20 nt, Artificial Sequence
  Synthetic
gcgacgagcggggggcccuc

SEQ ID NO: 238 - RNA, 20 nt, Artificial Sequence
  Synthetic
gcucgucgcggucugggcuc

SEQ ID NO: 239 - RNA, 20 nt, Artificial Sequence
  Synthetic
ggucgggcgucgggaucguc

SEQ ID NO: 240 - RNA, 20 nt, Artificial Sequence
  Synthetic
gccccccgcucgucgcgguc

SEQ ID NO: 241 - RNA, 20 nt, Artificial Sequence
  Synthetic
gacaggcgguccgugggguc

SEQ ID NO: 242 - RNA, 20 nt, Artificial Sequence
  Synthetic
gaucccgacgcccgaccccg

SEQ ID NO: 243 - RNA, 20 nt, Artificial Sequence
  Synthetic
gcgcggcgacaggcgguccg

SEQ ID NO: 244 - RNA, 20 nt, Artificial Sequence
  Synthetic
gcucgaaaggcggggguccg

SEQ ID NO: 245 - RNA, 20 nt, Artificial Sequence
  Synthetic
gccgggcgucgucgaggucg

SEQ ID NO: 246 - RNA, 20 nt, Artificial Sequence
  Synthetic
gccagcagagccagcugucg

SEQ ID NO: 247 - RNA, 20 nt, Artificial Sequence
  Synthetic
guagcggggccucccguucg

SEQ ID NO: 248 - RNA, 20 nt, Artificial Sequence
  Synthetic
gcccagaccgcgacgagcgg

SEQ ID NO: 249 - RNA, 20 nt, Artificial Sequence
  Synthetic
ggcgucggugcccgccgcgg

SEQ ID NO: 250 - RNA, 20 nt, Artificial Sequence
  Synthetic
gucgucggcucgaaaggcgg

SEQ ID NO: 251 - RNA, 20 nt, Artificial Sequence
  Synthetic
gacggccuccucuaccaugg

SEQ ID NO: 252 - RNA, 20 nt, Artificial Sequence
  Synthetic
gggcgucgucgaggucgugg

SEQ ID NO: 253 - RNA, 20 nt, Artificial Sequence
  Synthetic
gcggcgacaggcgguccgug

SEQ ID NO: 254 - RNA, 20 nt, Artificial Sequence
  Synthetic
ggcccggucgccggcggcgu

SEQ ID NO: 255 - RNA, 17 nt, Artificial Sequence
  Synthetic
aucgucgucggcucgaa

SEQ ID NO: 256 - RNA, 17 nt, Artificial Sequence
  Synthetic
cgcguauccggacccca

SEQ ID NO: 257 - RNA, 17 nt, Artificial Sequence
  Synthetic
cagcugucgcggcgaga

SEQ ID NO: 258 - RNA, 17 nt, Artificial Sequence
  Synthetic
cgucgggaucguccgga

SEQ ID NO: 259 - RNA, 17 nt, Artificial Sequence
  Synthetic
cgagccgacgacgauga

SEQ ID NO: 260 - RNA, 17 nt, Artificial Sequence
  Synthetic
cgacgccgccggcgacc

SEQ ID NO: 261 - RNA, 17 nt, Artificial Sequence
  Synthetic
cucccguucgcggcccc

SEQ ID NO: 262 - RNA, 17 nt, Artificial Sequence
  Synthetic
ccucccguucgcggccc

SEQ ID NO: 263 - RNA, 17 nt, Artificial Sequence
  Synthetic
cggcgagacggcguccc

SEQ ID NO: 264 - RNA, 17 nt, Artificial Sequence
  Synthetic
acgaccucgacgacgcc

SEQ ID NO: 265 - RNA, 17 nt, Artificial Sequence
  Synthetic
ucgaaaggcgggggucc

SEQ ID NO: 266 - RNA, 17 nt, Artificial Sequence
  Synthetic
cccagaccgcgacgagc

SEQ ID NO: 267 - RNA, 17 nt, Artificial Sequence
  Synthetic
ucgucggcucgaaaggc

SEQ ID NO: 268 - RNA, 17 nt, Artificial Sequence
  Synthetic
ccucgacgacgcccggc

SEQ ID NO: 269 - RNA, 17 nt, Artificial Sequence
  Synthetic
acgagcggggggcccuc

SEQ ID NO: 270 - RNA, 17 nt, Artificial Sequence
  Synthetic
cgucgcggucugggcuc

SEQ ID NO: 271 - RNA, 17 nt, Artificial Sequence
  Synthetic
cgggcgucgggaucguc

SEQ ID NO: 272 - RNA, 17 nt, Artificial Sequence
  Synthetic
ccccgcucgucgcgguc

SEQ ID NO: 273 - RNA, 17 nt, Artificial Sequence
  Synthetic
cucgaaaggcggggguc

SEQ ID NO: 274 - RNA, 17 nt, Artificial Sequence
  Synthetic
aggcgguccgugggguc

SEQ ID NO: 275 - RNA, 17 nt, Artificial Sequence
  Synthetic
agccgacgacgaugacg

SEQ ID NO: 276 - RNA, 17 nt, Artificial Sequence
  Synthetic
cgggaggccccgcuacg

SEQ ID NO: 277 - RNA, 17 nt, Artificial Sequence
  Synthetic
cggcgacaggcgguccg

SEQ ID NO: 278 - RNA, 17 nt, Artificial Sequence
  Synthetic
cgaaaggcggggguccg

SEQ ID NO: 279 - RNA, 17 nt, Artificial Sequence
  Synthetic
ccagaccgcgacgagcg

SEQ ID NO: 280 - RNA, 17 nt, Artificial Sequence
  Synthetic
auacgcgccgcguagcg

SEQ ID NO: 281 - RNA, 17 nt, Artificial Sequence
  Synthetic
cgucggcucgaaaggcg

SEQ ID NO: 282 - RNA, 17 nt, Artificial Sequence
  Synthetic
cccgccgggcgucgucg

SEQ ID NO: 283 - RNA, 17 nt, Artificial Sequence
  Synthetic
accucgacgacgcccgg

SEQ ID NO: 284 - RNA, 17 nt, Artificial Sequence
  Synthetic
cagaccgcgacgagcgg

SEQ ID NO: 285 - RNA, 17 nt, Artificial Sequence
  Synthetic
agaccgcgacgagcggg

SEQ ID NO: 286 - RNA, 17 nt, Artificial Sequence
  Synthetic
cgucgaggucguggggg

SEQ ID NO: 287 - RNA, 17 nt, Artificial Sequence
  Synthetic
cgucgucgaggucgugg

SEQ ID NO: 288 - RNA, 17 nt, Artificial Sequence
  Synthetic
ucgucgcggucugggcu

SEQ ID NO: 289 - RNA, 17 nt, Artificial Sequence
  Synthetic
cccgcucgucgcggucu

SEQ ID NO: 290 - RNA, 17 nt, Artificial Sequence
  Synthetic
ccggucgccggcggcgu

SEQ ID NO: 291 - RNA, 20 nt, Artificial Sequence
  Synthetic
ccggacggccuccucuacca

SEQ ID NO: 292 - RNA, 20 nt, Artificial Sequence
  Synthetic
cggcgcguauccggacccca

SEQ ID NO: 293 - RNA, 20 nt, Artificial Sequence
  Synthetic
agccagcugucgcggcgaga

SEQ ID NO: 294 - RNA, 20 nt, Artificial Sequence
  Synthetic
ccucggguggggcgcggaga

SEQ ID NO: 295 - RNA, 20 nt, Artificial Sequence
  Synthetic
cgucuccgcgccccacccga

SEQ ID NO: 296 - RNA, 20 nt, Artificial Sequence
  Synthetic
uuucgagccgacgacgauga

SEQ ID NO: 297 - RNA, 20 nt, Artificial Sequence
  Synthetic
ucgacgacgcccggcgggac

SEQ ID NO: 298 - RNA, 20 nt, Artificial Sequence
  Synthetic
uucgagccgacgacgaugac

SEQ ID NO: 299 - RNA, 20 nt, Artificial Sequence
  Synthetic
agccgacgccgccggcgacc

SEQ ID NO: 300 - RNA, 20 nt, Artificial Sequence
  Synthetic
ucggagaacaagcagcgccc

SEQ ID NO: 301 - RNA, 20 nt, Artificial Sequence
  Synthetic
ucgcggcgagacggcguccc

SEQ ID NO: 302 - RNA, 20 nt, Artificial Sequence
  Synthetic
cccacgaccucgacgacgcc

SEQ ID NO: 303 - RNA, 20 nt, Artificial Sequence
  Synthetic
cgccgucucgccgcgacagc

SEQ ID NO: 304 - RNA, 20 nt, Artificial Sequence
  Synthetic
ccggauacgcgccgcguagc

SEQ ID NO: 305 - RNA, 20 nt, Artificial Sequence
  Synthetic
accgacgccggcgaggacgc

SEQ ID NO: 306 - RNA, 20 nt, Artificial Sequence
  Synthetic
ucgucgucggcucgaaaggc

SEQ ID NO: 307 - RNA, 20 nt, Artificial Sequence
  Synthetic
cccgcuacgcggcgcguauc

SEQ ID NO: 308 - RNA, 20 nt, Artificial Sequence
  Synthetic
aggccgcggggucgggcguc

SEQ ID NO: 309 - RNA, 20 nt, Artificial Sequence
  Synthetic
cggcucgaaaggcggggguc

SEQ ID NO: 310 - RNA, 20 nt, Artificial Sequence
  Synthetic
cgagcccagaccgcgacgag

SEQ ID NO: 311 - RNA, 20 nt, Artificial Sequence
  Synthetic
uccggauacgcgccgcguag

SEQ ID NO: 312 - RNA, 20 nt, Artificial Sequence
  Synthetic
ucgagccgacgacgaugacg

SEQ ID NO: 313 - RNA, 20 nt, Artificial Sequence
  Synthetic
ccgucuccgcgccccacccg

SEQ ID NO: 314 - RNA, 20 nt, Artificial Sequence
  Synthetic
cgacgccggcgaggacgccg

SEQ ID NO: 315 - RNA, 20 nt, Artificial Sequence
  Synthetic
agcccagaccgcgacgagcg

SEQ ID NO: 316 - RNA, 20 nt, Artificial Sequence
  Synthetic
cggauacgcgccgcguagcg

SEQ ID NO: 317 - RNA, 20 nt, Artificial Sequence
  Synthetic
uccggggcggcgaggccgcg

SEQ ID NO: 318 - RNA, 20 nt, Artificial Sequence
  Synthetic
cgucgucggcucgaaaggcg

SEQ ID NO: 319 - RNA, 20 nt, Artificial Sequence
  Synthetic
cucgucgcggucugggcucg

SEQ ID NO: 320 - RNA, 20 nt, Artificial Sequence
  Synthetic
cgagggccccccgcucgucg

SEQ ID NO: 321 - RNA, 20 nt, Artificial Sequence
  Synthetic
cgucccgccgggcgucgucg

SEQ ID NO: 322 - RNA, 20 nt, Artificial Sequence
  Synthetic
aucgucgucggcucgaaagg

SEQ ID NO: 323 - RNA, 20 nt, Artificial Sequence
  Synthetic
cggguggggcgcggagacgg

SEQ ID NO: 324 - RNA, 20 nt, Artificial Sequence
  Synthetic
acgaccucgacgacgcccgg

SEQ ID NO: 325 - RNA, 20 nt, Artificial Sequence
  Synthetic
cccagaccgcgacgagcggg

SEQ ID NO: 326 - RNA, 20 nt, Artificial Sequence
  Synthetic
acgagcggggggcccucggg

SEQ ID NO: 327 - RNA, 20 nt, Artificial Sequence
  Synthetic
cgucgucgaggucguggggg

SEQ ID NO: 328 - RNA, 20 nt, Artificial Sequence
  Synthetic
cgggcgucgucgaggucgug

SEQ ID NO: 329 - RNA, 20 nt, Artificial Sequence
  Synthetic
cgcgacgagcggggggcccu

SEQ ID NO: 330 - RNA, 20 nt, Artificial Sequence
  Synthetic
ccccccgcucgucgcggucu

SEQ ID NO: 331 - RNA, 20 nt, Artificial Sequence
  Synthetic
cgcggcgacaggcgguccgu

SEQ ID NO: 332 - RNA, 20 nt, Artificial Sequence
  Synthetic
cucguccccgucaucgucgu

SEQ ID NO: 333 - RNA, 20 nt, Artificial Sequence
  Synthetic
ccgggcgucgucgaggucgu

SEQ ID NO: 334 - RNA, 17 nt, Artificial Sequence
  Synthetic
gacggccuccucuacca

SEQ ID NO: 335 - RNA, 17 nt, Artificial Sequence
  Synthetic
ggcucugcuggccucca

SEQ ID NO: 336 - RNA, 17 nt, Artificial Sequence
  Synthetic
ggcgcggagacggagga

SEQ ID NO: 337 - RNA, 17 nt, Artificial Sequence
  Synthetic
ggcccggggccgcgaac

SEQ ID NO: 338 - RNA, 17 nt, Artificial Sequence
  Synthetic
gagaacaagcagcgccc

SEQ ID NO: 339 - RNA, 17 nt, Artificial Sequence
  Synthetic
gcccgucgguggggccc

SEQ ID NO: 340 - RNA, 17 nt, Artificial Sequence
  Synthetic
gcagcgccccggcuccc

SEQ ID NO: 341 - RNA, 17 nt, Artificial Sequence
  Synthetic
guggggcccggggagcc

SEQ ID NO: 342 - RNA, 17 nt, Artificial Sequence
  Synthetic
ggcccucccgucccgcc

SEQ ID NO: 343 - RNA, 17 nt, Artificial Sequence
  Synthetic
gcgaccgggccccggcc

SEQ ID NO: 344 - RNA, 17 nt, Artificial Sequence
  Synthetic
guucgcggccccgggcc

SEQ ID NO: 345 - RNA, 17 nt, Artificial Sequence
  Synthetic
ggccccgggccggggcc

SEQ ID NO: 346 - RNA, 17 nt, Artificial Sequence
  Synthetic
ggcccgucgguggggcc

SEQ ID NO: 347 - RNA, 17 nt, Artificial Sequence
  Synthetic
gguggggcccggggagc

SEQ ID NO: 348 - RNA, 17 nt, Artificial Sequence
  Synthetic
gauacgcgccgcguagc

SEQ ID NO: 349 - RNA, 17 nt, Artificial Sequence
  Synthetic
gcggcgggcaccgacgc

SEQ ID NO: 350 - RNA, 17 nt, Artificial Sequence
  Synthetic
gacgccggcgaggacgc

SEQ ID NO: 351 - RNA, 17 nt, Artificial Sequence
  Synthetic
gggcccucccgucccgc

SEQ ID NO: 352 - RNA, 17 nt, Artificial Sequence
  Synthetic
gcgucggugcccgccgc

SEQ ID NO: 353 - RNA, 17 nt, Artificial Sequence
  Synthetic
guccccggcguccucgc

SEQ ID NO: 354 - RNA, 17 nt, Artificial Sequence
  Synthetic
ggccggggcccggucgc

SEQ ID NO: 355 - RNA, 17 nt, Artificial Sequence
  Synthetic
gcggcggcugggccggc

SEQ ID NO: 356 - RNA, 17 nt, Artificial Sequence
  Synthetic
gggagggcccccgcggc

SEQ ID NO: 357 - RNA, 17 nt, Artificial Sequence
  Synthetic
gcgacagcuggcucugc

SEQ ID NO: 358 - RNA, 17 nt, Artificial Sequence
  Synthetic
ggcgaggccgcgggguc

SEQ ID NO: 359 - RNA, 17 nt, Artificial Sequence
  Synthetic
gcuggccuccaugguag

SEQ ID NO: 360 - RNA, 17 nt, Artificial Sequence
  Synthetic
ggacgggagggcccccg

SEQ ID NO: 361 - RNA, 17 nt, Artificial Sequence
  Synthetic
gaccgggccccggcccg

SEQ ID NO: 362 - RNA, 17 nt, Artificial Sequence
  Synthetic
ggcgucggugcccgccg

SEQ ID NO: 363 - RNA, 17 nt, Artificial Sequence
  Synthetic
ggggcggcgaggccgcg

SEQ ID NO: 364 - RNA, 17 nt, Artificial Sequence
  Synthetic
ggggguccggggcggcg

SEQ ID NO: 365 - RNA, 17 nt, Artificial Sequence
  Synthetic
ggagacggaggagggcg

SEQ ID NO: 366 - RNA, 17 nt, Artificial Sequence
  Synthetic
ggcugggccggcgggcg

SEQ ID NO: 367 - RNA, 17 nt, Artificial Sequence
  Synthetic
ggcccucggguggggcg

SEQ ID NO: 368 - RNA, 17 nt, Artificial Sequence
  Synthetic
ggggguggucggggucg

SEQ ID NO: 369 - RNA, 17 nt, Artificial Sequence
  Synthetic
ggucggggucguggucg

SEQ ID NO: 370 - RNA, 17 nt, Artificial Sequence
  Synthetic
ggucguggggguggucg

SEQ ID NO: 371 - RNA, 17 nt, Artificial Sequence
  Synthetic
gcggggccucccguucg

SEQ ID NO: 372 - RNA, 17 nt, Artificial Sequence
  Synthetic
gcgggcgcggcgacagg

SEQ ID NO: 373 - RNA, 17 nt, Artificial Sequence
  Synthetic
ggccuccaugguagagg

SEQ ID NO: 374 - RNA, 17 nt, Artificial Sequence
  Synthetic
gggcgcggagacggagg

SEQ ID NO: 375 - RNA, 17 nt, Artificial Sequence
  Synthetic
guggggcgcggagacgg

SEQ ID NO: 376 - RNA, 17 nt, Artificial Sequence
  Synthetic
gggcucggggugggcgg

SEQ ID NO: 377 - RNA, 17 nt, Artificial Sequence
  Synthetic
gggcggcggcccgucgg

SEQ ID NO: 378 - RNA, 17 nt, Artificial Sequence
  Synthetic
gcggagacggaggaggg

SEQ ID NO: 379 - RNA, 17 nt, Artificial Sequence
  Synthetic
gcggucugggcucgggg

SEQ ID NO: 380 - RNA, 17 nt, Artificial Sequence
  Synthetic
ggccuccucuaccaugg

SEQ ID NO: 381 - RNA, 17 nt, Artificial Sequence
  Synthetic
gcggcggcccgucggug

SEQ ID NO: 382 - RNA, 17 nt, Artificial Sequence
  Synthetic
ggugggcggcggcccgu

SEQ ID NO: 383 - RNA, 17 nt, Artificial Sequence
  Synthetic
ggcguccucgccggcgu

SEQ ID NO: 384 - RNA, 17 nt, Artificial Sequence
  Synthetic
gccgcggggucgggcgu

SEQ ID NO: 385 - RNA, 17 nt, Artificial Sequence
  Synthetic
gcggggggcccucgggu

SEQ ID NO: 386 - RNA, 17 nt, Artificial Sequence
  Synthetic
guggucggggucguggu

SEQ ID NO: 387 - RNA, 17 nt, Artificial Sequence
  Synthetic
gaggucguggggguggu

SEQ ID NO: 388 - RNA, 20 nt, Artificial Sequence
  Synthetic
gcuggcucugcuggccucca

SEQ ID NO: 389 - RNA, 20 nt, Artificial Sequence
  Synthetic
ggcuccccgggccccaccga

SEQ ID NO: 390 - RNA, 20 nt, Artificial Sequence
  Synthetic
gggccggcgggcgcggcgac

SEQ ID NO: 391 - RNA, 20 nt, Artificial Sequence
  Synthetic
ggccucccguucgcggcccc

SEQ ID NO: 392 - RNA, 20 nt, Artificial Sequence
  Synthetic
gggccucccguucgcggccc

SEQ ID NO: 393 - RNA, 20 nt, Artificial Sequence
  Synthetic
gggggcccucccgucccgcc

SEQ ID NO: 394 - RNA, 20 nt, Artificial Sequence
  Synthetic
ggcggcccgucgguggggcc

SEQ ID NO: 395 - RNA, 20 nt, Artificial Sequence
  Synthetic
ggcucgaaaggcgggggucc

SEQ ID NO: 396 - RNA, 20 nt, Artificial Sequence
  Synthetic
gucgguggggcccggggagc

SEQ ID NO: 397 - RNA, 20 nt, Artificial Sequence
  Synthetic
ggcguccccggcguccucgc

SEQ ID NO: 398 - RNA, 20 nt, Artificial Sequence
  Synthetic
gcgcggagacggaggagggc

SEQ ID NO: 399 - RNA, 20 nt, Artificial Sequence
  Synthetic
ggcggcgaggccgcgggguc

SEQ ID NO: 400 - RNA, 20 nt, Artificial Sequence
  Synthetic
ggguggucggggucgugguc

SEQ ID NO: 401 - RNA, 20 nt, Artificial Sequence
  Synthetic
gaacgggaggccccgcuacg

SEQ ID NO: 402 - RNA, 20 nt, Artificial Sequence
  Synthetic
gcgggacgggagggcccccg

SEQ ID NO: 403 - RNA, 20 nt, Artificial Sequence
  Synthetic
ggcgaccgggccccggcccg

SEQ ID NO: 404 - RNA, 20 nt, Artificial Sequence
  Synthetic
gccggcgucggugcccgccg

SEQ ID NO: 405 - RNA, 20 nt, Artificial Sequence
  Synthetic
gcccgccggcccagccgccg

SEQ ID NO: 406 - RNA, 20 nt, Artificial Sequence
  Synthetic
gguccggggcggcgaggccg

SEQ ID NO: 407 - RNA, 20 nt, Artificial Sequence
  Synthetic
ggcgggcaccgacgccggcg

SEQ ID NO: 408 - RNA, 20 nt, Artificial Sequence
  Synthetic
ggcggggguccggggcggcg

SEQ ID NO: 409 - RNA, 20 nt, Artificial Sequence
  Synthetic
ggcggcugggccggcgggcg

SEQ ID NO: 410 - RNA, 20 nt, Artificial Sequence
  Synthetic
gggggcccucggguggggcg

SEQ ID NO: 411 - RNA, 20 nt, Artificial Sequence
  Synthetic
gguggucggggucguggucg

SEQ ID NO: 412 - RNA, 20 nt, Artificial Sequence
  Synthetic
gcuggccuccaugguagagg

SEQ ID NO: 413 - RNA, 20 nt, Artificial Sequence
  Synthetic
guggggcgcggagacggagg

SEQ ID NO: 414 - RNA, 20 nt, Artificial Sequence
  Synthetic
ggccggggcccggucgccgg

SEQ ID NO: 415 - RNA, 20 nt, Artificial Sequence
  Synthetic
ggacgggagggcccccgcgg

SEQ ID NO: 416 - RNA, 20 nt, Artificial Sequence
  Synthetic
ggugggcggcggcccgucgg

SEQ ID NO: 417 - RNA, 20 nt, Artificial Sequence
  Synthetic
ggcgcggagacggaggaggg

SEQ ID NO: 418 - RNA, 20 nt, Artificial Sequence
  Synthetic
ggcccggggccgcgaacggg

SEQ ID NO: 419 - RNA, 20 nt, Artificial Sequence
  Synthetic
gucgcggucugggcucgggg

SEQ ID NO: 420 - RNA, 20 nt, Artificial Sequence
  Synthetic
gagcggggggcccucgggug

SEQ ID NO: 421 - RNA, 20 nt, Artificial Sequence
  Synthetic
gaggccgcggggucgggcgu

SEQ ID NO: 422 - RNA, 20 nt, Artificial Sequence
  Synthetic
gugggcggcggcccgucggu

SEQ ID NO: 423 - RNA, 20 nt, Artificial Sequence
  Synthetic
gggcggcgaggccgcggggu

SEQ ID NO: 424 - RNA, 20 nt, Artificial Sequence
  Synthetic
gggguggucggggucguggu

SEQ ID NO: 425 - RNA, 20 nt, Artificial Sequence
  Synthetic
gucgaggucguggggguggu

SEQ ID NO: 426 - RNA, 17 nt, Artificial Sequence
  Synthetic
cggcccggggccgcgaa

SEQ ID NO: 427 - RNA, 17 nt, Artificial Sequence
  Synthetic
cggguggggcgcggaga

SEQ ID NO: 428 - RNA, 17 nt, Artificial Sequence
  Synthetic
uccccgggccccaccga

SEQ ID NO: 429 - RNA, 17 nt, Artificial Sequence
  Synthetic
cuccgcgccccacccga

SEQ ID NO: 430 - RNA, 17 nt, Artificial Sequence
  Synthetic
cgcccggcgggacggga

SEQ ID NO: 431 - RNA, 17 nt, Artificial Sequence
  Synthetic
ccccgggccccaccgac

SEQ ID NO: 432 - RNA, 17 nt, Artificial Sequence
  Synthetic
ccgacgccgccggcgac

SEQ ID NO: 433 - RNA, 17 nt, Artificial Sequence
  Synthetic
ccggcgggcgcggcgac

SEQ ID NO: 434 - RNA, 17 nt, Artificial Sequence
  Synthetic
acgacgcccggcgggac

SEQ ID NO: 435 - RNA, 17 nt, Artificial Sequence
  Synthetic
cagcgccccggcucccc

SEQ ID NO: 436 - RNA, 17 nt, Artificial Sequence
  Synthetic
ccgcggccucgccgccc

SEQ ID NO: 437 - RNA, 17 nt, Artificial Sequence
  Synthetic
cgaccgggccccggccc

SEQ ID NO: 438 - RNA, 17 nt, Artificial Sequence
  Synthetic
cgccggcgaccgggccc

SEQ ID NO: 439 - RNA, 17 nt, Artificial Sequence
  Synthetic
acgccggcgaggacgcc

SEQ ID NO: 440 - RNA, 17 nt, Artificial Sequence
  Synthetic
cgucucgccgcgacagc

SEQ ID NO: 441 - RNA, 17 nt, Artificial Sequence
  Synthetic
ccugucgccgcgcccgc

SEQ ID NO: 442 - RNA, 17 nt, Artificial Sequence
  Synthetic
cggggcggcgaggccgc

SEQ ID NO: 443 - RNA, 17 nt, Artificial Sequence
  Synthetic
cggagacggaggagggc

SEQ ID NO: 444 - RNA, 17 nt, Artificial Sequence
  Synthetic
cguucgcggccccgggc

SEQ ID NO: 445 - RNA, 17 nt, Artificial Sequence
  Synthetic
cuccgcggcggcugggc

SEQ ID NO: 446 - RNA, 17 nt, Artificial Sequence
  Synthetic
ugguagaggaggccguc

SEQ ID NO: 447 - RNA, 17 nt, Artificial Sequence
  Synthetic
ccgcggggucgggcguc

SEQ ID NO: 448 - RNA, 17 nt, Artificial Sequence
  Synthetic
uggucggggucgugguc

SEQ ID NO: 449 - RNA, 17 nt, Artificial Sequence
  Synthetic
aggucgugggggugguc

SEQ ID NO: 450 - RNA, 17 nt, Artificial Sequence
  Synthetic
ucuccgcgccccacccg

SEQ ID NO: 451 - RNA, 17 nt, Artificial Sequence
  Synthetic
cccgacgcccgaccccg

SEQ ID NO: 452 - RNA, 17 nt, Artificial Sequence
  Synthetic
cccgucgguggggcccg

SEQ ID NO: 453 - RNA, 17 nt, Artificial Sequence
  Synthetic
uggggcccggggagccg

SEQ ID NO: 454 - RNA, 17 nt, Artificial Sequence
  Synthetic
cgccggcgaggacgccg

SEQ ID NO: 455 - RNA, 17 nt, Artificial Sequence
  Synthetic
cgccggcccagccgccg

SEQ ID NO: 456 - RNA, 17 nt, Artificial Sequence
  Synthetic
ccggggcggcgaggccg

SEQ ID NO: 457 - RNA, 17 nt, Artificial Sequence
  Synthetic
uucgcggccccgggccg

SEQ ID NO: 458 - RNA, 17 nt, Artificial Sequence
  Synthetic
cgucggugcccgccgcg

SEQ ID NO: 459 - RNA, 17 nt, Artificial Sequence
  Synthetic
agcagagccagcugucg

SEQ ID NO: 460 - RNA, 17 nt, Artificial Sequence
  Synthetic
cggggcccggucgccgg

SEQ ID NO: 461 - RNA, 17 nt, Artificial Sequence
  Synthetic
cgcggcggcugggccgg

SEQ ID NO: 462 - RNA, 17 nt, Artificial Sequence
  Synthetic
cgggagggcccccgcgg

SEQ ID NO: 463 - RNA, 17 nt, Artificial Sequence
  Synthetic
ccggggccgcgaacggg

SEQ ID NO: 464 - RNA, 17 nt, Artificial Sequence
  Synthetic
acgcccggcgggacggg

SEQ ID NO: 465 - RNA, 17 nt, Artificial Sequence
  Synthetic
agcggggggcccucggg

SEQ ID NO: 466 - RNA, 17 nt, Artificial Sequence
  Synthetic
aaggcggggguccgggg

SEQ ID NO: 467 - RNA, 17 nt, Artificial Sequence
  Synthetic
ucugggcucgggguggg

SEQ ID NO: 468 - RNA, 17 nt, Artificial Sequence
  Synthetic
cggggggcccucgggug

SEQ ID NO: 469 - RNA, 17 nt, Artificial Sequence
  Synthetic
cggcgaggccgcggggu

SEQ ID NO: 470 - RNA, 17 nt, Artificial Sequence
  Synthetic
cggucugggcucggggu

SEQ ID NO: 471 - RNA, 20 nt, Artificial Sequence
  Synthetic
ccccggcccggggccgcgaa

SEQ ID NO: 472 - RNA, 20 nt, Artificial Sequence
  Synthetic
uggggcgcggagacggagga

SEQ ID NO: 473 - RNA, 20 nt, Artificial Sequence
  Synthetic
cgacgcccggcgggacggga

SEQ ID NO: 474 - RNA, 20 nt, Artificial Sequence
  Synthetic
cucgacgacgcccggcggga

SEQ ID NO: 475 - RNA, 20 nt, Artificial Sequence
  Synthetic
cccggcccggggccgcgaac

SEQ ID NO: 476 - RNA, 20 nt, Artificial Sequence
  Synthetic
cagccgacgccgccggcgac

SEQ ID NO: 477 - RNA, 20 nt, Artificial Sequence
  Synthetic
aagcagcgccccggcucccc

SEQ ID NO: 478 - RNA, 20 nt, Artificial Sequence
  Synthetic
accccgcggccucgccgccc

SEQ ID NO: 479 - RNA, 20 nt, Artificial Sequence
  Synthetic
cggcgaccgggccccggccc

SEQ ID NO: 480 - RNA, 20 nt, Artificial Sequence
  Synthetic
cgccgccggcgaccgggccc

SEQ ID NO: 481 - RNA, 20 nt, Artificial Sequence
  Synthetic
caagcagcgccccggcuccc

SEQ ID NO: 482 - RNA, 20 nt, Artificial Sequence
  Synthetic
ucgguggggcccggggagcc

SEQ ID NO: 483 - RNA, 20 nt, Artificial Sequence
  Synthetic
ccgacgccggcgaggacgcc

SEQ ID NO: 484 - RNA, 20 nt, Artificial Sequence
  Synthetic
ccggcgaccgggccccggcc

SEQ ID NO: 485 - RNA, 20 nt, Artificial Sequence
  Synthetic
cccguucgcggccccgggcc

SEQ ID NO: 486 - RNA, 20 nt, Artificial Sequence
  Synthetic
cgcggccccgggccggggcc

SEQ ID NO: 487 - RNA, 20 nt, Artificial Sequence
  Synthetic
cccgcggcgggcaccgacgc

SEQ ID NO: 488 - RNA, 20 nt, Artificial Sequence
  Synthetic
ccgccugucgccgcgcccgc

SEQ ID NO: 489 - RNA, 20 nt, Artificial Sequence
  Synthetic
cgggggcccucccgucccgc

SEQ ID NO: 490 - RNA, 20 nt, Artificial Sequence
  Synthetic
ccggcgucggugcccgccgc

SEQ ID NO: 491 - RNA, 20 nt, Artificial Sequence
  Synthetic
ccgggccggggcccggucgc

SEQ ID NO: 492 - RNA, 20 nt, Artificial Sequence
  Synthetic
cgaccucgacgacgcccggc

SEQ ID NO: 493 - RNA, 20 nt, Artificial Sequence
  Synthetic
uccgcggcggcugggccggc

SEQ ID NO: 494 - RNA, 20 nt, Artificial Sequence
  Synthetic
ucccguucgcggccccgggc

SEQ ID NO: 495 - RNA, 20 nt, Artificial Sequence
  Synthetic
ccaugguagaggaggccguc

SEQ ID NO: 496 - RNA, 20 nt, Artificial Sequence
  Synthetic
ucgaggucgugggggugguc

SEQ ID NO: 497 - RNA, 20 nt, Artificial Sequence
  Synthetic
ucugcuggccuccaugguag

SEQ ID NO: 498 - RNA, 20 nt, Artificial Sequence
  Synthetic
cggcccgucgguggggcccg

SEQ ID NO: 499 - RNA, 20 nt, Artificial Sequence
  Synthetic
cgguggggcccggggagccg

SEQ ID NO: 500 - RNA, 20 nt, Artificial Sequence
  Synthetic
ccguucgcggccccgggccg

SEQ ID NO: 501 - RNA, 20 nt, Artificial Sequence
  Synthetic
cggcgucggugcccgccgcg

SEQ ID NO: 502 - RNA, 20 nt, Artificial Sequence
  Synthetic
cgcggagacggaggagggcg

SEQ ID NO: 503 - RNA, 20 nt, Artificial Sequence
  Synthetic
cguggggguggucggggucg

SEQ ID NO: 504 - RNA, 20 nt, Artificial Sequence
  Synthetic
cgaggucguggggguggucg

SEQ ID NO: 505 - RNA, 20 nt, Artificial Sequence
  Synthetic
ccggcgggcgcggcgacagg

SEQ ID NO: 506 - RNA, 20 nt, Artificial Sequence
  Synthetic
cuccgcggcggcugggccgg

SEQ ID NO: 507 - RNA, 20 nt, Artificial Sequence
  Synthetic
ucugggcucggggugggcgg

SEQ ID NO: 508 - RNA, 20 nt, Artificial Sequence
  Synthetic
acgacgcccggcgggacggg

SEQ ID NO: 509 - RNA, 20 nt, Artificial Sequence
  Synthetic
cgaaaggcggggguccgggg

SEQ ID NO: 510 - RNA, 20 nt, Artificial Sequence
  Synthetic
cggucugggcucgggguggg

SEQ ID NO: 511 - RNA, 20 nt, Artificial Sequence
  Synthetic
ugggcggcggcccgucggug

SEQ ID NO: 512 - RNA, 20 nt, Artificial Sequence
  Synthetic
cgcucgucgcggucugggcu

SEQ ID NO: 513 - RNA, 20 nt, Artificial Sequence
  Synthetic
cggggugggcggcggcccgu

SEQ ID NO: 514 - RNA, 20 nt, Artificial Sequence
  Synthetic
cccggcguccucgccggcgu

SEQ ID NO: 515 - RNA, 20 nt, Artificial Sequence
  Synthetic
cgagcggggggcccucgggu

SEQ ID NO: 516 - RNA, 20 nt, Artificial Sequence
  Synthetic
ucgcggucugggcucggggu

SEQ ID NO: 517 - RNA, 17 nt, Artificial Sequence
  Synthetic
uacgaccgcgcgcagaa

SEQ ID NO: 518 - RNA, 17 nt, Artificial Sequence
  Synthetic
guucucgcgcgccaaca

SEQ ID NO: 519 - RNA, 17 nt, Artificial Sequence
  Synthetic
cagcucgggcgcccaca

SEQ ID NO: 520 - RNA, 17 nt, Artificial Sequence
  Synthetic
cccggggcccagccaca

SEQ ID NO: 521 - RNA, 17 nt, Artificial Sequence
  Synthetic
ucggcgcugggcgcaca

SEQ ID NO: 522 - RNA, 17 nt, Artificial Sequence
  Synthetic
ggcgggccggcgcgaca

SEQ ID NO: 523 - RNA, 17 nt, Artificial Sequence
  Synthetic
gcugugcgggccggaca

SEQ ID NO: 524 - RNA, 17 nt, Artificial Sequence
  Synthetic
guacucgcgcggggaca

SEQ ID NO: 525 - RNA, 17 nt, Artificial Sequence
  Synthetic
ccccagcgccacguaca

SEQ ID NO: 526 - RNA, 17 nt, Artificial Sequence
  Synthetic
guucuggagccacccca

SEQ ID NO: 527 - RNA, 17 nt, Artificial Sequence
  Synthetic
gauaacccccaccccca

SEQ ID NO: 528 - RNA, 17 nt, Artificial Sequence
  Synthetic
ggcggacagccgcccca

SEQ ID NO: 529 - RNA, 17 nt, Artificial Sequence
  Synthetic
ccgccgccagccgccca

SEQ ID NO: 530 - RNA, 17 nt, Artificial Sequence
  Synthetic
cggcagcgcggggccca

SEQ ID NO: 531 - RNA, 17 nt, Artificial Sequence
  Synthetic
ggggaccaccgacgcca

SEQ ID NO: 532 - RNA, 17 nt, Artificial Sequence
  Synthetic
ggccggccgcgacgcca

SEQ ID NO: 533 - RNA, 17 nt, Artificial Sequence
  Synthetic
ccaccugggcuacgcca

SEQ ID NO: 534 - RNA, 17 nt, Artificial Sequence
  Synthetic
gaagcggccggccgcca

SEQ ID NO: 535 - RNA, 17 nt, Artificial Sequence
  Synthetic
cggcgcgccgggcgcca

SEQ ID NO: 536 - RNA, 17 nt, Artificial Sequence
  Synthetic
augagggccggucgcca

SEQ ID NO: 537 - RNA, 17 nt, Artificial Sequence
  Synthetic
cgcggcgaucgaggcca

SEQ ID NO: 538 - RNA, 17 nt, Artificial Sequence
  Synthetic
cccggacgcggaggcca

SEQ ID NO: 539 - RNA, 17 nt, Artificial Sequence
  Synthetic
ccggcgcgacacggcca

SEQ ID NO: 540 - RNA, 17 nt, Artificial Sequence
  Synthetic
ggcgcgcacggcggcca

SEQ ID NO: 541 - RNA, 17 nt, Artificial Sequence
  Synthetic
ucgcugggccucggcca

SEQ ID NO: 542 - RNA, 17 nt, Artificial Sequence
  Synthetic
guccgugagcucggcca

SEQ ID NO: 543 - RNA, 17 nt, Artificial Sequence
  Synthetic
ggcccggcgccgggcca

SEQ ID NO: 544 - RNA, 17 nt, Artificial Sequence
  Synthetic
ucggcggcucauggcca

SEQ ID NO: 545 - RNA, 17 nt, Artificial Sequence
  Synthetic
gcacagccgguuggcca

SEQ ID NO: 546 - RNA, 17 nt, Artificial Sequence
  Synthetic
cagccccagaaacucca

SEQ ID NO: 547 - RNA, 17 nt, Artificial Sequence
  Synthetic
cgcccccagcaccucca

SEQ ID NO: 548 - RNA, 17 nt, Artificial Sequence
  Synthetic
ggagcaguaggccucca

SEQ ID NO: 549 - RNA, 17 nt, Artificial Sequence
  Synthetic
ccccgccgccgccagca

SEQ ID NO: 550 - RNA, 17 nt, Artificial Sequence
  Synthetic
ggccgccgccgccagca

SEQ ID NO: 551 - RNA, 17 nt, Artificial Sequence
  Synthetic
gucgucgggcuccagca

SEQ ID NO: 552 - RNA, 17 nt, Artificial Sequence
  Synthetic
guccagcgccggcagca

SEQ ID NO: 553 - RNA, 17 nt, Artificial Sequence
  Synthetic
gcgggaccugcgccgca

SEQ ID NO: 554 - RNA, 17 nt, Artificial Sequence
  Synthetic
gggcccgcugcgccgca

SEQ ID NO: 555 - RNA, 17 nt, Artificial Sequence
  Synthetic
cgccgccggccagcgca

SEQ ID NO: 556 - RNA, 17 nt, Artificial Sequence
  Synthetic
ccagucgcaggcgcgca

SEQ ID NO: 557 - RNA, 17 nt, Artificial Sequence
  Synthetic
cgggcccgaggcgcgca

SEQ ID NO: 558 - RNA, 17 nt, Artificial Sequence
  Synthetic
caggcucacggcgcgca

SEQ ID NO: 559 - RNA, 17 nt, Artificial Sequence
  Synthetic
gggcggcgccggcggca

SEQ ID NO: 560 - RNA, 17 nt, Artificial Sequence
  Synthetic
guagcccagguggggca

SEQ ID NO: 561 - RNA, 17 nt, Artificial Sequence
  Synthetic
gcgcacggcgcacugca

SEQ ID NO: 562 - RNA, 17 nt, Artificial Sequence
  Synthetic
cagcagccgcgugauca

SEQ ID NO: 563 - RNA, 17 nt, Artificial Sequence
  Synthetic
cgccguggccgagcuca

SEQ ID NO: 564 - RNA, 17 nt, Artificial Sequence
  Synthetic
cccggcgaccaggcuca

SEQ ID NO: 565 - RNA, 17 nt, Artificial Sequence
  Synthetic
gucguaucggcggcuca

SEQ ID NO: 566 - RNA, 17 nt, Artificial Sequence
  Synthetic
cgccacgggccgcuuca

SEQ ID NO: 567 - RNA, 17 nt, Artificial Sequence
  Synthetic
auacgaccgcgcgcaga

SEQ ID NO: 568 - RNA, 17 nt, Artificial Sequence
  Synthetic
gggcgcggccucggaga

SEQ ID NO: 569 - RNA, 17 nt, Artificial Sequence
  Synthetic
gcgauagcgcgcguaga

SEQ ID NO: 570 - RNA, 17 nt, Artificial Sequence
  Synthetic
gccugggacgaagacga

SEQ ID NO: 571 - RNA, 17 nt, Artificial Sequence
  Synthetic
cugcgcggcgacgacga

SEQ ID NO: 572 - RNA, 17 nt, Artificial Sequence
  Synthetic
gaggacgaggacgacga

SEQ ID NO: 573 - RNA, 17 nt, Artificial Sequence
  Synthetic
gccggcgcagaugacga

SEQ ID NO: 574 - RNA, 17 nt, Artificial Sequence
  Synthetic
cgacggaccccgcccga

SEQ ID NO: 575 - RNA, 17 nt, Artificial Sequence
  Synthetic
gaggucgaugacgccga

SEQ ID NO: 576 - RNA, 17 nt, Artificial Sequence
  Synthetic
ucgcgccggcccgccga

SEQ ID NO: 577 - RNA, 17 nt, Artificial Sequence
  Synthetic
ugcgacuggcccgccga

SEQ ID NO: 578 - RNA, 17 nt, Artificial Sequence
  Synthetic
cuggaggcgcuggccga

SEQ ID NO: 579 - RNA, 17 nt, Artificial Sequence
  Synthetic
uacgcgcgcuaucgcga

SEQ ID NO: 580 - RNA, 17 nt, Artificial Sequence
  Synthetic
cuccacggccccggcga

SEQ ID NO: 581 - RNA, 17 nt, Artificial Sequence
  Synthetic
cggugcggcggcggcga

SEQ ID NO: 582 - RNA, 17 nt, Artificial Sequence
  Synthetic
ggcggccaggcacucga

SEQ ID NO: 583 - RNA, 17 nt, Artificial Sequence
  Synthetic
gccggcgccgcgcucga

SEQ ID NO: 584 - RNA, 17 nt, Artificial Sequence
  Synthetic
cuggccgagggcuucga

SEQ ID NO: 585 - RNA, 17 nt, Artificial Sequence
  Synthetic
gacggcggcgcguucga

SEQ ID NO: 586 - RNA, 17 nt, Artificial Sequence
  Synthetic
agccccccgcggccgga

SEQ ID NO: 587 - RNA, 17 nt, Artificial Sequence
  Synthetic
guggcgcgggccgcgga

SEQ ID NO: 588 - RNA, 17 nt, Artificial Sequence
  Synthetic
cccggccagccccggga

SEQ ID NO: 589 - RNA, 17 nt, Artificial Sequence
  Synthetic
uccgccgcgccgcggga

SEQ ID NO: 590 - RNA, 17 nt, Artificial Sequence
  Synthetic
ggccggucgccagggga

SEQ ID NO: 591 - RNA, 17 nt, Artificial Sequence
  Synthetic
gggcgcgggcgcgggga

SEQ ID NO: 592 - RNA, 17 nt, Artificial Sequence
  Synthetic
ggcgcguucgaggggga

SEQ ID NO: 593 - RNA, 17 nt, Artificial Sequence
  Synthetic
gaaguuguggacuggga

SEQ ID NO: 594 - RNA, 17 nt, Artificial Sequence
  Synthetic
gugcugccggcgcugga

SEQ ID NO: 595 - RNA, 17 nt, Artificial Sequence
  Synthetic
ggccccgggggcgugga

SEQ ID NO: 596 - RNA, 17 nt, Artificial Sequence
  Synthetic
ccgcgggucaaacauga

SEQ ID NO: 597 - RNA, 17 nt, Artificial Sequence
  Synthetic
cacgcugccggugauga

SEQ ID NO: 598 - RNA, 17 nt, Artificial Sequence
  Synthetic
cgagaacgcggcgcuga

SEQ ID NO: 599 - RNA, 17 nt, Artificial Sequence
  Synthetic
gcggugcccgccgggua

SEQ ID NO: 600 - RNA, 17 nt, Artificial Sequence
  Synthetic
ccggggcgggugcugua

SEQ ID NO: 601 - RNA, 17 nt, Artificial Sequence
  Synthetic
cguucucgcgcgccaac

SEQ ID NO: 602 - RNA, 17 nt, Artificial Sequence
  Synthetic
uggcggcccuggccaac

SEQ ID NO: 603 - RNA, 17 nt, Artificial Sequence
  Synthetic
cgcccgaggccucgaac

SEQ ID NO: 604 - RNA, 17 nt, Artificial Sequence
  Synthetic
cccagcgccacguacac

SEQ ID NO: 605 - RNA, 17 nt, Artificial Sequence
  Synthetic
auaacccccacccccac

SEQ ID NO: 606 - RNA, 17 nt, Artificial Sequence
  Synthetic
gccggccgcgacgccac

SEQ ID NO: 607 - RNA, 17 nt, Artificial Sequence
  Synthetic
acgccgauggccgccac

SEQ ID NO: 608 - RNA, 17 nt, Artificial Sequence
  Synthetic
uccgcggcccgcgccac

SEQ ID NO: 609 - RNA, 17 nt, Artificial Sequence
  Synthetic
cggcgcgacacggccac

SEQ ID NO: 610 - RNA, 17 nt, Artificial Sequence
  Synthetic
cgcugggccucggccac

SEQ ID NO: 611 - RNA, 17 nt, Artificial Sequence
  Synthetic
cgucgccgccgccgcac

SEQ ID NO: 612 - RNA, 17 nt, Artificial Sequence
  Synthetic
ggcggcggccagcgcac

SEQ ID NO: 613 - RNA, 17 nt, Artificial Sequence
  Synthetic
gucggcgcugggcgcac

SEQ ID NO: 614 - RNA, 17 nt, Artificial Sequence
  Synthetic
cguugccgccgcggcac

SEQ ID NO: 615 - RNA, 17 nt, Artificial Sequence
  Synthetic
cgcggggacaugggcac

SEQ ID NO: 616 - RNA, 17 nt, Artificial Sequence
  Synthetic
agcagcuccuucaucac

SEQ ID NO: 617 - RNA, 17 nt, Artificial Sequence
  Synthetic
gcgacuggcccgccgac

SEQ ID NO: 618 - RNA, 17 nt, Artificial Sequence
  Synthetic
acgcgcgcuaucgcgac

SEQ ID NO: 619 - RNA, 17 nt, Artificial Sequence
  Synthetic
ucgccagcgccggcgac

SEQ ID NO: 620 - RNA, 17 nt, Artificial Sequence
  Synthetic
ccccguccccuggcgac

SEQ ID NO: 621 - RNA, 17 nt, Artificial Sequence
  Synthetic
ccgugcgcgccugcgac

SEQ ID NO: 622 - RNA, 17 nt, Artificial Sequence
  Synthetic
gccggucgccaggggac

SEQ ID NO: 623 - RNA, 17 nt, Artificial Sequence
  Synthetic
gcgcguucgagggggac

SEQ ID NO: 624 - RNA, 17 nt, Artificial Sequence
  Synthetic
ggcgggaaguuguggac

SEQ ID NO: 625 - RNA, 17 nt, Artificial Sequence
  Synthetic
ugggcgggcaauuggac

SEQ ID NO: 626 - RNA, 17 nt, Artificial Sequence
  Synthetic
gagaacgcggcgcugac

SEQ ID NO: 627 - RNA, 17 nt, Artificial Sequence
  Synthetic
gcggcgcgucgggguac

SEQ ID NO: 628 - RNA, 17 nt, Artificial Sequence
  Synthetic
gcgggccgugccccacc

SEQ ID NO: 629 - RNA, 17 nt, Artificial Sequence
  Synthetic
ccgcggcccgcgccacc

SEQ ID NO: 630 - RNA, 17 nt, Artificial Sequence
  Synthetic
gucgccgccgccgcacc

SEQ ID NO: 631 - RNA, 17 nt, Artificial Sequence
  Synthetic
gggcuucgacggcgacc

SEQ ID NO: 632 - RNA, 17 nt, Artificial Sequence
  Synthetic
ccagggccccggcgacc

SEQ ID NO: 633 - RNA, 17 nt, Artificial Sequence
  Synthetic
cgacgaggacgaggacc

SEQ ID NO: 634 - RNA, 17 nt, Artificial Sequence
  Synthetic
gcugccgggcgaggacc

SEQ ID NO: 635 - RNA, 17 nt, Artificial Sequence
  Synthetic
gcuguccacgcgggacc

SEQ ID NO: 636 - RNA, 17 nt, Artificial Sequence
  Synthetic
ggacguggcgcuggacc

SEQ ID NO: 637 - RNA, 17 nt, Artificial Sequence
  Synthetic
gcggcagcacgccuacc

SEQ ID NO: 638 - RNA, 17 nt, Artificial Sequence
  Synthetic
ccccgcggcgccguacc

SEQ ID NO: 639 - RNA, 17 nt, Artificial Sequence
  Synthetic
gcggcugcuguacaccc

SEQ ID NO: 640 - RNA, 17 nt, Artificial Sequence
  Synthetic
acgcgcgcgaagacccc

SEQ ID NO: 641 - RNA, 17 nt, Artificial Sequence
  Synthetic
cgcgcgcgaagaccccc

SEQ ID NO: 642 - RNA, 17 nt, Artificial Sequence
  Synthetic
cgagggccccgaccccc

SEQ ID NO: 643 - RNA, 17 nt, Artificial Sequence
  Synthetic
cggcgccggcagccccc

SEQ ID NO: 644 - RNA, 17 nt, Artificial Sequence
  Synthetic
uggcggcggcagccccc

SEQ ID NO: 645 - RNA, 17 nt, Artificial Sequence
  Synthetic
ccccccuccacgccccc

SEQ ID NO: 646 - RNA, 17 nt, Artificial Sequence
  Synthetic
gccgggcccccgccccc

SEQ ID NO: 647 - RNA, 17 nt, Artificial Sequence
  Synthetic
ccggcggcagggccccc

SEQ ID NO: 648 - RNA, 17 nt, Artificial Sequence
  Synthetic
ggccgcgcccaagcccc

SEQ ID NO: 649 - RNA, 17 nt, Artificial Sequence
  Synthetic
gggccccggccagcccc

SEQ ID NO: 650 - RNA, 17 nt, Artificial Sequence
  Synthetic
gcggcgccggcagcccc

SEQ ID NO: 651 - RNA, 17 nt, Artificial Sequence
  Synthetic
cuggcggcggcagcccc

SEQ ID NO: 652 - RNA, 17 nt, Artificial Sequence
  Synthetic
gccccccuccacgcccc

SEQ ID NO: 653 - RNA, 17 nt, Artificial Sequence
  Synthetic
agcggcgcggacgcccc

SEQ ID NO: 654 - RNA, 17 nt, Artificial Sequence
  Synthetic
cguacagcacccgcccc

SEQ ID NO: 655 - RNA, 17 nt, Artificial Sequence
  Synthetic
cgccgggcccccgcccc

SEQ ID NO: 656 - RNA, 17 nt, Artificial Sequence
  Synthetic
cggcggacagccgcccc

SEQ ID NO: 657 - RNA, 17 nt, Artificial Sequence
  Synthetic
ccagcccgcggcgcccc

SEQ ID NO: 658 - RNA, 17 nt, Artificial Sequence
  Synthetic
gccaaagaggcggcccc

SEQ ID NO: 659 - RNA, 17 nt, Artificial Sequence
  Synthetic
gccggcggcagggcccc

SEQ ID NO: 660 - RNA, 17 nt, Artificial Sequence
  Synthetic
gggcgggcucgggcccc

SEQ ID NO: 661 - RNA, 17 nt, Artificial Sequence
  Synthetic
ccguguggcugggcccc

SEQ ID NO: 662 - RNA, 17 nt, Artificial Sequence
  Synthetic
uccagcgccacgucccc

SEQ ID NO: 663 - RNA, 17 nt, Artificial Sequence
  Synthetic
cgcuguuccccgucccc

SEQ ID NO: 664 - RNA, 17 nt, Artificial Sequence
  Synthetic
acccgcgcguggucccc

SEQ ID NO: 665 - RNA, 17 nt, Artificial Sequence
  Synthetic
aggccgcgcccaagccc

SEQ ID NO: 666 - RNA, 17 nt, Artificial Sequence
  Synthetic
cgggccccggccagccc

SEQ ID NO: 667 - RNA, 17 nt, Artificial Sequence
  Synthetic
ucacggccgggcagccc

SEQ ID NO: 668 - RNA, 17 nt, Artificial Sequence
  Synthetic
ggggccgcggggagccc

SEQ ID NO: 669 - RNA, 17 nt, Artificial Sequence
  Synthetic
ccgccauggcguagccc

SEQ ID NO: 670 - RNA, 17 nt, Artificial Sequence
  Synthetic
ccguacagcacccgccc

SEQ ID NO: 671 - RNA, 17 nt, Artificial Sequence
  Synthetic
ggacgccgcccccgccc

SEQ ID NO: 672 - RNA, 17 nt, Artificial Sequence
  Synthetic
gguccaauugcccgccc

SEQ ID NO: 673 - RNA, 17 nt, Artificial Sequence
  Synthetic
cugggcgacagccgccc

SEQ ID NO: 674 - RNA, 17 nt, Artificial Sequence
  Synthetic
gccgccgccagccgccc

SEQ ID NO: 675 - RNA, 17 nt, Artificial Sequence
  Synthetic
gcccgcccccgccgccc

SEQ ID NO: 676 - RNA, 17 nt, Artificial Sequence
  Synthetic
gguccucgccgccgccc

SEQ ID NO: 677 - RNA, 17 nt, Artificial Sequence
  Synthetic
gcccgcggccgccgccc

SEQ ID NO: 678 - RNA, 17 nt, Artificial Sequence
  Synthetic
ugccgccggcgccgccc

SEQ ID NO: 679 - RNA, 17 nt, Artificial Sequence
  Synthetic
ggggauccucgccgccc

SEQ ID NO: 680 - RNA, 17 nt, Artificial Sequence
  Synthetic
gggggcggcguccgccc

SEQ ID NO: 681 - RNA, 17 nt, Artificial Sequence
  Synthetic
cgccgggcgccgcgccc

SEQ ID NO: 682 - RNA, 17 nt, Artificial Sequence
  Synthetic
gccgcagcggcgcgccc

SEQ ID NO: 683 - RNA, 17 nt, Artificial Sequence
  Synthetic
cccagcccgcggcgccc

SEQ ID NO: 684 - RNA, 17 nt, Artificial Sequence
  Synthetic
cgaggccucgggcgccc

SEQ ID NO: 685 - RNA, 17 nt, Artificial Sequence
  Synthetic
ccgggcggcugucgccc

SEQ ID NO: 686 - RNA, 17 nt, Artificial Sequence
  Synthetic
gcgccccccagaggccc

SEQ ID NO: 687 - RNA, 17 nt, Artificial Sequence
  Synthetic
cagaaacuccacggccc

SEQ ID NO: 688 - RNA, 17 nt, Artificial Sequence
  Synthetic
ggcgacgacgacggccc

SEQ ID NO: 689 - RNA, 17 nt, Artificial Sequence
  Synthetic
cugcgccgcggcggccc

SEQ ID NO: 690 - RNA, 17 nt, Artificial Sequence
  Synthetic
cugccugcuggcggccc

SEQ ID NO: 691 - RNA, 17 nt, Artificial Sequence
  Synthetic
ggccgcguguucggccc

SEQ ID NO: 692 - RNA, 17 nt, Artificial Sequence
  Synthetic
cgcggggcccagggccc

SEQ ID NO: 693 - RNA, 17 nt, Artificial Sequence
  Synthetic
gcuggcgggccgggccc

SEQ ID NO: 694 - RNA, 17 nt, Artificial Sequence
  Synthetic
guuugacccgcgggccc

SEQ ID NO: 695 - RNA, 17 nt, Artificial Sequence
  Synthetic
ggggcgggcucgggccc

SEQ ID NO: 696 - RNA, 17 nt, Artificial Sequence
  Synthetic
ccuggucgccggggccc

SEQ ID NO: 697 - RNA, 17 nt, Artificial Sequence
  Synthetic
gcggcagcgcggggccc

SEQ ID NO: 698 - RNA, 17 nt, Artificial Sequence
  Synthetic
gccguguggcugggccc

SEQ ID NO: 699 - RNA, 17 nt, Artificial Sequence
  Synthetic
gagaggggggguggccc

SEQ ID NO: 700 - RNA, 17 nt, Artificial Sequence
  Synthetic
gaggcccagcgaauccc

SEQ ID NO: 701 - RNA, 17 nt, Artificial Sequence
  Synthetic
guccagcgccacguccc

SEQ ID NO: 702 - RNA, 17 nt, Artificial Sequence
  Synthetic
gaccuggcggccguccc

SEQ ID NO: 703 - RNA, 17 nt, Artificial Sequence
  Synthetic
gccgucgucuucguccc

SEQ ID NO: 704 - RNA, 17 nt, Artificial Sequence
  Synthetic
aacccgcgcgugguccc

SEQ ID NO: 705 - RNA, 17 nt, Artificial Sequence
  Synthetic
gcgcgggcguccgagcc

SEQ ID NO: 706 - RNA, 17 nt, Artificial Sequence
  Synthetic
cgugcgcgccgugagcc

SEQ ID NO: 707 - RNA, 17 nt, Artificial Sequence
  Synthetic
gcagcagcucgcacgcc

SEQ ID NO: 708 - RNA, 17 nt, Artificial Sequence
  Synthetic
acgccgacgacgacgcc

SEQ ID NO: 709 - RNA, 17 nt, Artificial Sequence
  Synthetic
cccgcgcgaguaccgcc

SEQ ID NO: 710 - RNA, 17 nt, Artificial Sequence
  Synthetic
guccagcucgacccgcc

SEQ ID NO: 711 - RNA, 17 nt, Artificial Sequence
  Synthetic
cggacgccgcccccgcc

SEQ ID NO: 712 - RNA, 17 nt, Artificial Sequence
  Synthetic
agcgcgcggugcccgcc

SEQ ID NO: 713 - RNA, 17 nt, Artificial Sequence
  Synthetic
ccugggcgacagccgcc

SEQ ID NO: 714 - RNA, 17 nt, Artificial Sequence
  Synthetic
ggguccucgccgccgcc

SEQ ID NO: 715 - RNA, 17 nt, Artificial Sequence
  Synthetic
uccccgaggccgccgcc

SEQ ID NO: 716 - RNA, 17 nt, Artificial Sequence
  Synthetic
ccgcaucgagcgccgcc

SEQ ID NO: 717 - RNA, 17 nt, Artificial Sequence
  Synthetic
cugccgccggcgccgcc

SEQ ID NO: 718 - RNA, 17 nt, Artificial Sequence
  Synthetic
gcgcccacacggccgcc

SEQ ID NO: 719 - RNA, 17 nt, Artificial Sequence
  Synthetic
ggccggacacggccgcc

SEQ ID NO: 720 - RNA, 17 nt, Artificial Sequence
  Synthetic
gccccgggacggccgcc

SEQ ID NO: 721 - RNA, 17 nt, Artificial Sequence
  Synthetic
ggcccggcccggccgcc

SEQ ID NO: 722 - RNA, 17 nt, Artificial Sequence
  Synthetic
acccccacggggccgcc

SEQ ID NO: 723 - RNA, 17 nt, Artificial Sequence
  Synthetic
cgggggcggcguccgcc

SEQ ID NO: 724 - RNA, 17 nt, Artificial Sequence
  Synthetic
cagaaguccggcgcgcc

SEQ ID NO: 725 - RNA, 17 nt, Artificial Sequence
  Synthetic
uggacugggaaggcgcc

SEQ ID NO: 726 - RNA, 17 nt, Artificial Sequence
  Synthetic
ggcgggggcccggcgcc

SEQ ID NO: 727 - RNA, 17 nt, Artificial Sequence
  Synthetic
agccguggcccggcgcc

SEQ ID NO: 728 - RNA, 17 nt, Artificial Sequence
  Synthetic
ucaucugcgccggcgcc

SEQ ID NO: 729 - RNA, 17 nt, Artificial Sequence
  Synthetic
ggccugggcgcggcgcc

SEQ ID NO: 730 - RNA, 17 nt, Artificial Sequence
  Synthetic
accgacgccauggcgcc

SEQ ID NO: 731 - RNA, 17 nt, Artificial Sequence
  Synthetic
cggccgccgcgugcgcc

SEQ ID NO: 732 - RNA, 17 nt, Artificial Sequence
  Synthetic
ucgccgcgcggugcgcc

SEQ ID NO: 733 - RNA, 17 nt, Artificial Sequence
  Synthetic
ccggccagguccucgcc

SEQ ID NO: 734 - RNA, 17 nt, Artificial Sequence
  Synthetic
ggcaccgcgcgcucgcc

SEQ ID NO: 735 - RNA, 17 nt, Artificial Sequence
  Synthetic
caugagggccggucgcc

SEQ ID NO: 736 - RNA, 17 nt, Artificial Sequence
  Synthetic
ccgugagccuggucgcc

SEQ ID NO: 737 - RNA, 17 nt, Artificial Sequence
  Synthetic
gggaccuggccuucgcc

SEQ ID NO: 738 - RNA, 17 nt, Artificial Sequence
  Synthetic
cggccccggcgaaggcc

SEQ ID NO: 739 - RNA, 17 nt, Artificial Sequence
  Synthetic
agauccggaagcaggcc

SEQ ID NO: 740 - RNA, 17 nt, Artificial Sequence
  Synthetic
ggcgccccccagaggcc

SEQ ID NO: 741 - RNA, 17 nt, Artificial Sequence
  Synthetic
gcgcggcgaucgaggcc

SEQ ID NO: 742 - RNA, 17 nt, Artificial Sequence
  Synthetic
gcgccggcagcacggcc

SEQ ID NO: 743 - RNA, 17 nt, Artificial Sequence
  Synthetic
cgggccgcuucacggcc

SEQ ID NO: 744 - RNA, 17 nt, Artificial Sequence
  Synthetic
cggcgacgacgacggcc

SEQ ID NO: 745 - RNA, 17 nt, Artificial Sequence
  Synthetic
gccggcgcuggacggcc

SEQ ID NO: 746 - RNA, 17 nt, Artificial Sequence
  Synthetic
agagucccggcccggcc

SEQ ID NO: 747 - RNA, 17 nt, Artificial Sequence
  Synthetic
ugcgcgccggcccggcc

SEQ ID NO: 748 - RNA, 17 nt, Artificial Sequence
  Synthetic
gcgcaagagucccggcc

SEQ ID NO: 749 - RNA, 17 nt, Artificial Sequence
  Synthetic
aggccccgccgccggcc

SEQ ID NO: 750 - RNA, 17 nt, Artificial Sequence
  Synthetic
ggcggugcgcgccggcc

SEQ ID NO: 751 - RNA, 17 nt, Artificial Sequence
  Synthetic
cggccacgcggccggcc

SEQ ID NO: 752 - RNA, 17 nt, Artificial Sequence
  Synthetic
cgccgccgcacgcggcc

SEQ ID NO: 753 - RNA, 17 nt, Artificial Sequence
  Synthetic
ucccgcggcaggcggcc

SEQ ID NO: 754 - RNA, 17 nt, Artificial Sequence
  Synthetic
ggugcuguacggcggcc

SEQ ID NO: 755 - RNA, 17 nt, Artificial Sequence
  Synthetic
ccugcgccgcggcggcc

SEQ ID NO: 756 - RNA, 17 nt, Artificial Sequence
  Synthetic
gccgccuccgggcggcc

SEQ ID NO: 757 - RNA, 17 nt, Artificial Sequence
  Synthetic
ugcgccgcauggcggcc

SEQ ID NO: 758 - RNA, 17 nt, Artificial Sequence
  Synthetic
gcgcacgcgcuucggcc

SEQ ID NO: 759 - RNA, 17 nt, Artificial Sequence
  Synthetic
gggccgcguguucggcc

SEQ ID NO: 760 - RNA, 17 nt, Artificial Sequence
  Synthetic
gcccgcgccaccgggcc

SEQ ID NO: 761 - RNA, 17 nt, Artificial Sequence
  Synthetic
cuccgggcggccgggcc

SEQ ID NO: 762 - RNA, 17 nt, Artificial Sequence
  Synthetic
ggcggccgggccgggcc

SEQ ID NO: 763 - RNA, 17 nt, Artificial Sequence
  Synthetic
ccaccgccgcgcgggcc

SEQ ID NO: 764 - RNA, 17 nt, Artificial Sequence
  Synthetic
ggcggcgggggcgggcc

SEQ ID NO: 765 - RNA, 17 nt, Artificial Sequence
  Synthetic
cggggggcuggcgggcc

SEQ ID NO: 766 - RNA, 17 nt, Artificial Sequence
  Synthetic
cggggcuggccggggcc

SEQ ID NO: 767 - RNA, 17 nt, Artificial Sequence
  Synthetic
ccccgggggcgggggcc

SEQ ID NO: 768 - RNA, 17 nt, Artificial Sequence
  Synthetic
cugcgcgcgcuggggcc

SEQ ID NO: 769 - RNA, 17 nt, Artificial Sequence
  Synthetic
ccgcuucggcuggggcc

SEQ ID NO: 770 - RNA, 17 nt, Artificial Sequence
  Synthetic
ccgucccggggcuggcc

SEQ ID NO: 771 - RNA, 17 nt, Artificial Sequence
  Synthetic
agcggggagccguggcc

SEQ ID NO: 772 - RNA, 17 nt, Artificial Sequence
  Synthetic
ggagaggggggguggcc

SEQ ID NO: 773 - RNA, 17 nt, Artificial Sequence
  Synthetic
cgcacagccgguuggcc

SEQ ID NO: 774 - RNA, 17 nt, Artificial Sequence
  Synthetic
cuguacucgccgcugcc

SEQ ID NO: 775 - RNA, 17 nt, Artificial Sequence
  Synthetic
gacccgccggggcugcc

SEQ ID NO: 776 - RNA, 17 nt, Artificial Sequence
  Synthetic
cguggccgucgagugcc

SEQ ID NO: 777 - RNA, 17 nt, Artificial Sequence
  Synthetic
cgaggcccagcgaaucc

SEQ ID NO: 778 - RNA, 17 nt, Artificial Sequence
  Synthetic
ggggaucuggcgcaucc

SEQ ID NO: 779 - RNA, 17 nt, Artificial Sequence
  Synthetic
cgccugccgcgggaucc

SEQ ID NO: 780 - RNA, 17 nt, Artificial Sequence
  Synthetic
cgaccucgucggacucc

SEQ ID NO: 781 - RNA, 17 nt, Artificial Sequence
  Synthetic
cgcgggccgccgccucc

SEQ ID NO: 782 - RNA, 17 nt, Artificial Sequence
  Synthetic
ccucggccagcgccucc

SEQ ID NO: 783 - RNA, 17 nt, Artificial Sequence
  Synthetic
gggagcaguaggccucc

SEQ ID NO: 784 - RNA, 17 nt, Artificial Sequence
  Synthetic
cgcaagcgcaagagucc

SEQ ID NO: 785 - RNA, 17 nt, Artificial Sequence
  Synthetic
cgaccuggcggccgucc

SEQ ID NO: 786 - RNA, 17 nt, Artificial Sequence
  Synthetic
ccauggccuccgcgucc

SEQ ID NO: 787 - RNA, 17 nt, Artificial Sequence
  Synthetic
ugggcaccggcgugucc

SEQ ID NO: 788 - RNA, 17 nt, Artificial Sequence
  Synthetic
gcccgagauccggaagc

SEQ ID NO: 789 - RNA, 17 nt, Artificial Sequence
  Synthetic
ggcggcggcggggaagc

SEQ ID NO: 790 - RNA, 17 nt, Artificial Sequence
  Synthetic
ucugguugucaaacagc

SEQ ID NO: 791 - RNA, 17 nt, Artificial Sequence
  Synthetic
aggggacggggaacagc

SEQ ID NO: 792 - RNA, 17 nt, Artificial Sequence
  Synthetic
uguccggcccgcacagc

SEQ ID NO: 793 - RNA, 17 nt, Artificial Sequence
  Synthetic
cgccgcgcagcaccagc

SEQ ID NO: 794 - RNA, 17 nt, Artificial Sequence
  Synthetic
uggccgccgccgccagc

SEQ ID NO: 795 - RNA, 17 nt, Artificial Sequence
  Synthetic
uggccagggccgccagc

SEQ ID NO: 796 - RNA, 17 nt, Artificial Sequence
  Synthetic
cgucgucgggcuccagc

SEQ ID NO: 797 - RNA, 17 nt, Artificial Sequence
  Synthetic
ccgccaugcggcgcagc

SEQ ID NO: 798 - RNA, 17 nt, Artificial Sequence
  Synthetic
gcgacggguacgucagc

SEQ ID NO: 799 - RNA, 17 nt, Artificial Sequence
  Synthetic
ggcgcaggcuggucagc

SEQ ID NO: 800 - RNA, 17 nt, Artificial Sequence
  Synthetic
cgugugggcgcccgagc

SEQ ID NO: 801 - RNA, 17 nt, Artificial Sequence
  Synthetic
ggcgcgggcguccgagc

SEQ ID NO: 802 - RNA, 17 nt, Artificial Sequence
  Synthetic
gccccggcgggucgagc

SEQ ID NO: 803 - RNA, 17 nt, Artificial Sequence
  Synthetic
cuucggcccggacacgc

SEQ ID NO: 804 - RNA, 17 nt, Artificial Sequence
  Synthetic
gcugcugcuguccacgc

SEQ ID NO: 805 - RNA, 17 nt, Artificial Sequence
  Synthetic
gacgccgacgacgacgc

SEQ ID NO: 806 - RNA, 17 nt, Artificial Sequence
  Synthetic
cggaggaggcgcgacgc

SEQ ID NO: 807 - RNA, 17 nt, Artificial Sequence
  Synthetic
ugcugccgcgacaccgc

SEQ ID NO: 808 - RNA, 17 nt, Artificial Sequence
  Synthetic
ccccgcgcgaguaccgc

SEQ ID NO: 809 - RNA, 17 nt, Artificial Sequence
  Synthetic
cguccagcucgacccgc

SEQ ID NO: 810 - RNA, 17 nt, Artificial Sequence
  Synthetic
cggccggagggacccgc

SEQ ID NO: 811 - RNA, 17 nt, Artificial Sequence
  Synthetic
ccucauguuugacccgc

SEQ ID NO: 812 - RNA, 17 nt, Artificial Sequence
  Synthetic
cgacgacgcccccccgc

SEQ ID NO: 813 - RNA, 17 nt, Artificial Sequence
  Synthetic
gggucgucgccccccgc

SEQ ID NO: 814 - RNA, 17 nt, Artificial Sequence
  Synthetic
gcgcccgccucccccgc

SEQ ID NO: 815 - RNA, 17 nt, Artificial Sequence
  Synthetic
ucgaggccagggcccgc

SEQ ID NO: 816 - RNA, 17 nt, Artificial Sequence
  Synthetic
ggggaagcggggcccgc

SEQ ID NO: 817 - RNA, 17 nt, Artificial Sequence
  Synthetic
gagcgcgcggugcccgc

SEQ ID NO: 818 - RNA, 17 nt, Artificial Sequence
  Synthetic
ugaccacgaugagccgc

SEQ ID NO: 819 - RNA, 17 nt, Artificial Sequence
  Synthetic
ccccgaggccccgccgc

SEQ ID NO: 820 - RNA, 17 nt, Artificial Sequence
  Synthetic
ccacaacuucccgccgc

SEQ ID NO: 821 - RNA, 17 nt, Artificial Sequence
  Synthetic
gccgcaucgagcgccgc

SEQ ID NO: 822 - RNA, 17 nt, Artificial Sequence
  Synthetic
cgcaggucccgcgccgc

SEQ ID NO: 823 - RNA, 17 nt, Artificial Sequence
  Synthetic
cgccuccgccgcgccgc

SEQ ID NO: 824 - RNA, 17 nt, Artificial Sequence
  Synthetic
gccggguacggcgccgc

SEQ ID NO: 825 - RNA, 17 nt, Artificial Sequence
  Synthetic
gcggcccggggcgccgc

SEQ ID NO: 826 - RNA, 17 nt, Artificial Sequence
  Synthetic
cggcccgcggaggccgc

SEQ ID NO: 827 - RNA, 17 nt, Artificial Sequence
  Synthetic
ggcgcccacacggccgc

SEQ ID NO: 828 - RNA, 17 nt, Artificial Sequence
  Synthetic
cgggucccuccggccgc

SEQ ID NO: 829 - RNA, 17 nt, Artificial Sequence
  Synthetic
uccagggcggcggccgc

SEQ ID NO: 830 - RNA, 17 nt, Artificial Sequence
  Synthetic
cacccccacggggccgc

SEQ ID NO: 831 - RNA, 17 nt, Artificial Sequence
  Synthetic
gcgcugacgggggccgc

SEQ ID NO: 832 - RNA, 17 nt, Artificial Sequence
  Synthetic
ggccucgggggggccgc

SEQ ID NO: 833 - RNA, 17 nt, Artificial Sequence
  Synthetic
cccgggggcccugccgc

SEQ ID NO: 834 - RNA, 17 nt, Artificial Sequence
  Synthetic
gccuggccgccugccgc

SEQ ID NO: 835 - RNA, 17 nt, Artificial Sequence
  Synthetic
gggccccgcgcugccgc

SEQ ID NO: 836 - RNA, 17 nt, Artificial Sequence
  Synthetic
ggcggccucgcugccgc

SEQ ID NO: 837 - RNA, 17 nt, Artificial Sequence
  Synthetic
acccccgcggccuccgc

SEQ ID NO: 838 - RNA, 17 nt, Artificial Sequence
  Synthetic
gggcugcucgccagcgc

SEQ ID NO: 839 - RNA, 17 nt, Artificial Sequence
  Synthetic
gcccggccguccagcgc

SEQ ID NO: 840 - RNA, 17 nt, Artificial Sequence
  Synthetic
gggucccgcggcagcgc

SEQ ID NO: 841 - RNA, 17 nt, Artificial Sequence
  Synthetic
ccccggggaccacgcgc

SEQ ID NO: 842 - RNA, 17 nt, Artificial Sequence
  Synthetic
ugccgccggccacgcgc

SEQ ID NO: 843 - RNA, 17 nt, Artificial Sequence
  Synthetic
ggacgccgccgacgcgc

SEQ ID NO: 844 - RNA, 17 nt, Artificial Sequence
  Synthetic
guucgugcgcgacgcgc

SEQ ID NO: 845 - RNA, 17 nt, Artificial Sequence
  Synthetic
cgcgcagguccccgcgc

SEQ ID NO: 846 - RNA, 17 nt, Artificial Sequence
  Synthetic
gccggccaccgccgcgc

SEQ ID NO: 847 - RNA, 17 nt, Artificial Sequence
  Synthetic
cgcgcagccacgcgcgc

SEQ ID NO: 848 - RNA, 17 nt, Artificial Sequence
  Synthetic
caggccccagcgcgcgc

SEQ ID NO: 849 - RNA, 17 nt, Artificial Sequence
  Synthetic
acgccgccugcgcgcgc

SEQ ID NO: 850 - RNA, 17 nt, Artificial Sequence
  Synthetic
gcgggcccgaggcgcgc

SEQ ID NO: 851 - RNA, 17 nt, Artificial Sequence
  Synthetic
gcucggccacggcgcgc

SEQ ID NO: 852 - RNA, 17 nt, Artificial Sequence
  Synthetic
cauggcgcccggcgcgc

SEQ ID NO: 853 - RNA, 17 nt, Artificial Sequence
  Synthetic
gcagaaguccggcgcgc

SEQ ID NO: 854 - RNA, 17 nt, Artificial Sequence
  Synthetic
cgcgaggcggugcgcgc

SEQ ID NO: 855 - RNA, 17 nt, Artificial Sequence
  Synthetic
cccggcgguacucgcgc

SEQ ID NO: 856 - RNA, 17 nt, Artificial Sequence
  Synthetic
ccguggccgugucgcgc

SEQ ID NO: 857 - RNA, 17 nt, Artificial Sequence
  Synthetic
gcgcgcguagaaggcgc

SEQ ID NO: 858 - RNA, 17 nt, Artificial Sequence
  Synthetic
cggagcucggcaggcgc

SEQ ID NO: 859 - RNA, 17 nt, Artificial Sequence
  Synthetic
ccacgcacgcgaggcgc

SEQ ID NO: 860 - RNA, 17 nt, Artificial Sequence
  Synthetic
cgggauccuggaggcgc

SEQ ID NO: 861 - RNA, 17 nt, Artificial Sequence
  Synthetic
gcggggagccccggcgc

SEQ ID NO: 862 - RNA, 17 nt, Artificial Sequence
  Synthetic
gggcgggggcccggcgc

SEQ ID NO: 863 - RNA, 17 nt, Artificial Sequence
  Synthetic
gagccguggcccggcgc

SEQ ID NO: 864 - RNA, 17 nt, Artificial Sequence
  Synthetic
gucaucugcgccggcgc

SEQ ID NO: 865 - RNA, 17 nt, Artificial Sequence
  Synthetic
ccgccggucgccggcgc

SEQ ID NO: 866 - RNA, 17 nt, Artificial Sequence
  Synthetic
ggccgugcugccggcgc

SEQ ID NO: 867 - RNA, 17 nt, Artificial Sequence
  Synthetic
ccgggccgccgcggcgc

SEQ ID NO: 868 - RNA, 17 nt, Artificial Sequence
  Synthetic
uccgucgagcgcggcgc

SEQ ID NO: 869 - RNA, 17 nt, Artificial Sequence
  Synthetic
gcgcguaggcgcggcgc

SEQ ID NO: 870 - RNA, 17 nt, Artificial Sequence
  Synthetic
gcgcuggccggcggcgc

SEQ ID NO: 871 - RNA, 17 nt, Artificial Sequence
  Synthetic
cgaaucccgggcggcgc

SEQ ID NO: 872 - RNA, 17 nt, Artificial Sequence
  Synthetic
ccagcaccgugcggcgc

SEQ ID NO: 873 - RNA, 17 nt, Artificial Sequence
  Synthetic
ccccgacgugucggcgc

SEQ ID NO: 874 - RNA, 17 nt, Artificial Sequence
  Synthetic
gggcuccagcagggcgc

SEQ ID NO: 875 - RNA, 17 nt, Artificial Sequence
  Synthetic
gaggggggcgcgggcgc

SEQ ID NO: 876 - RNA, 17 nt, Artificial Sequence
  Synthetic
acacggccacggggcgc

SEQ ID NO: 877 - RNA, 17 nt, Artificial Sequence
  Synthetic
ccgccagcagggggcgc

SEQ ID NO: 878 - RNA, 17 nt, Artificial Sequence
  Synthetic
cgacacgucgggggcgc

SEQ ID NO: 879 - RNA, 17 nt, Artificial Sequence
  Synthetic
cgcggggaggggggcgc

SEQ ID NO: 880 - RNA, 17 nt, Artificial Sequence
  Synthetic
ggcguggaggggggcgc

SEQ ID NO: 881 - RNA, 17 nt, Artificial Sequence
  Synthetic
ccccggggacguggcgc

SEQ ID NO: 882 - RNA, 17 nt, Artificial Sequence
  Synthetic
gcccguguacguggcgc

SEQ ID NO: 883 - RNA, 17 nt, Artificial Sequence
  Synthetic
caccggcagcguggcgc

SEQ ID NO: 884 - RNA, 17 nt, Artificial Sequence
  Synthetic
gcccggcccgguggcgc

SEQ ID NO: 885 - RNA, 17 nt, Artificial Sequence
  Synthetic
ugcucaugcgccugcgc

SEQ ID NO: 886 - RNA, 17 nt, Artificial Sequence
  Synthetic
ccccucgucaucugcgc

SEQ ID NO: 887 - RNA, 17 nt, Artificial Sequence
  Synthetic
ugcagugcgccgugcgc

SEQ ID NO: 888 - RNA, 17 nt, Artificial Sequence
  Synthetic
ggcggcguccggugcgc

SEQ ID NO: 889 - RNA, 17 nt, Artificial Sequence
  Synthetic
aucgccgcgcggugcgc

SEQ ID NO: 890 - RNA, 17 nt, Artificial Sequence
  Synthetic
gucggcgggccagucgc

SEQ ID NO: 891 - RNA, 17 nt, Artificial Sequence
  Synthetic
gaugagccgccggucgc

SEQ ID NO: 892 - RNA, 17 nt, Artificial Sequence
  Synthetic
ucgucuucgggggucgc

SEQ ID NO: 893 - RNA, 17 nt, Artificial Sequence
  Synthetic
gccgugagccuggucgc

SEQ ID NO: 894 - RNA, 17 nt, Artificial Sequence
  Synthetic
cgccgcccgggauucgc

SEQ ID NO: 895 - RNA, 17 nt, Artificial Sequence
  Synthetic
cgggaccuggccuucgc

SEQ ID NO: 896 - RNA, 17 nt, Artificial Sequence
  Synthetic
gggcgccgcgcccaggc

SEQ ID NO: 897 - RNA, 17 nt, Artificial Sequence
  Synthetic
cagggccgccagcaggc

SEQ ID NO: 898 - RNA, 17 nt, Artificial Sequence
  Synthetic
cagccacgcgcgcaggc

SEQ ID NO: 899 - RNA, 17 nt, Artificial Sequence
  Synthetic
guaggcgcggcgcaggc

SEQ ID NO: 900 - RNA, 17 nt, Artificial Sequence
  Synthetic
gugcugggggcggaggc

SEQ ID NO: 901 - RNA, 17 nt, Artificial Sequence
  Synthetic
ccccccgcgggggaggc

SEQ ID NO: 902 - RNA, 17 nt, Artificial Sequence
  Synthetic
acggcgcacugcacggc

SEQ ID NO: 903 - RNA, 17 nt, Artificial Sequence
  Synthetic
acgggccgcuucacggc

SEQ ID NO: 904 - RNA, 17 nt, Artificial Sequence
  Synthetic
ugccggcgcuggacggc

SEQ ID NO: 905 - RNA, 17 nt, Artificial Sequence
  Synthetic
gcggcgccguacccggc

SEQ ID NO: 906 - RNA, 17 nt, Artificial Sequence
  Synthetic
ggccgggcagccccggc

SEQ ID NO: 907 - RNA, 17 nt, Artificial Sequence
  Synthetic
gccccagccgaagcggc

SEQ ID NO: 908 - RNA, 17 nt, Artificial Sequence
  Synthetic
cucgacggccacgcggc

SEQ ID NO: 909 - RNA, 17 nt, Artificial Sequence
  Synthetic
cgccagccccccgcggc

SEQ ID NO: 910 - RNA, 17 nt, Artificial Sequence
  Synthetic
ggccacgcccccgcggc

SEQ ID NO: 911 - RNA, 17 nt, Artificial Sequence
  Synthetic
cuccaggaucccgcggc

SEQ ID NO: 912 - RNA, 17 nt, Artificial Sequence
  Synthetic
gguccgccgagcgcggc

SEQ ID NO: 913 - RNA, 17 nt, Artificial Sequence
  Synthetic
gcccguggcgucgcggc

SEQ ID NO: 914 - RNA, 17 nt, Artificial Sequence
  Synthetic
cgggcggcgccggcggc

SEQ ID NO: 915 - RNA, 17 nt, Artificial Sequence
  Synthetic
aggaccuggccggcggc

SEQ ID NO: 916 - RNA, 17 nt, Artificial Sequence
  Synthetic
cggcgugcggcggcggc

SEQ ID NO: 917 - RNA, 17 nt, Artificial Sequence
  Synthetic
accgugcuggcggcggc

SEQ ID NO: 918 - RNA, 17 nt, Artificial Sequence
  Synthetic
cgccgccuccgggcggc

SEQ ID NO: 919 - RNA, 17 nt, Artificial Sequence
  Synthetic
ccgacccccugggcggc

SEQ ID NO: 920 - RNA, 17 nt, Artificial Sequence
  Synthetic
cacgcggccugggcggc

SEQ ID NO: 921 - RNA, 17 nt, Artificial Sequence
  Synthetic
ggcuacgccauggcggc

SEQ ID NO: 922 - RNA, 17 nt, Artificial Sequence
  Synthetic
gggucggggcccucggc

SEQ ID NO: 923 - RNA, 17 nt, Artificial Sequence
  Synthetic
cggccgcggagcucggc

SEQ ID NO: 924 - RNA, 17 nt, Artificial Sequence
  Synthetic
accgcgggcccgucggc

SEQ ID NO: 925 - RNA, 17 nt, Artificial Sequence
  Synthetic
cggccggccgcuucggc

SEQ ID NO: 926 - RNA, 17 nt, Artificial Sequence
  Synthetic
gggucaaacaugagggc

SEQ ID NO: 927 - RNA, 17 nt, Artificial Sequence
  Synthetic
ggcccgcgccaccgggc

SEQ ID NO: 928 - RNA, 17 nt, Artificial Sequence
  Synthetic
ggggggguggcccgggc

SEQ ID NO: 929 - RNA, 17 nt, Artificial Sequence
  Synthetic
ccuccgggcggccgggc

SEQ ID NO: 930 - RNA, 17 nt, Artificial Sequence
  Synthetic
gcgccaccgggccgggc

SEQ ID NO: 931 - RNA, 17 nt, Artificial Sequence
  Synthetic
gggcggccgggccgggc

SEQ ID NO: 932 - RNA, 17 nt, Artificial Sequence
  Synthetic
cccggggcgccgcgggc

SEQ ID NO: 933 - RNA, 17 nt, Artificial Sequence
  Synthetic
ggccacggggcgcgggc

SEQ ID NO: 934 - RNA, 17 nt, Artificial Sequence
  Synthetic
cggggcccucggcgggc

SEQ ID NO: 935 - RNA, 17 nt, Artificial Sequence
  Synthetic
gcggggggcuggcgggc

SEQ ID NO: 936 - RNA, 17 nt, Artificial Sequence
  Synthetic
caaccggcugugcgggc

SEQ ID NO: 937 - RNA, 17 nt, Artificial Sequence
  Synthetic
ggcgcgggccgucgggc

SEQ ID NO: 938 - RNA, 17 nt, Artificial Sequence
  Synthetic
gcccccgcccccggggc

SEQ ID NO: 939 - RNA, 17 nt, Artificial Sequence
  Synthetic
ggcggccgucccggggc

SEQ ID NO: 940 - RNA, 17 nt, Artificial Sequence
  Synthetic
gcacccgccccgggggc

SEQ ID NO: 941 - RNA, 17 nt, Artificial Sequence
  Synthetic
gccugggcggcgggggc

SEQ ID NO: 942 - RNA, 17 nt, Artificial Sequence
  Synthetic
gcgggcugggcgggggc

SEQ ID NO: 943 - RNA, 17 nt, Artificial Sequence
  Synthetic
cuccggccgcggggggc

SEQ ID NO: 944 - RNA, 17 nt, Artificial Sequence
  Synthetic
gacacggccgccugggc

SEQ ID NO: 945 - RNA, 17 nt, Artificial Sequence
  Synthetic
ggcgccgcgggcugggc

SEQ ID NO: 946 - RNA, 17 nt, Artificial Sequence
  Synthetic
ccgggcgaggaccuggc

SEQ ID NO: 947 - RNA, 17 nt, Artificial Sequence
  Synthetic
gugcgccgugcgcuggc

SEQ ID NO: 948 - RNA, 17 nt, Artificial Sequence
  Synthetic
gccgucccggggcuggc

SEQ ID NO: 949 - RNA, 17 nt, Artificial Sequence
  Synthetic
ggccgcggggggcuggc

SEQ ID NO: 950 - RNA, 17 nt, Artificial Sequence
  Synthetic
ggggaccugcgcguggc

SEQ ID NO: 951 - RNA, 17 nt, Artificial Sequence
  Synthetic
gucggcgucggcguggc

SEQ ID NO: 952 - RNA, 17 nt, Artificial Sequence
  Synthetic
gcccgcgcggcgguggc

SEQ ID NO: 953 - RNA, 17 nt, Artificial Sequence
  Synthetic
gggcgccgccguguggc

SEQ ID NO: 954 - RNA, 17 nt, Artificial Sequence
  Synthetic
gagccugcgcccccugc

SEQ ID NO: 955 - RNA, 17 nt, Artificial Sequence
  Synthetic
uugcgcccgcgcccugc

SEQ ID NO: 956 - RNA, 17 nt, Artificial Sequence
  Synthetic
cgggcuguccugccugc

SEQ ID NO: 957 - RNA, 17 nt, Artificial Sequence
  Synthetic
ggcccgcgccacgcugc

SEQ ID NO: 958 - RNA, 17 nt, Artificial Sequence
  Synthetic
gcuguacucgccgcugc

SEQ ID NO: 959 - RNA, 17 nt, Artificial Sequence
  Synthetic
guccgcccgggggcugc

SEQ ID NO: 960 - RNA, 17 nt, Artificial Sequence
  Synthetic
ccgccgggccgugcugc

SEQ ID NO: 961 - RNA, 17 nt, Artificial Sequence
  Synthetic
ccgcagcggcaccgugc

SEQ ID NO: 962 - RNA, 17 nt, Artificial Sequence
  Synthetic
gggggccguggaggugc

SEQ ID NO: 963 - RNA, 17 nt, Artificial Sequence
  Synthetic
ccugcgccgcacggugc

SEQ ID NO: 964 - RNA, 17 nt, Artificial Sequence
  Synthetic
uggccaaccggcugugc

SEQ ID NO: 965 - RNA, 17 nt, Artificial Sequence
  Synthetic
gcgcggcgcccgagauc

SEQ ID NO: 966 - RNA, 17 nt, Artificial Sequence
  Synthetic
ccucggggucggggauc

SEQ ID NO: 967 - RNA, 17 nt, Artificial Sequence
  Synthetic
acagcagccgcgugauc

SEQ ID NO: 968 - RNA, 17 nt, Artificial Sequence
  Synthetic
cgcucggcggaccacuc

SEQ ID NO: 969 - RNA, 17 nt, Artificial Sequence
  Synthetic
ucgaccucgucggacuc

SEQ ID NO: 970 - RNA, 17 nt, Artificial Sequence
  Synthetic
gacgccgacgcgaccuc

SEQ ID NO: 971 - RNA, 17 nt, Artificial Sequence
  Synthetic
gggcccgcgggucccuc

SEQ ID NO: 972 - RNA, 17 nt, Artificial Sequence
  Synthetic
ucgcgggccgccgccuc

SEQ ID NO: 973 - RNA, 17 nt, Artificial Sequence
  Synthetic
cgcgccuccuccgccuc

SEQ ID NO: 974 - RNA, 17 nt, Artificial Sequence
  Synthetic
ggcccccugcgcgccuc

SEQ ID NO: 975 - RNA, 17 nt, Artificial Sequence
  Synthetic
cgccgguucgaggccuc

SEQ ID NO: 976 - RNA, 17 nt, Artificial Sequence
  Synthetic
ggccgggcggcggccuc

SEQ ID NO: 977 - RNA, 17 nt, Artificial Sequence
  Synthetic
acagccgcccgggccuc

SEQ ID NO: 978 - RNA, 17 nt, Artificial Sequence
  Synthetic
gccggcggcggggccuc

SEQ ID NO: 979 - RNA, 17 nt, Artificial Sequence
  Synthetic
cgcacggugcuggccuc

SEQ ID NO: 980 - RNA, 17 nt, Artificial Sequence
  Synthetic
accacgcgcacguccuc

SEQ ID NO: 981 - RNA, 17 nt, Artificial Sequence
  Synthetic
gcggcgucgcccagcuc

SEQ ID NO: 982 - RNA, 17 nt, Artificial Sequence
  Synthetic
gcagggggcgcaggcuc

SEQ ID NO: 983 - RNA, 17 nt, Artificial Sequence
  Synthetic
ugggcgggggcgggcuc

SEQ ID NO: 984 - RNA, 17 nt, Artificial Sequence
  Synthetic
gccugcuuccggaucuc

SEQ ID NO: 985 - RNA, 17 nt, Artificial Sequence
  Synthetic
uccuccucgcagaaguc

SEQ ID NO: 986 - RNA, 17 nt, Artificial Sequence
  Synthetic
cccagcgccgacacguc

SEQ ID NO: 987 - RNA, 17 nt, Artificial Sequence
  Synthetic
gcgaggcgcgggccguc

SEQ ID NO: 988 - RNA, 17 nt, Artificial Sequence
  Synthetic
cccauggccuccgcguc

SEQ ID NO: 989 - RNA, 17 nt, Artificial Sequence
  Synthetic
cgcagcggcggcgcguc

SEQ ID NO: 990 - RNA, 17 nt, Artificial Sequence
  Synthetic
agcgcgucggcggcguc

SEQ ID NO: 991 - RNA, 17 nt, Artificial Sequence
  Synthetic
gcguggcgggcggcguc

SEQ ID NO: 992 - RNA, 17 nt, Artificial Sequence
  Synthetic
gggggggcgucgucguc

SEQ ID NO: 993 - RNA, 17 nt, Artificial Sequence
  Synthetic
cgcacguccucgggguc

SEQ ID NO: 994 - RNA, 17 nt, Artificial Sequence
  Synthetic
cagccgcccaggggguc

SEQ ID NO: 995 - RNA, 17 nt, Artificial Sequence
  Synthetic
gcccaggcggccguguc

SEQ ID NO: 996 - RNA, 17 nt, Artificial Sequence
  Synthetic
augggcaccggcguguc

SEQ ID NO: 997 - RNA, 17 nt, Artificial Sequence
  Synthetic
uggaccaggccugcuuc

SEQ ID NO: 998 - RNA, 17 nt, Artificial Sequence
  Synthetic
cgcucuucuucgucuuc

SEQ ID NO: 999 - RNA, 17 nt, Artificial Sequence
  Synthetic
ggaccacgcgcggguuc

SEQ ID NO: 1000 - RNA, 17 nt, Artificial Sequence
  Synthetic
cggggccguggaguuuc

SEQ ID NO: 1001 - RNA, 17 nt, Artificial Sequence
  Synthetic
cgcgcagggggccaaag

SEQ ID NO: 1002 - RNA, 17 nt, Artificial Sequence
  Synthetic
ggacgacgaggacgaag

SEQ ID NO: 1003 - RNA, 17 nt, Artificial Sequence
  Synthetic
ccaggccccagccgaag

SEQ ID NO: 1004 - RNA, 17 nt, Artificial Sequence
  Synthetic
cggcggcggcggggaag

SEQ ID NO: 1005 - RNA, 17 nt, Artificial Sequence
  Synthetic
gcugcccggccgugaag

SEQ ID NO: 1006 - RNA, 17 nt, Artificial Sequence
  Synthetic
uucucgcgcgccaacag

SEQ ID NO: 1007 - RNA, 17 nt, Artificial Sequence
  Synthetic
caggggacggggaacag

SEQ ID NO: 1008 - RNA, 17 nt, Artificial Sequence
  Synthetic
ucgccgcgcagcaccag

SEQ ID NO: 1009 - RNA, 17 nt, Artificial Sequence
  Synthetic
ccucgggcgccccccag

SEQ ID NO: 1010 - RNA, 17 nt, Artificial Sequence
  Synthetic
cgccgccagccgcccag

SEQ ID NO: 1011 - RNA, 17 nt, Artificial Sequence
  Synthetic
ugagggccggucgccag

SEQ ID NO: 1012 - RNA, 17 nt, Artificial Sequence
  Synthetic
gccgccgccgccagcag

SEQ ID NO: 1013 - RNA, 17 nt, Artificial Sequence
  Synthetic
acguacacgggccgcag

SEQ ID NO: 1014 - RNA, 17 nt, Artificial Sequence
  Synthetic
ucggccacgggccgcag

SEQ ID NO: 1015 - RNA, 17 nt, Artificial Sequence
  Synthetic
gggcccgaggcgcgcag

SEQ ID NO: 1016 - RNA, 17 nt, Artificial Sequence
  Synthetic
ccgcggcacaggcgcag

SEQ ID NO: 1017 - RNA, 17 nt, Artificial Sequence
  Synthetic
gccgccaugcggcgcag

SEQ ID NO: 1018 - RNA, 17 nt, Artificial Sequence
  Synthetic
agguccucgcccggcag

SEQ ID NO: 1019 - RNA, 17 nt, Artificial Sequence
  Synthetic
cgcgacggguacgucag

SEQ ID NO: 1020 - RNA, 17 nt, Artificial Sequence
  Synthetic
ccgaagacgaagaagag

SEQ ID NO: 1021 - RNA, 17 nt, Artificial Sequence
  Synthetic
ggcgcggccucggagag

SEQ ID NO: 1022 - RNA, 17 nt, Artificial Sequence
  Synthetic
ccggcgcagaugacgag

SEQ ID NO: 1023 - RNA, 17 nt, Artificial Sequence
  Synthetic
cgcaggcggcgugcgag

SEQ ID NO: 1024 - RNA, 17 nt, Artificial Sequence
  Synthetic
acggcggcgcguucgag

SEQ ID NO: 1025 - RNA, 17 nt, Artificial Sequence
  Synthetic
cgggggggccgccggag

SEQ ID NO: 1026 - RNA, 17 nt, Artificial Sequence
  Synthetic
ugggcgcggccucggag

SEQ ID NO: 1027 - RNA, 17 nt, Artificial Sequence
  Synthetic
ccgccgcgccgcgggag

SEQ ID NO: 1028 - RNA, 17 nt, Artificial Sequence
  Synthetic
ggcgcgggcgcggggag

SEQ ID NO: 1029 - RNA, 17 nt, Artificial Sequence
  Synthetic
gccccgggggcguggag

SEQ ID NO: 1030 - RNA, 17 nt, Artificial Sequence
  Synthetic
guuggcgcgcgagaacg

SEQ ID NO: 1031 - RNA, 17 nt, Artificial Sequence
  Synthetic
cccccgggccgaacacg

SEQ ID NO: 1032 - RNA, 17 nt, Artificial Sequence
  Synthetic
uaacccccacccccacg

SEQ ID NO: 1033 - RNA, 17 nt, Artificial Sequence
  Synthetic
ggcgcgacacggccacg

SEQ ID NO: 1034 - RNA, 17 nt, Artificial Sequence
  Synthetic
ggcacucgacggccacg

SEQ ID NO: 1035 - RNA, 17 nt, Artificial Sequence
  Synthetic
ugcugcugcuguccacg

SEQ ID NO: 1036 - RNA, 17 nt, Artificial Sequence
  Synthetic
gucgccgccgccgcacg

SEQ ID NO: 1037 - RNA, 17 nt, Artificial Sequence
  Synthetic
cuggggccuggcgcacg

SEQ ID NO: 1038 - RNA, 17 nt, Artificial Sequence
  Synthetic
cgaagcgcgugcgcacg

SEQ ID NO: 1039 - RNA, 17 nt, Artificial Sequence
  Synthetic
aguacgcccugaucacg

SEQ ID NO: 1040 - RNA, 17 nt, Artificial Sequence
  Synthetic
cgacgacggcaacgacg

SEQ ID NO: 1041 - RNA, 17 nt, Artificial Sequence
  Synthetic
agaggaugcggacgacg

SEQ ID NO: 1042 - RNA, 17 nt, Artificial Sequence
  Synthetic
guccucgucggacgacg

SEQ ID NO: 1043 - RNA, 17 nt, Artificial Sequence
  Synthetic
ggacccggaguccgacg

SEQ ID NO: 1044 - RNA, 17 nt, Artificial Sequence
  Synthetic
guccucgucguccgacg

SEQ ID NO: 1045 - RNA, 17 nt, Artificial Sequence
  Synthetic
ugcggacgacgaggacg

SEQ ID NO: 1046 - RNA, 17 nt, Artificial Sequence
  Synthetic
gucguccgacgaggacg

SEQ ID NO: 1047 - RNA, 17 nt, Artificial Sequence
  Synthetic
gcuguacaccccggacg

SEQ ID NO: 1048 - RNA, 17 nt, Artificial Sequence
  Synthetic
ccggucgccaggggacg

SEQ ID NO: 1049 - RNA, 17 nt, Artificial Sequence
  Synthetic
cgugguccccggggacg

SEQ ID NO: 1050 - RNA, 17 nt, Artificial Sequence
  Synthetic
cgcguucgagggggacg

SEQ ID NO: 1051 - RNA, 17 nt, Artificial Sequence
  Synthetic
cgccggcgcagaugacg

SEQ ID NO: 1052 - RNA, 17 nt, Artificial Sequence
  Synthetic
agaacgcggcgcugacg

SEQ ID NO: 1053 - RNA, 17 nt, Artificial Sequence
  Synthetic
gcugcggcccguguacg

SEQ ID NO: 1054 - RNA, 17 nt, Artificial Sequence
  Synthetic
gugcugccgcgacaccg

SEQ ID NO: 1055 - RNA, 17 nt, Artificial Sequence
  Synthetic
gcggccggagggacccg

SEQ ID NO: 1056 - RNA, 17 nt, Artificial Sequence
  Synthetic
cccucauguuugacccg

SEQ ID NO: 1057 - RNA, 17 nt, Artificial Sequence
  Synthetic
ccagauccccgaccccg

SEQ ID NO: 1058 - RNA, 17 nt, Artificial Sequence
  Synthetic
ggcggcgaggacccccg

SEQ ID NO: 1059 - RNA, 17 nt, Artificial Sequence
  Synthetic
cuccggcggcccccccg

SEQ ID NO: 1060 - RNA, 17 nt, Artificial Sequence
  Synthetic
ggcccgccagccccccg

SEQ ID NO: 1061 - RNA, 17 nt, Artificial Sequence
  Synthetic
ggggucgucgccccccg

SEQ ID NO: 1062 - RNA, 17 nt, Artificial Sequence
  Synthetic
ggcggcggcagcccccg

SEQ ID NO: 1063 - RNA, 17 nt, Artificial Sequence
  Synthetic
gcuuggccacgcccccg

SEQ ID NO: 1064 - RNA, 17 nt, Artificial Sequence
  Synthetic
cccccuccacgcccccg

SEQ ID NO: 1065 - RNA, 17 nt, Artificial Sequence
  Synthetic
ccgggcccccgcccccg

SEQ ID NO: 1066 - RNA, 17 nt, Artificial Sequence
  Synthetic
cgcgcccgccucccccg

SEQ ID NO: 1067 - RNA, 17 nt, Artificial Sequence
  Synthetic
guacagcacccgccccg

SEQ ID NO: 1068 - RNA, 17 nt, Artificial Sequence
  Synthetic
ggcccgcccgcgccccg

SEQ ID NO: 1069 - RNA, 17 nt, Artificial Sequence
  Synthetic
ggcccccggcggccccg

SEQ ID NO: 1070 - RNA, 17 nt, Artificial Sequence
  Synthetic
ggcgggcucgggccccg

SEQ ID NO: 1071 - RNA, 17 nt, Artificial Sequence
  Synthetic
cguguggcugggccccg

SEQ ID NO: 1072 - RNA, 17 nt, Artificial Sequence
  Synthetic
ggcggcgaggauccccg

SEQ ID NO: 1073 - RNA, 17 nt, Artificial Sequence
  Synthetic
ggcgccggggcuccccg

SEQ ID NO: 1074 - RNA, 17 nt, Artificial Sequence
  Synthetic
ccagcgccacguccccg

SEQ ID NO: 1075 - RNA, 17 nt, Artificial Sequence
  Synthetic
cccgcgcgugguccccg

SEQ ID NO: 1076 - RNA, 17 nt, Artificial Sequence
  Synthetic
ggcgucggugguccccg

SEQ ID NO: 1077 - RNA, 17 nt, Artificial Sequence
  Synthetic
cgcccccgcccagcccg

SEQ ID NO: 1078 - RNA, 17 nt, Artificial Sequence
  Synthetic
guccucgccgccgcccg

SEQ ID NO: 1079 - RNA, 17 nt, Artificial Sequence
  Synthetic
ggggcggcguccgcccg

SEQ ID NO: 1080 - RNA, 17 nt, Artificial Sequence
  Synthetic
ccacacggcggcgcccg

SEQ ID NO: 1081 - RNA, 17 nt, Artificial Sequence
  Synthetic
ggccgccggggcgcccg

SEQ ID NO: 1082 - RNA, 17 nt, Artificial Sequence
  Synthetic
ccucuggggggcgcccg

SEQ ID NO: 1083 - RNA, 17 nt, Artificial Sequence
  Synthetic
gcgacgacgacggcccg

SEQ ID NO: 1084 - RNA, 17 nt, Artificial Sequence
  Synthetic
ggccgugaagcggcccg

SEQ ID NO: 1085 - RNA, 17 nt, Artificial Sequence
  Synthetic
gccgaacacgcggcccg

SEQ ID NO: 1086 - RNA, 17 nt, Artificial Sequence
  Synthetic
ugcgccgcggcggcccg

SEQ ID NO: 1087 - RNA, 17 nt, Artificial Sequence
  Synthetic
gcgcucgaugcggcccg

SEQ ID NO: 1088 - RNA, 17 nt, Artificial Sequence
  Synthetic
ggugccgcugcggcccg

SEQ ID NO: 1089 - RNA, 17 nt, Artificial Sequence
  Synthetic
gccgcguguucggcccg

SEQ ID NO: 1090 - RNA, 17 nt, Artificial Sequence
  Synthetic
aucgaggccagggcccg

SEQ ID NO: 1091 - RNA, 17 nt, Artificial Sequence
  Synthetic
gcccgccgacgggcccg

SEQ ID NO: 1092 - RNA, 17 nt, Artificial Sequence
  Synthetic
gcggcgcagcgggcccg

SEQ ID NO: 1093 - RNA, 17 nt, Artificial Sequence
  Synthetic
cggggaagcggggcccg

SEQ ID NO: 1094 - RNA, 17 nt, Artificial Sequence
  Synthetic
gcgccuccaggaucccg

SEQ ID NO: 1095 - RNA, 17 nt, Artificial Sequence
  Synthetic
cgcuugcgccccucccg

SEQ ID NO: 1096 - RNA, 17 nt, Artificial Sequence
  Synthetic
accuggcggccgucccg

SEQ ID NO: 1097 - RNA, 17 nt, Artificial Sequence
  Synthetic
ggcaggcgcgggucccg

SEQ ID NO: 1098 - RNA, 17 nt, Artificial Sequence
  Synthetic
cgcgggcguccgagccg

SEQ ID NO: 1099 - RNA, 17 nt, Artificial Sequence
  Synthetic
acgucagcggggagccg

SEQ ID NO: 1100 - RNA, 17 nt, Artificial Sequence
  Synthetic
uccagcucgacccgccg

SEQ ID NO: 1101 - RNA, 17 nt, Artificial Sequence
  Synthetic
gucgcgccggcccgccg

SEQ ID NO: 1102 - RNA, 17 nt, Artificial Sequence
  Synthetic
uccacaacuucccgccg

SEQ ID NO: 1103 - RNA, 17 nt, Artificial Sequence
  Synthetic
cgcggccgccgccgccg

SEQ ID NO: 1104 - RNA, 17 nt, Artificial Sequence
  Synthetic
cggcagcgaggccgccg

SEQ ID NO: 1105 - RNA, 17 nt, Artificial Sequence
  Synthetic
cgcccacacggccgccg

SEQ ID NO: 1106 - RNA, 17 nt, Artificial Sequence
  Synthetic
gcacgcggcggccgccg

SEQ ID NO: 1107 - RNA, 17 nt, Artificial Sequence
  Synthetic
ggcgccccgggccgccg

SEQ ID NO: 1108 - RNA, 17 nt, Artificial Sequence
  Synthetic
cccccacggggccgccg

SEQ ID NO: 1109 - RNA, 17 nt, Artificial Sequence
  Synthetic
agcgcacguugccgccg

SEQ ID NO: 1110 - RNA, 17 nt, Artificial Sequence
  Synthetic
ccgccuccgccgcgccg

SEQ ID NO: 1111 - RNA, 17 nt, Artificial Sequence
  Synthetic
cugcuccccgcgcgccg

SEQ ID NO: 1112 - RNA, 17 nt, Artificial Sequence
  Synthetic
cgccggguacggcgccg

SEQ ID NO: 1113 - RNA, 17 nt, Artificial Sequence
  Synthetic
caucugcgccggcgccg

SEQ ID NO: 1114 - RNA, 17 nt, Artificial Sequence
  Synthetic
ggcggcccggggcgccg

SEQ ID NO: 1115 - RNA, 17 nt, Artificial Sequence
  Synthetic
cgggcgggccugcgccg

SEQ ID NO: 1116 - RNA, 17 nt, Artificial Sequence
  Synthetic
cgugagccuggucgccg

SEQ ID NO: 1117 - RNA, 17 nt, Artificial Sequence
  Synthetic
ggaccuggccuucgccg

SEQ ID NO: 1118 - RNA, 17 nt, Artificial Sequence
  Synthetic
gcggcccgcggaggccg

SEQ ID NO: 1119 - RNA, 17 nt, Artificial Sequence
  Synthetic
gcgggucccuccggccg

SEQ ID NO: 1120 - RNA, 17 nt, Artificial Sequence
  Synthetic
cgcggcggcggcggccg

SEQ ID NO: 1121 - RNA, 17 nt, Artificial Sequence
  Synthetic
cuccagggcggcggccg

SEQ ID NO: 1122 - RNA, 17 nt, Artificial Sequence
  Synthetic
cccgguggcgcgggccg

SEQ ID NO: 1123 - RNA, 17 nt, Artificial Sequence
  Synthetic
ggccuucgccggggccg

SEQ ID NO: 1124 - RNA, 17 nt, Artificial Sequence
  Synthetic
ggcgcugacgggggccg

SEQ ID NO: 1125 - RNA, 17 nt, Artificial Sequence
  Synthetic
ggcggcggcgggggccg

SEQ ID NO: 1126 - RNA, 17 nt, Artificial Sequence
  Synthetic
ccuggaggcgcuggccg

SEQ ID NO: 1127 - RNA, 17 nt, Artificial Sequence
  Synthetic
cgucccggggcuggccg

SEQ ID NO: 1128 - RNA, 17 nt, Artificial Sequence
  Synthetic
gcugcggcccguggccg

SEQ ID NO: 1129 - RNA, 17 nt, Artificial Sequence
  Synthetic
ugccuggccgccugccg

SEQ ID NO: 1130 - RNA, 17 nt, Artificial Sequence
  Synthetic
ugggccccgcgcugccg

SEQ ID NO: 1131 - RNA, 17 nt, Artificial Sequence
  Synthetic
ccgcugcgccugugccg

SEQ ID NO: 1132 - RNA, 17 nt, Artificial Sequence
  Synthetic
gcgcaaaagucccuccg

SEQ ID NO: 1133 - RNA, 17 nt, Artificial Sequence
  Synthetic
gacccccgcggccuccg

SEQ ID NO: 1134 - RNA, 17 nt, Artificial Sequence
  Synthetic
gcgccugccgagcuccg

SEQ ID NO: 1135 - RNA, 17 nt, Artificial Sequence
  Synthetic
gccacccccccucuccg

SEQ ID NO: 1136 - RNA, 17 nt, Artificial Sequence
  Synthetic
cauggccuccgcguccg

SEQ ID NO: 1137 - RNA, 17 nt, Artificial Sequence
  Synthetic
gucaaacagcagguccg

SEQ ID NO: 1138 - RNA, 17 nt, Artificial Sequence
  Synthetic
gcggcggcggggaagcg

SEQ ID NO: 1139 - RNA, 17 nt, Artificial Sequence
  Synthetic
gccgcgcagcaccagcg

SEQ ID NO: 1140 - RNA, 17 nt, Artificial Sequence
  Synthetic
cuucaucaccggcagcg

SEQ ID NO: 1141 - RNA, 17 nt, Artificial Sequence
  Synthetic
cgggucccgcggcagcg

SEQ ID NO: 1142 - RNA, 17 nt, Artificial Sequence
  Synthetic
cguggccggcggcagcg

SEQ ID NO: 1143 - RNA, 17 nt, Artificial Sequence
  Synthetic
cgacggguacgucagcg

SEQ ID NO: 1144 - RNA, 17 nt, Artificial Sequence
  Synthetic
gagugguccgccgagcg

SEQ ID NO: 1145 - RNA, 17 nt, Artificial Sequence
  Synthetic
gcgggguccgucgagcg

SEQ ID NO: 1146 - RNA, 17 nt, Artificial Sequence
  Synthetic
uccccggggaccacgcg

SEQ ID NO: 1147 - RNA, 17 nt, Artificial Sequence
  Synthetic
ggccgaccacgcacgcg

SEQ ID NO: 1148 - RNA, 17 nt, Artificial Sequence
  Synthetic
gggcccggcgcaccgcg

SEQ ID NO: 1149 - RNA, 17 nt, Artificial Sequence
  Synthetic
ggucgucgccccccgcg

SEQ ID NO: 1150 - RNA, 17 nt, Artificial Sequence
  Synthetic
cgcccgccucccccgcg

SEQ ID NO: 1151 - RNA, 17 nt, Artificial Sequence
  Synthetic
gcgccgccgggcccgcg

SEQ ID NO: 1152 - RNA, 17 nt, Artificial Sequence
  Synthetic
gaaggccaggucccgcg

SEQ ID NO: 1153 - RNA, 17 nt, Artificial Sequence
  Synthetic
ggccggccaccgccgcg

SEQ ID NO: 1154 - RNA, 17 nt, Artificial Sequence
  Synthetic
cacaacuucccgccgcg

SEQ ID NO: 1155 - RNA, 17 nt, Artificial Sequence
  Synthetic
ccggguacggcgccgcg

SEQ ID NO: 1156 - RNA, 17 nt, Artificial Sequence
  Synthetic
uggccucgaucgccgcg

SEQ ID NO: 1157 - RNA, 17 nt, Artificial Sequence
  Synthetic
ggcccgcggaggccgcg

SEQ ID NO: 1158 - RNA, 17 nt, Artificial Sequence
  Synthetic
cgcccaggccggccgcg

SEQ ID NO: 1159 - RNA, 17 nt, Artificial Sequence
  Synthetic
gggucccuccggccgcg

SEQ ID NO: 1160 - RNA, 17 nt, Artificial Sequence
  Synthetic
cgcugacgggggccgcg

SEQ ID NO: 1161 - RNA, 17 nt, Artificial Sequence
  Synthetic
ggucccgcggcagcgcg

SEQ ID NO: 1162 - RNA, 17 nt, Artificial Sequence
  Synthetic
cgcaccgggcgagcgcg

SEQ ID NO: 1163 - RNA, 17 nt, Artificial Sequence
  Synthetic
gcuccagaacccgcgcg

SEQ ID NO: 1164 - RNA, 17 nt, Artificial Sequence
  Synthetic
gggggucuucgcgcgcg

SEQ ID NO: 1165 - RNA, 17 nt, Artificial Sequence
  Synthetic
cucggccacggcgcgcg

SEQ ID NO: 1166 - RNA, 17 nt, Artificial Sequence
  Synthetic
cgccccgccugcgcgcg

SEQ ID NO: 1167 - RNA, 17 nt, Artificial Sequence
  Synthetic
ccggcgguacucgcgcg

SEQ ID NO: 1168 - RNA, 17 nt, Artificial Sequence
  Synthetic
agcucggccacggcgcg

SEQ ID NO: 1169 - RNA, 17 nt, Artificial Sequence
  Synthetic
aggggggcgcgggcgcg

SEQ ID NO: 1170 - RNA, 17 nt, Artificial Sequence
  Synthetic
cguggcgcuggggcgcg

SEQ ID NO: 1171 - RNA, 17 nt, Artificial Sequence
  Synthetic
gcgcggggaccugcgcg

SEQ ID NO: 1172 - RNA, 17 nt, Artificial Sequence
  Synthetic
gcucaugcgccugcgcg

SEQ ID NO: 1173 - RNA, 17 nt, Artificial Sequence
  Synthetic
ggaagcccuucugcgcg

SEQ ID NO: 1174 - RNA, 17 nt, Artificial Sequence
  Synthetic
ccccgaggacgugcgcg

SEQ ID NO: 1175 - RNA, 17 nt, Artificial Sequence
  Synthetic
ggagcugcuguugcgcg

SEQ ID NO: 1176 - RNA, 17 nt, Artificial Sequence
  Synthetic
gcccggcgguacucgcg

SEQ ID NO: 1177 - RNA, 17 nt, Artificial Sequence
  Synthetic
agccacgcgcgcaggcg

SEQ ID NO: 1178 - RNA, 17 nt, Artificial Sequence
  Synthetic
gcggagcucggcaggcg

SEQ ID NO: 1179 - RNA, 17 nt, Artificial Sequence
  Synthetic
accacgcacgcgaggcg

SEQ ID NO: 1180 - RNA, 17 nt, Artificial Sequence
  Synthetic
acaggggcgcguaggcg

SEQ ID NO: 1181 - RNA, 17 nt, Artificial Sequence
  Synthetic
gacgaagaagagcggcg

SEQ ID NO: 1182 - RNA, 17 nt, Artificial Sequence
  Synthetic
gcgccccucccgcggcg

SEQ ID NO: 1183 - RNA, 17 nt, Artificial Sequence
  Synthetic
ggaccuggccggcggcg

SEQ ID NO: 1184 - RNA, 17 nt, Artificial Sequence
  Synthetic
ugcgcuggccggcggcg

SEQ ID NO: 1185 - RNA, 17 nt, Artificial Sequence
  Synthetic
ggcgugcggcggcggcg

SEQ ID NO: 1186 - RNA, 17 nt, Artificial Sequence
  Synthetic
agccccgggcggcggcg

SEQ ID NO: 1187 - RNA, 17 nt, Artificial Sequence
  Synthetic
ccgugcuggcggcggcg

SEQ ID NO: 1188 - RNA, 17 nt, Artificial Sequence
  Synthetic
gccgccccagggcggcg

SEQ ID NO: 1189 - RNA, 17 nt, Artificial Sequence
  Synthetic
acgcggccugggcggcg

SEQ ID NO: 1190 - RNA, 17 nt, Artificial Sequence
  Synthetic
cgucgucggcgucggcg

SEQ ID NO: 1191 - RNA, 17 nt, Artificial Sequence
  Synthetic
cgggcuccagcagggcg

SEQ ID NO: 1192 - RNA, 17 nt, Artificial Sequence
  Synthetic
gggggguggcccgggcg

SEQ ID NO: 1193 - RNA, 17 nt, Artificial Sequence
  Synthetic
cucgccgcugccgggcg

SEQ ID NO: 1194 - RNA, 17 nt, Artificial Sequence
  Synthetic
ggaggggggcgcgggcg

SEQ ID NO: 1195 - RNA, 17 nt, Artificial Sequence
  Synthetic
cgcgggggaggcgggcg

SEQ ID NO: 1196 - RNA, 17 nt, Artificial Sequence
  Synthetic
gcgcgggccgucgggcg

SEQ ID NO: 1197 - RNA, 17 nt, Artificial Sequence
  Synthetic
gacacggccacggggcg

SEQ ID NO: 1198 - RNA, 17 nt, Artificial Sequence
  Synthetic
cacccgccccgggggcg

SEQ ID NO: 1199 - RNA, 17 nt, Artificial Sequence
  Synthetic
cucgggccccgggggcg

SEQ ID NO: 1200 - RNA, 17 nt, Artificial Sequence
  Synthetic
uucccgccgcgggggcg

SEQ ID NO: 1201 - RNA, 17 nt, Artificial Sequence
  Synthetic
gcgcggggaggggggcg

SEQ ID NO: 1202 - RNA, 17 nt, Artificial Sequence
  Synthetic
gggcguggaggggggcg

SEQ ID NO: 1203 - RNA, 17 nt, Artificial Sequence
  Synthetic
cgcggccggccugggcg

SEQ ID NO: 1204 - RNA, 17 nt, Artificial Sequence
  Synthetic
gcgccgcgggcugggcg

SEQ ID NO: 1205 - RNA, 17 nt, Artificial Sequence
  Synthetic
cgcccggggcuugggcg

SEQ ID NO: 1206 - RNA, 17 nt, Artificial Sequence
  Synthetic
ucaccggcagcguggcg

SEQ ID NO: 1207 - RNA, 17 nt, Artificial Sequence
  Synthetic
ggcccggcccgguggcg

SEQ ID NO: 1208 - RNA, 17 nt, Artificial Sequence
  Synthetic
gugcucaugcgccugcg

SEQ ID NO: 1209 - RNA, 17 nt, Artificial Sequence
  Synthetic
cagggcguacugcugcg

SEQ ID NO: 1210 - RNA, 17 nt, Artificial Sequence
  Synthetic
cccccgcuggugcugcg

SEQ ID NO: 1211 - RNA, 17 nt, Artificial Sequence
  Synthetic
cgcgccggacuucugcg

SEQ ID NO: 1212 - RNA, 17 nt, Artificial Sequence
  Synthetic
guacaggcgcgcgugcg

SEQ ID NO: 1213 - RNA, 17 nt, Artificial Sequence
  Synthetic
cccgcgccucgcgugcg

SEQ ID NO: 1214 - RNA, 17 nt, Artificial Sequence
  Synthetic
cgaccggcggcucaucg

SEQ ID NO: 1215 - RNA, 17 nt, Artificial Sequence
  Synthetic
gcaccgcgcggcgaucg

SEQ ID NO: 1216 - RNA, 17 nt, Artificial Sequence
  Synthetic
gccgggcggcggccucg

SEQ ID NO: 1217 - RNA, 17 nt, Artificial Sequence
  Synthetic
ccggcggcggggccucg

SEQ ID NO: 1218 - RNA, 17 nt, Artificial Sequence
  Synthetic
ccacgcgcacguccucg

SEQ ID NO: 1219 - RNA, 17 nt, Artificial Sequence
  Synthetic
ccagcgccgacacgucg

SEQ ID NO: 1220 - RNA, 17 nt, Artificial Sequence
  Synthetic
gcagcggcggcgcgucg

SEQ ID NO: 1221 - RNA, 17 nt, Artificial Sequence
  Synthetic
cguggcgggcggcgucg

SEQ ID NO: 1222 - RNA, 17 nt, Artificial Sequence
  Synthetic
agcggcccguggcgucg

SEQ ID NO: 1223 - RNA, 17 nt, Artificial Sequence
  Synthetic
gcacguccucggggucg

SEQ ID NO: 1224 - RNA, 17 nt, Artificial Sequence
  Synthetic
agccgcccagggggucg

SEQ ID NO: 1225 - RNA, 17 nt, Artificial Sequence
  Synthetic
uucgucuucgggggucg

SEQ ID NO: 1226 - RNA, 17 nt, Artificial Sequence
  Synthetic
acgggcccgcggugucg

SEQ ID NO: 1227 - RNA, 17 nt, Artificial Sequence
  Synthetic
gcucuucuucgucuucg

SEQ ID NO: 1228 - RNA, 17 nt, Artificial Sequence
  Synthetic
cgacggcggcgcguucg

SEQ ID NO: 1229 - RNA, 17 nt, Artificial Sequence
  Synthetic
ggcgcgacgccgguucg

SEQ ID NO: 1230 - RNA, 17 nt, Artificial Sequence
  Synthetic
ccauggcguagcccagg

SEQ ID NO: 1231 - RNA, 17 nt, Artificial Sequence
  Synthetic
ccaauugcccgcccagg

SEQ ID NO: 1232 - RNA, 17 nt, Artificial Sequence
  Synthetic
gccgccagccgcccagg

SEQ ID NO: 1233 - RNA, 17 nt, Artificial Sequence
  Synthetic
ccgccgccgccagcagg

SEQ ID NO: 1234 - RNA, 17 nt, Artificial Sequence
  Synthetic
gcagccacgcgcgcagg

SEQ ID NO: 1235 - RNA, 17 nt, Artificial Sequence
  Synthetic
gccccagcgcgcgcagg

SEQ ID NO: 1236 - RNA, 17 nt, Artificial Sequence
  Synthetic
ggcccgaggcgcgcagg

SEQ ID NO: 1237 - RNA, 17 nt, Artificial Sequence
  Synthetic
caggaucccgcggcagg

SEQ ID NO: 1238 - RNA, 17 nt, Artificial Sequence
  Synthetic
gcagggggccaaagagg

SEQ ID NO: 1239 - RNA, 17 nt, Artificial Sequence
  Synthetic
gcgcggccucggagagg

SEQ ID NO: 1240 - RNA, 17 nt, Artificial Sequence
  Synthetic
cggcgcagaugacgagg

SEQ ID NO: 1241 - RNA, 17 nt, Artificial Sequence
  Synthetic
cuggggggcgcccgagg

SEQ ID NO: 1242 - RNA, 17 nt, Artificial Sequence
  Synthetic
ggcgcuggggcgcgagg

SEQ ID NO: 1243 - RNA, 17 nt, Artificial Sequence
  Synthetic
gccggacuucugcgagg

SEQ ID NO: 1244 - RNA, 17 nt, Artificial Sequence
  Synthetic
cggcggcgcguucgagg

SEQ ID NO: 1245 - RNA, 17 nt, Artificial Sequence
  Synthetic
ggacuucugcgaggagg

SEQ ID NO: 1246 - RNA, 17 nt, Artificial Sequence
  Synthetic
gcccggccgcccggagg

SEQ ID NO: 1247 - RNA, 17 nt, Artificial Sequence
  Synthetic
ggcgcccgaggcggagg

SEQ ID NO: 1248 - RNA, 17 nt, Artificial Sequence
  Synthetic
ccgcggcgcggcggagg

SEQ ID NO: 1249 - RNA, 17 nt, Artificial Sequence
  Synthetic
ggugcugggggcggagg

SEQ ID NO: 1250 - RNA, 17 nt, Artificial Sequence
  Synthetic
gcgcgggcgcggggagg

SEQ ID NO: 1251 - RNA, 17 nt, Artificial Sequence
  Synthetic
gccccccgcgggggagg

SEQ ID NO: 1252 - RNA, 17 nt, Artificial Sequence
  Synthetic
ccccgggggcguggagg

SEQ ID NO: 1253 - RNA, 17 nt, Artificial Sequence
  Synthetic
ggggcccagccacacgg

SEQ ID NO: 1254 - RNA, 17 nt, Artificial Sequence
  Synthetic
gcgcacggcggccacgg

SEQ ID NO: 1255 - RNA, 17 nt, Artificial Sequence
  Synthetic
gcggcucauggccacgg

SEQ ID NO: 1256 - RNA, 17 nt, Artificial Sequence
  Synthetic
gcucacggcgcgcacgg

SEQ ID NO: 1257 - RNA, 17 nt, Artificial Sequence
  Synthetic
cacggcgcacugcacgg

SEQ ID NO: 1258 - RNA, 17 nt, Artificial Sequence
  Synthetic
ugggacgaagacgacgg

SEQ ID NO: 1259 - RNA, 17 nt, Artificial Sequence
  Synthetic
ugcggcggcggcgacgg

SEQ ID NO: 1260 - RNA, 17 nt, Artificial Sequence
  Synthetic
gaacgcggcgcugacgg

SEQ ID NO: 1261 - RNA, 17 nt, Artificial Sequence
  Synthetic
gggcgggugcuguacgg

SEQ ID NO: 1262 - RNA, 17 nt, Artificial Sequence
  Synthetic
ccagcgccggcgaccgg

SEQ ID NO: 1263 - RNA, 17 nt, Artificial Sequence
  Synthetic
cgcggcgccguacccgg

SEQ ID NO: 1264 - RNA, 17 nt, Artificial Sequence
  Synthetic
aaagaggcggcccccgg

SEQ ID NO: 1265 - RNA, 17 nt, Artificial Sequence
  Synthetic
cggccgggcagccccgg

SEQ ID NO: 1266 - RNA, 17 nt, Artificial Sequence
  Synthetic
uacagcacccgccccgg

SEQ ID NO: 1267 - RNA, 17 nt, Artificial Sequence
  Synthetic
ggccucgggcgccccgg

SEQ ID NO: 1268 - RNA, 17 nt, Artificial Sequence
  Synthetic
gcgggcucgggccccgg

SEQ ID NO: 1269 - RNA, 17 nt, Artificial Sequence
  Synthetic
guguggcugggccccgg

SEQ ID NO: 1270 - RNA, 17 nt, Artificial Sequence
  Synthetic
ccggcccggccgcccgg

SEQ ID NO: 1271 - RNA, 17 nt, Artificial Sequence
  Synthetic
gggcggcguccgcccgg

SEQ ID NO: 1272 - RNA, 17 nt, Artificial Sequence
  Synthetic
ccggcagcacggcccgg

SEQ ID NO: 1273 - RNA, 17 nt, Artificial Sequence
  Synthetic
cgacgacgacggcccgg

SEQ ID NO: 1274 - RNA, 17 nt, Artificial Sequence
  Synthetic
gcgccggcccggcccgg

SEQ ID NO: 1275 - RNA, 17 nt, Artificial Sequence
  Synthetic
ccgcguguucggcccgg

SEQ ID NO: 1276 - RNA, 17 nt, Artificial Sequence
  Synthetic
ccgccgcgcgggcccgg

SEQ ID NO: 1277 - RNA, 17 nt, Artificial Sequence
  Synthetic
gcgggcguccgagccgg

SEQ ID NO: 1278 - RNA, 17 nt, Artificial Sequence
  Synthetic
ccccacggggccgccgg

SEQ ID NO: 1279 - RNA, 17 nt, Artificial Sequence
  Synthetic
cgcguagaaggcgccgg

SEQ ID NO: 1280 - RNA, 17 nt, Artificial Sequence
  Synthetic
aucccgggcggcgccgg

SEQ ID NO: 1281 - RNA, 17 nt, Artificial Sequence
  Synthetic
cagccccccgcggccgg

SEQ ID NO: 1282 - RNA, 17 nt, Artificial Sequence
  Synthetic
ggcgaggaccuggccgg

SEQ ID NO: 1283 - RNA, 17 nt, Artificial Sequence
  Synthetic
cgccgugcgcuggccgg

SEQ ID NO: 1284 - RNA, 17 nt, Artificial Sequence
  Synthetic
gaccugcgcguggccgg

SEQ ID NO: 1285 - RNA, 17 nt, Artificial Sequence
  Synthetic
ucggcggaccacuccgg

SEQ ID NO: 1286 - RNA, 17 nt, Artificial Sequence
  Synthetic
ccgcgcagcaccagcgg

SEQ ID NO: 1287 - RNA, 17 nt, Artificial Sequence
  Synthetic
cggcacaggcgcagcgg

SEQ ID NO: 1288 - RNA, 17 nt, Artificial Sequence
  Synthetic
gggccuggcgcacgcgg

SEQ ID NO: 1289 - RNA, 17 nt, Artificial Sequence
  Synthetic
guacaccccggacgcgg

SEQ ID NO: 1290 - RNA, 17 nt, Artificial Sequence
  Synthetic
gucgucgccccccgcgg

SEQ ID NO: 1291 - RNA, 17 nt, Artificial Sequence
  Synthetic
uggccacgcccccgcgg

SEQ ID NO: 1292 - RNA, 17 nt, Artificial Sequence
  Synthetic
gcccgccucccccgcgg

SEQ ID NO: 1293 - RNA, 17 nt, Artificial Sequence
  Synthetic
cucgaugcggcccgcgg

SEQ ID NO: 1294 - RNA, 17 nt, Artificial Sequence
  Synthetic
acaacuucccgccgcgg

SEQ ID NO: 1295 - RNA, 17 nt, Artificial Sequence
  Synthetic
gcgggccugcgccgcgg

SEQ ID NO: 1296 - RNA, 17 nt, Artificial Sequence
  Synthetic
gcccgcggaggccgcgg

SEQ ID NO: 1297 - RNA, 17 nt, Artificial Sequence
  Synthetic
ggucccuccggccgcgg

SEQ ID NO: 1298 - RNA, 17 nt, Artificial Sequence
  Synthetic
gguggcgcgggccgcgg

SEQ ID NO: 1299 - RNA, 17 nt, Artificial Sequence
  Synthetic
cugcgccugugccgcgg

SEQ ID NO: 1300 - RNA, 17 nt, Artificial Sequence
  Synthetic
aaacagcagguccgcgg

SEQ ID NO: 1301 - RNA, 17 nt, Artificial Sequence
  Synthetic
ugguccgccgagcgcgg

SEQ ID NO: 1302 - RNA, 17 nt, Artificial Sequence
  Synthetic
ccgccgggcccgcgcgg

SEQ ID NO: 1303 - RNA, 17 nt, Artificial Sequence
  Synthetic
ccccucccgcggcgcgg

SEQ ID NO: 1304 - RNA, 17 nt, Artificial Sequence
  Synthetic
gggggaggcgggcgcgg

SEQ ID NO: 1305 - RNA, 17 nt, Artificial Sequence
  Synthetic
gggggcgcccgaggcgg

SEQ ID NO: 1306 - RNA, 17 nt, Artificial Sequence
  Synthetic
cggccgcccggaggcgg

SEQ ID NO: 1307 - RNA, 17 nt, Artificial Sequence
  Synthetic
cggcgcggcggaggcgg

SEQ ID NO: 1308 - RNA, 17 nt, Artificial Sequence
  Synthetic
gaggaccuggccggcgg

SEQ ID NO: 1309 - RNA, 17 nt, Artificial Sequence
  Synthetic
cagcagguccgcggcgg

SEQ ID NO: 1310 - RNA, 17 nt, Artificial Sequence
  Synthetic
ccgggcccgcgcggcgg

SEQ ID NO: 1311 - RNA, 17 nt, Artificial Sequence
  Synthetic
cucccgcggcgcggcgg

SEQ ID NO: 1312 - RNA, 17 nt, Artificial Sequence
  Synthetic
cgcggcggaggcggcgg

SEQ ID NO: 1313 - RNA, 17 nt, Artificial Sequence
  Synthetic
cagguccgcggcggcgg

SEQ ID NO: 1314 - RNA, 17 nt, Artificial Sequence
  Synthetic
cgugcuggcggcggcgg

SEQ ID NO: 1315 - RNA, 17 nt, Artificial Sequence
  Synthetic
ucggcgugcggcggcgg

SEQ ID NO: 1316 - RNA, 17 nt, Artificial Sequence
  Synthetic
cgcggccugggcggcgg

SEQ ID NO: 1317 - RNA, 17 nt, Artificial Sequence
  Synthetic
cccccugcuggcggcgg

SEQ ID NO: 1318 - RNA, 17 nt, Artificial Sequence
  Synthetic
caccgugcuggcggcgg

SEQ ID NO: 1319 - RNA, 17 nt, Artificial Sequence
  Synthetic
caggccgcgugcggcgg

SEQ ID NO: 1320 - RNA, 17 nt, Artificial Sequence
  Synthetic
gcgucggcgugcggcgg

SEQ ID NO: 1321 - RNA, 17 nt, Artificial Sequence
  Synthetic
cucgcccggugcggcgg

SEQ ID NO: 1322 - RNA, 17 nt, Artificial Sequence
  Synthetic
guaggccuccagggcgg

SEQ ID NO: 1323 - RNA, 17 nt, Artificial Sequence
  Synthetic
gcccaagccccgggcgg

SEQ ID NO: 1324 - RNA, 17 nt, Artificial Sequence
  Synthetic
ggggguggcccgggcgg

SEQ ID NO: 1325 - RNA, 17 nt, Artificial Sequence
  Synthetic
gcuggacggccgggcgg

SEQ ID NO: 1326 - RNA, 17 nt, Artificial Sequence
  Synthetic
acccgccccgggggcgg

SEQ ID NO: 1327 - RNA, 17 nt, Artificial Sequence
  Synthetic
ggaggugcugggggcgg

SEQ ID NO: 1328 - RNA, 17 nt, Artificial Sequence
  Synthetic
gcacgcggccugggcgg

SEQ ID NO: 1329 - RNA, 17 nt, Artificial Sequence
  Synthetic
cgccgcgggcugggcgg

SEQ ID NO: 1330 - RNA, 17 nt, Artificial Sequence
  Synthetic
cccugggcggcuggcgg

SEQ ID NO: 1331 - RNA, 17 nt, Artificial Sequence
  Synthetic
gcgcccccugcuggcgg

SEQ ID NO: 1332 - RNA, 17 nt, Artificial Sequence
  Synthetic
cggcaccgugcuggcgg

SEQ ID NO: 1333 - RNA, 17 nt, Artificial Sequence
  Synthetic
gcccaggccgcgugcgg

SEQ ID NO: 1334 - RNA, 17 nt, Artificial Sequence
  Synthetic
ggcgcgucggcgugcgg

SEQ ID NO: 1335 - RNA, 17 nt, Artificial Sequence
  Synthetic
gcgcucgcccggugcgg

SEQ ID NO: 1336 - RNA, 17 nt, Artificial Sequence
  Synthetic
gcgcgcggucguaucgg

SEQ ID NO: 1337 - RNA, 17 nt, Artificial Sequence
  Synthetic
ggggucggggcccucgg

SEQ ID NO: 1338 - RNA, 17 nt, Artificial Sequence
  Synthetic
cggcggcggggccucgg

SEQ ID NO: 1339 - RNA, 17 nt, Artificial Sequence
  Synthetic
cagcccgccgcgcucgg

SEQ ID NO: 1340 - RNA, 17 nt, Artificial Sequence
  Synthetic
cagcgccgacacgucgg

SEQ ID NO: 1341 - RNA, 17 nt, Artificial Sequence
  Synthetic
caccgcgggcccgucgg

SEQ ID NO: 1342 - RNA, 17 nt, Artificial Sequence
  Synthetic
ggccgccagcgcgucgg

SEQ ID NO: 1343 - RNA, 17 nt, Artificial Sequence
  Synthetic
gggcgccauggcgucgg

SEQ ID NO: 1344 - RNA, 17 nt, Artificial Sequence
  Synthetic
cucuucuucgucuucgg

SEQ ID NO: 1345 - RNA, 17 nt, Artificial Sequence
  Synthetic
ggacagccgccccaggg

SEQ ID NO: 1346 - RNA, 17 nt, Artificial Sequence
  Synthetic
gcaguaggccuccaggg

SEQ ID NO: 1347 - RNA, 17 nt, Artificial Sequence
  Synthetic
cgcggccucggagaggg

SEQ ID NO: 1348 - RNA, 17 nt, Artificial Sequence
  Synthetic
cgcgggcgcggggaggg

SEQ ID NO: 1349 - RNA, 17 nt, Artificial Sequence
  Synthetic
cccgggggcguggaggg

SEQ ID NO: 1350 - RNA, 17 nt, Artificial Sequence
  Synthetic
cgccggcagcccccggg

SEQ ID NO: 1351 - RNA, 17 nt, Artificial Sequence
  Synthetic
cgcgcccaagccccggg

SEQ ID NO: 1352 - RNA, 17 nt, Artificial Sequence
  Synthetic
ccccccagaggcccggg

SEQ ID NO: 1353 - RNA, 17 nt, Artificial Sequence
  Synthetic
aggggggguggcccggg

SEQ ID NO: 1354 - RNA, 17 nt, Artificial Sequence
  Synthetic
gcccagcgaaucccggg

SEQ ID NO: 1355 - RNA, 17 nt, Artificial Sequence
  Synthetic
ggcgcuggacggccggg

SEQ ID NO: 1356 - RNA, 17 nt, Artificial Sequence
  Synthetic
gggccgccgccuccggg

SEQ ID NO: 1357 - RNA, 17 nt, Artificial Sequence
  Synthetic
ggacggggaacagcggg

SEQ ID NO: 1358 - RNA, 17 nt, Artificial Sequence
  Synthetic
cgcgcagcaccagcggg

SEQ ID NO: 1359 - RNA, 17 nt, Artificial Sequence
  Synthetic
cccgccucccccgcggg

SEQ ID NO: 1360 - RNA, 17 nt, Artificial Sequence
  Synthetic
cuccgccgcgccgcggg

SEQ ID NO: 1361 - RNA, 17 nt, Artificial Sequence
  Synthetic
gucccuccggccgcggg

SEQ ID NO: 1362 - RNA, 17 nt, Artificial Sequence
  Synthetic
cggccacggggcgcggg

SEQ ID NO: 1363 - RNA, 17 nt, Artificial Sequence
  Synthetic
ggcgucggcguggcggg

SEQ ID NO: 1364 - RNA, 17 nt, Artificial Sequence
  Synthetic
ggcggcggggccucggg

SEQ ID NO: 1365 - RNA, 17 nt, Artificial Sequence
  Synthetic
aggcgcgggccgucggg

SEQ ID NO: 1366 - RNA, 17 nt, Artificial Sequence
  Synthetic
gcggccucggagagggg

SEQ ID NO: 1367 - RNA, 17 nt, Artificial Sequence
  Synthetic
ggcccccgcccccgggg

SEQ ID NO: 1368 - RNA, 17 nt, Artificial Sequence
  Synthetic
gcgcagcaccagcgggg

SEQ ID NO: 1369 - RNA, 17 nt, Artificial Sequence
  Synthetic
ggggcgcgggcgcgggg

SEQ ID NO: 1370 - RNA, 17 nt, Artificial Sequence
  Synthetic
gcggcggggccucgggg

SEQ ID NO: 1371 - RNA, 17 nt, Artificial Sequence
  Synthetic
agcacccgccccggggg

SEQ ID NO: 1372 - RNA, 17 nt, Artificial Sequence
  Synthetic
gucgccccccgcggggg

SEQ ID NO: 1373 - RNA, 17 nt, Artificial Sequence
  Synthetic
ggccugggcggcggggg

SEQ ID NO: 1374 - RNA, 17 nt, Artificial Sequence
  Synthetic
gguggcccgggcggggg

SEQ ID NO: 1375 - RNA, 17 nt, Artificial Sequence
  Synthetic
cgcgggcugggcggggg

SEQ ID NO: 1376 - RNA, 17 nt, Artificial Sequence
  Synthetic
gccucggagaggggggg

SEQ ID NO: 1377 - RNA, 17 nt, Artificial Sequence
  Synthetic
cguggaggugcuggggg

SEQ ID NO: 1378 - RNA, 17 nt, Artificial Sequence
  Synthetic
cggcggccccguggggg

SEQ ID NO: 1379 - RNA, 17 nt, Artificial Sequence
  Synthetic
acgcggaggccaugggg

SEQ ID NO: 1380 - RNA, 17 nt, Artificial Sequence
  Synthetic
uccucgccgcccugggg

SEQ ID NO: 1381 - RNA, 17 nt, Artificial Sequence
  Synthetic
ggccccgacccccuggg

SEQ ID NO: 1382 - RNA, 17 nt, Artificial Sequence
  Synthetic
ggacacggccgccuggg

SEQ ID NO: 1383 - RNA, 17 nt, Artificial Sequence
  Synthetic
gccgcacgcggccuggg

SEQ ID NO: 1384 - RNA, 17 nt, Artificial Sequence
  Synthetic
gggcgccgcgggcuggg

SEQ ID NO: 1385 - RNA, 17 nt, Artificial Sequence
  Synthetic
ccgcccgggccucuggg

SEQ ID NO: 1386 - RNA, 17 nt, Artificial Sequence
  Synthetic
ccugggcuacgccaugg

SEQ ID NO: 1387 - RNA, 17 nt, Artificial Sequence
  Synthetic
cccgcugcgccgcaugg

SEQ ID NO: 1388 - RNA, 17 nt, Artificial Sequence
  Synthetic
cuucgacggcgaccugg

SEQ ID NO: 1389 - RNA, 17 nt, Artificial Sequence
  Synthetic
cgcggccgccgcccugg

SEQ ID NO: 1390 - RNA, 17 nt, Artificial Sequence
  Synthetic
cugccgcgggauccugg

SEQ ID NO: 1391 - RNA, 17 nt, Artificial Sequence
  Synthetic
cgccgccgacgcgcugg

SEQ ID NO: 1392 - RNA, 17 nt, Artificial Sequence
  Synthetic
acccccugggcggcugg

SEQ ID NO: 1393 - RNA, 17 nt, Artificial Sequence
  Synthetic
cggccgcggggggcugg

SEQ ID NO: 1394 - RNA, 17 nt, Artificial Sequence
  Synthetic
ccugcgcccccugcugg

SEQ ID NO: 1395 - RNA, 17 nt, Artificial Sequence
  Synthetic
gcuguccugccugcugg

SEQ ID NO: 1396 - RNA, 17 nt, Artificial Sequence
  Synthetic
cagcggcaccgugcugg

SEQ ID NO: 1397 - RNA, 17 nt, Artificial Sequence
  Synthetic
ggccguggaggugcugg

SEQ ID NO: 1398 - RNA, 17 nt, Artificial Sequence
  Synthetic
gccgcccgggccucugg

SEQ ID NO: 1399 - RNA, 17 nt, Artificial Sequence
  Synthetic
ccccggcggccccgugg

SEQ ID NO: 1400 - RNA, 17 nt, Artificial Sequence
  Synthetic
ggcggcgggggccgugg

SEQ ID NO: 1401 - RNA, 17 nt, Artificial Sequence
  Synthetic
ggucuucgcgcgcgugg

SEQ ID NO: 1402 - RNA, 17 nt, Artificial Sequence
  Synthetic
cgaggacgugcgcgugg

SEQ ID NO: 1403 - RNA, 17 nt, Artificial Sequence
  Synthetic
cgucggcgucggcgugg

SEQ ID NO: 1404 - RNA, 17 nt, Artificial Sequence
  Synthetic
gggccccgggggcgugg

SEQ ID NO: 1405 - RNA, 17 nt, Artificial Sequence
  Synthetic
gucgucacggccggugg

SEQ ID NO: 1406 - RNA, 17 nt, Artificial Sequence
  Synthetic
cggccccgugggggugg

SEQ ID NO: 1407 - RNA, 17 nt, Artificial Sequence
  Synthetic
cccgcgggucaaacaug

SEQ ID NO: 1408 - RNA, 17 nt, Artificial Sequence
  Synthetic
gcauccaggccgccaug

SEQ ID NO: 1409 - RNA, 17 nt, Artificial Sequence
  Synthetic
cggacgcggaggccaug

SEQ ID NO: 1410 - RNA, 17 nt, Artificial Sequence
  Synthetic
cccggcggcgcucgaug

SEQ ID NO: 1411 - RNA, 17 nt, Artificial Sequence
  Synthetic
cgaggacgaagaggaug

SEQ ID NO: 1412 - RNA, 17 nt, Artificial Sequence
  Synthetic
ggauccucgccgcccug

SEQ ID NO: 1413 - RNA, 17 nt, Artificial Sequence
  Synthetic
cguggcugcgcgagcug

SEQ ID NO: 1414 - RNA, 17 nt, Artificial Sequence
  Synthetic
gccugggcgcgccgcug

SEQ ID NO: 1415 - RNA, 17 nt, Artificial Sequence
  Synthetic
ccagcacggugccgcug

SEQ ID NO: 1416 - RNA, 17 nt, Artificial Sequence
  Synthetic
gccgccugcgcgcgcug

SEQ ID NO: 1417 - RNA, 17 nt, Artificial Sequence
  Synthetic
ccguguacguggcgcug

SEQ ID NO: 1418 - RNA, 17 nt, Artificial Sequence
  Synthetic
gccggccgcuucggcug

SEQ ID NO: 1419 - RNA, 17 nt, Artificial Sequence
  Synthetic
gggccguggaggugcug

SEQ ID NO: 1420 - RNA, 17 nt, Artificial Sequence
  Synthetic
agccgcccgggccucug

SEQ ID NO: 1421 - RNA, 17 nt, Artificial Sequence
  Synthetic
gggccguggaguuucug

SEQ ID NO: 1422 - RNA, 17 nt, Artificial Sequence
  Synthetic
ccgaggccagcaccgug

SEQ ID NO: 1423 - RNA, 17 nt, Artificial Sequence
  Synthetic
cccccggcggccccgug

SEQ ID NO: 1424 - RNA, 17 nt, Artificial Sequence
  Synthetic
ccgcgggcgccgccgug

SEQ ID NO: 1425 - RNA, 17 nt, Artificial Sequence
  Synthetic
gcgccccggcggccgug

SEQ ID NO: 1426 - RNA, 17 nt, Artificial Sequence
  Synthetic
gccgcccaggccgcgug

SEQ ID NO: 1427 - RNA, 17 nt, Artificial Sequence
  Synthetic
cggggcgcgucggcgug

SEQ ID NO: 1428 - RNA, 17 nt, Artificial Sequence
  Synthetic
auggcguagcccaggug

SEQ ID NO: 1429 - RNA, 17 nt, Artificial Sequence
  Synthetic
cgcgcgcucgcccggug

SEQ ID NO: 1430 - RNA, 17 nt, Artificial Sequence
  Synthetic
gcggccccgugggggug

SEQ ID NO: 1431 - RNA, 17 nt, Artificial Sequence
  Synthetic
cuggccaaccggcugug

SEQ ID NO: 1432 - RNA, 17 nt, Artificial Sequence
  Synthetic
cccgcggcgggaaguug

SEQ ID NO: 1433 - RNA, 17 nt, Artificial Sequence
  Synthetic
ccgccugggcgggcaau

SEQ ID NO: 1434 - RNA, 17 nt, Artificial Sequence
  Synthetic
uacucgcgcggggacau

SEQ ID NO: 1435 - RNA, 17 nt, Artificial Sequence
  Synthetic
ccggacgcggaggccau

SEQ ID NO: 1436 - RNA, 17 nt, Artificial Sequence
  Synthetic
cggccgguggcggccau

SEQ ID NO: 1437 - RNA, 17 nt, Artificial Sequence
  Synthetic
ucugcgcgcggucguau

SEQ ID NO: 1438 - RNA, 17 nt, Artificial Sequence
  Synthetic
gcgggaaguuguggacu

SEQ ID NO: 1439 - RNA, 17 nt, Artificial Sequence
  Synthetic
cgggccgugccccaccu

SEQ ID NO: 1440 - RNA, 17 nt, Artificial Sequence
  Synthetic
gagggccccgacccccu

SEQ ID NO: 1441 - RNA, 17 nt, Artificial Sequence
  Synthetic
gucgccgucgaagcccu

SEQ ID NO: 1442 - RNA, 17 nt, Artificial Sequence
  Synthetic
gggauccucgccgcccu

SEQ ID NO: 1443 - RNA, 17 nt, Artificial Sequence
  Synthetic
cuggucgccggggcccu

SEQ ID NO: 1444 - RNA, 17 nt, Artificial Sequence
  Synthetic
cagggggucggggcccu

SEQ ID NO: 1445 - RNA, 17 nt, Artificial Sequence
  Synthetic
gccggacacggccgccu

SEQ ID NO: 1446 - RNA, 17 nt, Artificial Sequence
  Synthetic
ucgcgccuccuccgccu

SEQ ID NO: 1447 - RNA, 17 nt, Artificial Sequence
  Synthetic
uggcccccugcgcgccu

SEQ ID NO: 1448 - RNA, 17 nt, Artificial Sequence
  Synthetic
ggacugggaaggcgccu

SEQ ID NO: 1449 - RNA, 17 nt, Artificial Sequence
  Synthetic
acgccgguucgaggccu

SEQ ID NO: 1450 - RNA, 17 nt, Artificial Sequence
  Synthetic
ggccacgcggccggccu

SEQ ID NO: 1451 - RNA, 17 nt, Artificial Sequence
  Synthetic
gccgccgcacgcggccu

SEQ ID NO: 1452 - RNA, 17 nt, Artificial Sequence
  Synthetic
gggcuugggcgcggccu

SEQ ID NO: 1453 - RNA, 17 nt, Artificial Sequence
  Synthetic
gugcuguacggcggccu

SEQ ID NO: 1454 - RNA, 17 nt, Artificial Sequence
  Synthetic
cggccgggcggcggccu

SEQ ID NO: 1455 - RNA, 17 nt, Artificial Sequence
  Synthetic
ggccggcggcggggccu

SEQ ID NO: 1456 - RNA, 17 nt, Artificial Sequence
  Synthetic
ugcgcgcgcuggggccu

SEQ ID NO: 1457 - RNA, 17 nt, Artificial Sequence
  Synthetic
cgggauucgcugggccu

SEQ ID NO: 1458 - RNA, 17 nt, Artificial Sequence
  Synthetic
ccgcacggugcuggccu

SEQ ID NO: 1459 - RNA, 17 nt, Artificial Sequence
  Synthetic
caccacgcgcacguccu

SEQ ID NO: 1460 - RNA, 17 nt, Artificial Sequence
  Synthetic
cgcggcgucgcccagcu

SEQ ID NO: 1461 - RNA, 17 nt, Artificial Sequence
  Synthetic
gugugggcgcccgagcu

SEQ ID NO: 1462 - RNA, 17 nt, Artificial Sequence
  Synthetic
gcggcggccgcggagcu

SEQ ID NO: 1463 - RNA, 17 nt, Artificial Sequence
  Synthetic
cgggugguccgugagcu

SEQ ID NO: 1464 - RNA, 17 nt, Artificial Sequence
  Synthetic
ggacagcccgccgcgcu

SEQ ID NO: 1465 - RNA, 17 nt, Artificial Sequence
  Synthetic
cgccgccugcgcgcgcu

SEQ ID NO: 1466 - RNA, 17 nt, Artificial Sequence
  Synthetic
cccgacgugucggcgcu

SEQ ID NO: 1467 - RNA, 17 nt, Artificial Sequence
  Synthetic
cccguguacguggcgcu

SEQ ID NO: 1468 - RNA, 17 nt, Artificial Sequence
  Synthetic
gccgcccgggauucgcu

SEQ ID NO: 1469 - RNA, 17 nt, Artificial Sequence
  Synthetic
cgcggacgcccccggcu

SEQ ID NO: 1470 - RNA, 17 nt, Artificial Sequence
  Synthetic
ggccggccgcuucggcu

SEQ ID NO: 1471 - RNA, 17 nt, Artificial Sequence
  Synthetic
ccggggcgccgcgggcu

SEQ ID NO: 1472 - RNA, 17 nt, Artificial Sequence
  Synthetic
gggggcggaggcgggcu

SEQ ID NO: 1473 - RNA, 17 nt, Artificial Sequence
  Synthetic
cugggcgggggcgggcu

SEQ ID NO: 1474 - RNA, 17 nt, Artificial Sequence
  Synthetic
cgccgccgcccggggcu

SEQ ID NO: 1475 - RNA, 17 nt, Artificial Sequence
  Synthetic
ggcgccgccguguggcu

SEQ ID NO: 1476 - RNA, 17 nt, Artificial Sequence
  Synthetic
ggggccguggaggugcu

SEQ ID NO: 1477 - RNA, 17 nt, Artificial Sequence
  Synthetic
ggccugcuuccggaucu

SEQ ID NO: 1478 - RNA, 17 nt, Artificial Sequence
  Synthetic
cagccgcccgggccucu

SEQ ID NO: 1479 - RNA, 17 nt, Artificial Sequence
  Synthetic
ggggccguggaguuucu

SEQ ID NO: 1480 - RNA, 17 nt, Artificial Sequence
  Synthetic
ggcgcgcggggagcagu

SEQ ID NO: 1481 - RNA, 17 nt, Artificial Sequence
  Synthetic
gcaggcggcgugcgagu

SEQ ID NO: 1482 - RNA, 17 nt, Artificial Sequence
  Synthetic
gcccagcgccgacacgu

SEQ ID NO: 1483 - RNA, 17 nt, Artificial Sequence
  Synthetic
gcccccggcggccccgu

SEQ ID NO: 1484 - RNA, 17 nt, Artificial Sequence
  Synthetic
cgacaccgcgggcccgu

SEQ ID NO: 1485 - RNA, 17 nt, Artificial Sequence
  Synthetic
cgcgaggcgcgggccgu

SEQ ID NO: 1486 - RNA, 17 nt, Artificial Sequence
  Synthetic
ggcggccgccagcgcgu

SEQ ID NO: 1487 - RNA, 17 nt, Artificial Sequence
  Synthetic
gcgcagcggcggcgcgu

SEQ ID NO: 1488 - RNA, 17 nt, Artificial Sequence
  Synthetic
cgccaacaggggcgcgu

SEQ ID NO: 1489 - RNA, 17 nt, Artificial Sequence
  Synthetic
gcgcaggcggggcgcgu

SEQ ID NO: 1490 - RNA, 17 nt, Artificial Sequence
  Synthetic
ggcgccggaggucgcgu

SEQ ID NO: 1491 - RNA, 17 nt, Artificial Sequence
  Synthetic
ggcguggcgggcggcgu

SEQ ID NO: 1492 - RNA, 17 nt, Artificial Sequence
  Synthetic
ggcgucgucgucggcgu

SEQ ID NO: 1493 - RNA, 17 nt, Artificial Sequence
  Synthetic
gccgggcgccauggcgu

SEQ ID NO: 1494 - RNA, 17 nt, Artificial Sequence
  Synthetic
ggcgucaucgaccucgu

SEQ ID NO: 1495 - RNA, 17 nt, Artificial Sequence
  Synthetic
gucguccucguccucgu

SEQ ID NO: 1496 - RNA, 17 nt, Artificial Sequence
  Synthetic
gcgcccggcgucgucgu

SEQ ID NO: 1497 - RNA, 17 nt, Artificial Sequence
  Synthetic
cgggggggcgucgucgu

SEQ ID NO: 1498 - RNA, 17 nt, Artificial Sequence
  Synthetic
cauggcguagcccaggu

SEQ ID NO: 1499 - RNA, 17 nt, Artificial Sequence
  Synthetic
cagcucgcacgccaggu

SEQ ID NO: 1500 - RNA, 17 nt, Artificial Sequence
  Synthetic
cggcccgcacagccggu

SEQ ID NO: 1501 - RNA, 17 nt, Artificial Sequence
  Synthetic
gcgcacguccucggggu

SEQ ID NO: 1502 - RNA, 17 nt, Artificial Sequence
  Synthetic
ccagccgcccagggggu

SEQ ID NO: 1503 - RNA, 17 nt, Artificial Sequence
  Synthetic
ggcggccccgugggggu

SEQ ID NO: 1504 - RNA, 17 nt, Artificial Sequence
  Synthetic
cgccucgcgugcguggu

SEQ ID NO: 1505 - RNA, 17 nt, Artificial Sequence
  Synthetic
cgccuacgcgccccugu

SEQ ID NO: 1506 - RNA, 17 nt, Artificial Sequence
  Synthetic
cggcgcccccgacgugu

SEQ ID NO: 1507 - RNA, 17 nt, Artificial Sequence
  Synthetic
cgccccggcggccgugu

SEQ ID NO: 1508 - RNA, 17 nt, Artificial Sequence
  Synthetic
auggcggccggccgcuu

SEQ ID NO: 1509 - RNA, 17 nt, Artificial Sequence
  Synthetic
cgcgugcgcacgcgcuu

SEQ ID NO: 1510 - RNA, 17 nt, Artificial Sequence
  Synthetic
gccgccgcccggggcuu

SEQ ID NO: 1511 - RNA, 17 nt, Artificial Sequence
  Synthetic
gccgggggccgccucuu

SEQ ID NO: 1512 - RNA, 17 nt, Artificial Sequence
  Synthetic
ccgcucuucuucgucuu

SEQ ID NO: 1513 - RNA, 17 nt, Artificial Sequence
  Synthetic
gccucgggccgcguguu

SEQ ID NO: 1514 - RNA, 20 nt, Artificial Sequence
  Synthetic
cgauacgaccgcgcgcagaa

SEQ ID NO: 1515 - RNA, 20 nt, Artificial Sequence
  Synthetic
cgcguucucgcgcgccaaca

SEQ ID NO: 1516 - RNA, 20 nt, Artificial Sequence
  Synthetic
gcccagcucgggcgcccaca

SEQ ID NO: 1517 - RNA, 20 nt, Artificial Sequence
  Synthetic
gcccccggggcccagccaca

SEQ ID NO: 1518 - RNA, 20 nt, Artificial Sequence
  Synthetic
gugucggcgcugggcgcaca

SEQ ID NO: 1519 - RNA, 20 nt, Artificial Sequence
  Synthetic
cucggcgggccggcgcgaca

SEQ ID NO: 1520 - RNA, 20 nt, Artificial Sequence
  Synthetic
ccggcugugcgggccggaca

SEQ ID NO: 1521 - RNA, 20 nt, Artificial Sequence
  Synthetic
gcgguacucgcgcggggaca

SEQ ID NO: 1522 - RNA, 20 nt, Artificial Sequence
  Synthetic
gcgccccagcgccacguaca

SEQ ID NO: 1523 - RNA, 20 nt, Artificial Sequence
  Synthetic
cggguucuggagccacccca

SEQ ID NO: 1524 - RNA, 20 nt, Artificial Sequence
  Synthetic
gacgauaacccccaccccca

SEQ ID NO: 1525 - RNA, 20 nt, Artificial Sequence
  Synthetic
cgcggcggacagccgcccca

SEQ ID NO: 1526 - RNA, 20 nt, Artificial Sequence
  Synthetic
cugccgccgccagccgccca

SEQ ID NO: 1527 - RNA, 20 nt, Artificial Sequence
  Synthetic
ccgcggcagcgcggggccca

SEQ ID NO: 1528 - RNA, 20 nt, Artificial Sequence
  Synthetic
cucggggaccaccgacgcca

SEQ ID NO: 1529 - RNA, 20 nt, Artificial Sequence
  Synthetic
gguggccggccgcgacgcca

SEQ ID NO: 1530 - RNA, 20 nt, Artificial Sequence
  Synthetic
gccccaccugggcuacgcca

SEQ ID NO: 1531 - RNA, 20 nt, Artificial Sequence
  Synthetic
gccgaagcggccggccgcca

SEQ ID NO: 1532 - RNA, 20 nt, Artificial Sequence
  Synthetic
guccggcgcgccgggcgcca

SEQ ID NO: 1533 - RNA, 20 nt, Artificial Sequence
  Synthetic
aacaugagggccggucgcca

SEQ ID NO: 1534 - RNA, 20 nt, Artificial Sequence
  Synthetic
ccgcgcggcgaucgaggcca

SEQ ID NO: 1535 - RNA, 20 nt, Artificial Sequence
  Synthetic
caccccggacgcggaggcca

SEQ ID NO: 1536 - RNA, 20 nt, Artificial Sequence
  Synthetic
gggccggcgcgacacggcca

SEQ ID NO: 1537 - RNA, 20 nt, Artificial Sequence
  Synthetic
cacggcgcgcacggcggcca

SEQ ID NO: 1538 - RNA, 20 nt, Artificial Sequence
  Synthetic
gauucgcugggccucggcca

SEQ ID NO: 1539 - RNA, 20 nt, Artificial Sequence
  Synthetic
gugguccgugagcucggcca

SEQ ID NO: 1540 - RNA, 20 nt, Artificial Sequence
  Synthetic
gggggcccggcgccgggcca

SEQ ID NO: 1541 - RNA, 20 nt, Artificial Sequence
  Synthetic
guaucggcggcucauggcca

SEQ ID NO: 1542 - RNA, 20 nt, Artificial Sequence
  Synthetic
cccgcacagccgguuggcca

SEQ ID NO: 1543 - RNA, 20 nt, Artificial Sequence
  Synthetic
gagcagccccagaaacucca

SEQ ID NO: 1544 - RNA, 20 nt, Artificial Sequence
  Synthetic
cuccgcccccagcaccucca

SEQ ID NO: 1545 - RNA, 20 nt, Artificial Sequence
  Synthetic
cggggagcaguaggccucca

SEQ ID NO: 1546 - RNA, 20 nt, Artificial Sequence
  Synthetic
ggcccccgccgccgccagca

SEQ ID NO: 1547 - RNA, 20 nt, Artificial Sequence
  Synthetic
gcuggccgccgccgccagca

SEQ ID NO: 1548 - RNA, 20 nt, Artificial Sequence
  Synthetic
gucgucgucgggcuccagca

SEQ ID NO: 1549 - RNA, 20 nt, Artificial Sequence
  Synthetic
gccguccagcgccggcagca

SEQ ID NO: 1550 - RNA, 20 nt, Artificial Sequence
  Synthetic
ggcgcgggaccugcgccgca

SEQ ID NO: 1551 - RNA, 20 nt, Artificial Sequence
  Synthetic
cucgggcccgcugcgccgca

SEQ ID NO: 1552 - RNA, 20 nt, Artificial Sequence
  Synthetic
ccgcgccgccggccagcgca

SEQ ID NO: 1553 - RNA, 20 nt, Artificial Sequence
  Synthetic
gggccagucgcaggcgcgca

SEQ ID NO: 1554 - RNA, 20 nt, Artificial Sequence
  Synthetic
cagcgggcccgaggcgcgca

SEQ ID NO: 1555 - RNA, 20 nt, Artificial Sequence
  Synthetic
gaccaggcucacggcgcgca

SEQ ID NO: 1556 - RNA, 20 nt, Artificial Sequence
  Synthetic
cccgggcggcgccggcggca

SEQ ID NO: 1557 - RNA, 20 nt, Artificial Sequence
  Synthetic
ggcguagcccagguggggca

SEQ ID NO: 1558 - RNA, 20 nt, Artificial Sequence
  Synthetic
ccagcgcacggcgcacugca

SEQ ID NO: 1559 - RNA, 20 nt, Artificial Sequence
  Synthetic
guacagcagccgcgugauca

SEQ ID NO: 1560 - RNA, 20 nt, Artificial Sequence
  Synthetic
gcgcgccguggccgagcuca

SEQ ID NO: 1561 - RNA, 20 nt, Artificial Sequence
  Synthetic
ggccccggcgaccaggcuca

SEQ ID NO: 1562 - RNA, 20 nt, Artificial Sequence
  Synthetic
gcggucguaucggcggcuca

SEQ ID NO: 1563 - RNA, 20 nt, Artificial Sequence
  Synthetic
cgacgccacgggccgcuuca

SEQ ID NO: 1564 - RNA, 20 nt, Artificial Sequence
  Synthetic
ccgauacgaccgcgcgcaga

SEQ ID NO: 1565 - RNA, 20 nt, Artificial Sequence
  Synthetic
cuugggcgcggccucggaga

SEQ ID NO: 1566 - RNA, 20 nt, Artificial Sequence
  Synthetic
gucgcgauagcgcgcguaga

SEQ ID NO: 1567 - RNA, 20 nt, Artificial Sequence
  Synthetic
ggcgccugggacgaagacga

SEQ ID NO: 1568 - RNA, 20 nt, Artificial Sequence
  Synthetic
gugcugcgcggcgacgacga

SEQ ID NO: 1569 - RNA, 20 nt, Artificial Sequence
  Synthetic
gacgaggacgaggacgacga

SEQ ID NO: 1570 - RNA, 20 nt, Artificial Sequence
  Synthetic
ggcgccggcgcagaugacga

SEQ ID NO: 1571 - RNA, 20 nt, Artificial Sequence
  Synthetic
gcucgacggaccccgcccga

SEQ ID NO: 1572 - RNA, 20 nt, Artificial Sequence
  Synthetic
gacgaggucgaugacgccga

SEQ ID NO: 1573 - RNA, 20 nt, Artificial Sequence
  Synthetic
gugucgcgccggcccgccga

SEQ ID NO: 1574 - RNA, 20 nt, Artificial Sequence
  Synthetic
gccugcgacuggcccgccga

SEQ ID NO: 1575 - RNA, 20 nt, Artificial Sequence
  Synthetic
auccuggaggcgcuggccga

SEQ ID NO: 1576 - RNA, 20 nt, Artificial Sequence
  Synthetic
uucuacgcgcgcuaucgcga

SEQ ID NO: 1577 - RNA, 20 nt, Artificial Sequence
  Synthetic
aaacuccacggccccggcga

SEQ ID NO: 1578 - RNA, 20 nt, Artificial Sequence
  Synthetic
gcccggugcggcggcggcga

SEQ ID NO: 1579 - RNA, 20 nt, Artificial Sequence
  Synthetic
gcaggcggccaggcacucga

SEQ ID NO: 1580 - RNA, 20 nt, Artificial Sequence
  Synthetic
gcugccggcgccgcgcucga

SEQ ID NO: 1581 - RNA, 20 nt, Artificial Sequence
  Synthetic
gcgcuggccgagggcuucga

SEQ ID NO: 1582 - RNA, 20 nt, Artificial Sequence
  Synthetic
gacgacggcggcgcguucga

SEQ ID NO: 1583 - RNA, 20 nt, Artificial Sequence
  Synthetic
gccagccccccgcggccgga

SEQ ID NO: 1584 - RNA, 20 nt, Artificial Sequence
  Synthetic
ccgguggcgcgggccgcgga

SEQ ID NO: 1585 - RNA, 20 nt, Artificial Sequence
  Synthetic
ggccccggccagccccggga

SEQ ID NO: 1586 - RNA, 20 nt, Artificial Sequence
  Synthetic
gccuccgccgcgccgcggga

SEQ ID NO: 1587 - RNA, 20 nt, Artificial Sequence
  Synthetic
gagggccggucgccagggga

SEQ ID NO: 1588 - RNA, 20 nt, Artificial Sequence
  Synthetic
ggggggcgcgggcgcgggga

SEQ ID NO: 1589 - RNA, 20 nt, Artificial Sequence
  Synthetic
ggcggcgcguucgaggggga

SEQ ID NO: 1590 - RNA, 20 nt, Artificial Sequence
  Synthetic
cgggaaguuguggacuggga

SEQ ID NO: 1591 - RNA, 20 nt, Artificial Sequence
  Synthetic
gccgugcugccggcgcugga

SEQ ID NO: 1592 - RNA, 20 nt, Artificial Sequence
  Synthetic
ucgggccccgggggcgugga

SEQ ID NO: 1593 - RNA, 20 nt, Artificial Sequence
  Synthetic
ggcccgcgggucaaacauga

SEQ ID NO: 1594 - RNA, 20 nt, Artificial Sequence
  Synthetic
cgccacgcugccggugauga

SEQ ID NO: 1595 - RNA, 20 nt, Artificial Sequence
  Synthetic
gcgcgagaacgcggcgcuga

SEQ ID NO: 1596 - RNA, 20 nt, Artificial Sequence
  Synthetic
cgcgcggugcccgccgggua

SEQ ID NO: 1597 - RNA, 20 nt, Artificial Sequence
  Synthetic
cccccggggcgggugcugua

SEQ ID NO: 1598 - RNA, 20 nt, Artificial Sequence
  Synthetic
ccgcguucucgcgcgccaac

SEQ ID NO: 1599 - RNA, 20 nt, Artificial Sequence
  Synthetic
ugcuggcggcccuggccaac

SEQ ID NO: 1600 - RNA, 20 nt, Artificial Sequence
  Synthetic
gggcgcccgaggccucgaac

SEQ ID NO: 1601 - RNA, 20 nt, Artificial Sequence
  Synthetic
cgccccagcgccacguacac

SEQ ID NO: 1602 - RNA, 20 nt, Artificial Sequence
  Synthetic
acgauaacccccacccccac

SEQ ID NO: 1603 - RNA, 20 nt, Artificial Sequence
  Synthetic
guggccggccgcgacgccac

SEQ ID NO: 1604 - RNA, 20 nt, Artificial Sequence
  Synthetic
augacgccgauggccgccac

SEQ ID NO: 1605 - RNA, 20 nt, Artificial Sequence
  Synthetic
cccuccgcggcccgcgccac

SEQ ID NO: 1606 - RNA, 20 nt, Artificial Sequence
  Synthetic
ggccggcgcgacacggccac

SEQ ID NO: 1607 - RNA, 20 nt, Artificial Sequence
  Synthetic
auucgcugggccucggccac

SEQ ID NO: 1608 - RNA, 20 nt, Artificial Sequence
  Synthetic
cgccgucgccgccgccgcac

SEQ ID NO: 1609 - RNA, 20 nt, Artificial Sequence
  Synthetic
ggcggcggcggccagcgcac

SEQ ID NO: 1610 - RNA, 20 nt, Artificial Sequence
  Synthetic
cgugucggcgcugggcgcac

SEQ ID NO: 1611 - RNA, 20 nt, Artificial Sequence
  Synthetic
gcacguugccgccgcggcac

SEQ ID NO: 1612 - RNA, 20 nt, Artificial Sequence
  Synthetic
ucgcgcggggacaugggcac

SEQ ID NO: 1613 - RNA, 20 nt, Artificial Sequence
  Synthetic
aacagcagcuccuucaucac

SEQ ID NO: 1614 - RNA, 20 nt, Artificial Sequence
  Synthetic
ccugcgacuggcccgccgac

SEQ ID NO: 1615 - RNA, 20 nt, Artificial Sequence
  Synthetic
ucuacgcgcgcuaucgcgac

SEQ ID NO: 1616 - RNA, 20 nt, Artificial Sequence
  Synthetic
ugcucgccagcgccggcgac

SEQ ID NO: 1617 - RNA, 20 nt, Artificial Sequence
  Synthetic
guuccccguccccuggcgac

SEQ ID NO: 1618 - RNA, 20 nt, Artificial Sequence
  Synthetic
acaccgugcgcgccugcgac

SEQ ID NO: 1619 - RNA, 20 nt, Artificial Sequence
  Synthetic
agggccggucgccaggggac

SEQ ID NO: 1620 - RNA, 20 nt, Artificial Sequence
  Synthetic
gcggcgcguucgagggggac

SEQ ID NO: 1621 - RNA, 20 nt, Artificial Sequence
  Synthetic
cgcggcgggaaguuguggac

SEQ ID NO: 1622 - RNA, 20 nt, Artificial Sequence
  Synthetic
gccugggcgggcaauuggac

SEQ ID NO: 1623 - RNA, 20 nt, Artificial Sequence
  Synthetic
cgcgagaacgcggcgcugac

SEQ ID NO: 1624 - RNA, 20 nt, Artificial Sequence
  Synthetic
gcggcggcgcgucgggguac

SEQ ID NO: 1625 - RNA, 20 nt, Artificial Sequence
  Synthetic
ggcgcgggccgugccccacc

SEQ ID NO: 1626 - RNA, 20 nt, Artificial Sequence
  Synthetic
ccuccgcggcccgcgccacc

SEQ ID NO: 1627 - RNA, 20 nt, Artificial Sequence
  Synthetic
gccgucgccgccgccgcacc

SEQ ID NO: 1628 - RNA, 20 nt, Artificial Sequence
  Synthetic
cgagggcuucgacggcgacc

SEQ ID NO: 1629 - RNA, 20 nt, Artificial Sequence
  Synthetic
ggcccagggccccggcgacc

SEQ ID NO: 1630 - RNA, 20 nt, Artificial Sequence
  Synthetic
ggacgacgaggacgaggacc

SEQ ID NO: 1631 - RNA, 20 nt, Artificial Sequence
  Synthetic
gccgcugccgggcgaggacc

SEQ ID NO: 1632 - RNA, 20 nt, Artificial Sequence
  Synthetic
gcugcuguccacgcgggacc

SEQ ID NO: 1633 - RNA, 20 nt, Artificial Sequence
  Synthetic
cggggacguggcgcuggacc

SEQ ID NO: 1634 - RNA, 20 nt, Artificial Sequence
  Synthetic
gucgcggcagcacgccuacc

SEQ ID NO: 1635 - RNA, 20 nt, Artificial Sequence
  Synthetic
gauccccgcggcgccguacc

SEQ ID NO: 1636 - RNA, 20 nt, Artificial Sequence
  Synthetic
cacgcggcugcuguacaccc

SEQ ID NO: 1637 - RNA, 20 nt, Artificial Sequence
  Synthetic
uccacgcgcgcgaagacccc

SEQ ID NO: 1638 - RNA, 20 nt, Artificial Sequence
  Synthetic
ccacgcgcgcgaagaccccc

SEQ ID NO: 1639 - RNA, 20 nt, Artificial Sequence
  Synthetic
cgccgagggccccgaccccc

SEQ ID NO: 1640 - RNA, 20 nt, Artificial Sequence
  Synthetic
gcgcggcgccggcagccccc

SEQ ID NO: 1641 - RNA, 20 nt, Artificial Sequence
  Synthetic
ggcuggcggcggcagccccc

SEQ ID NO: 1642 - RNA, 20 nt, Artificial Sequence
  Synthetic
gcgccccccuccacgccccc

SEQ ID NO: 1643 - RNA, 20 nt, Artificial Sequence
  Synthetic
ggcgccgggcccccgccccc

SEQ ID NO: 1644 - RNA, 20 nt, Artificial Sequence
  Synthetic
gcgccggcggcagggccccc

SEQ ID NO: 1645 - RNA, 20 nt, Artificial Sequence
  Synthetic
cgaggccgcgcccaagcccc

SEQ ID NO: 1646 - RNA, 20 nt, Artificial Sequence
  Synthetic
gccgggccccggccagcccc

SEQ ID NO: 1647 - RNA, 20 nt, Artificial Sequence
  Synthetic
agcgcggcgccggcagcccc

SEQ ID NO: 1648 - RNA, 20 nt, Artificial Sequence
  Synthetic
cggcuggcggcggcagcccc

SEQ ID NO: 1649 - RNA, 20 nt, Artificial Sequence
  Synthetic
cgcgccccccuccacgcccc

SEQ ID NO: 1650 - RNA, 20 nt, Artificial Sequence
  Synthetic
aagagcggcgcggacgcccc

SEQ ID NO: 1651 - RNA, 20 nt, Artificial Sequence
  Synthetic
cgccguacagcacccgcccc

SEQ ID NO: 1652 - RNA, 20 nt, Artificial Sequence
  Synthetic
cggcgccgggcccccgcccc

SEQ ID NO: 1653 - RNA, 20 nt, Artificial Sequence
  Synthetic
gcgcggcggacagccgcccc

SEQ ID NO: 1654 - RNA, 20 nt, Artificial Sequence
  Synthetic
cgcccagcccgcggcgcccc

SEQ ID NO: 1655 - RNA, 20 nt, Artificial Sequence
  Synthetic
ggggccaaagaggcggcccc

SEQ ID NO: 1656 - RNA, 20 nt, Artificial Sequence
  Synthetic
ggcgccggcggcagggcccc

SEQ ID NO: 1657 - RNA, 20 nt, Artificial Sequence
  Synthetic
cgggggcgggcucgggcccc

SEQ ID NO: 1658 - RNA, 20 nt, Artificial Sequence
  Synthetic
ccgccguguggcugggcccc

SEQ ID NO: 1659 - RNA, 20 nt, Artificial Sequence
  Synthetic
ugguccagcgccacgucccc

SEQ ID NO: 1660 - RNA, 20 nt, Artificial Sequence
  Synthetic
acccgcuguuccccgucccc

SEQ ID NO: 1661 - RNA, 20 nt, Artificial Sequence
  Synthetic
agaacccgcgcguggucccc

SEQ ID NO: 1662 - RNA, 20 nt, Artificial Sequence
  Synthetic
ccgaggccgcgcccaagccc

SEQ ID NO: 1663 - RNA, 20 nt, Artificial Sequence
  Synthetic
ggccgggccccggccagccc

SEQ ID NO: 1664 - RNA, 20 nt, Artificial Sequence
  Synthetic
gcuucacggccgggcagccc

SEQ ID NO: 1665 - RNA, 20 nt, Artificial Sequence
  Synthetic
acgggggccgcggggagccc

SEQ ID NO: 1666 - RNA, 20 nt, Artificial Sequence
  Synthetic
cggccgccauggcguagccc

SEQ ID NO: 1667 - RNA, 20 nt, Artificial Sequence
  Synthetic
ccgccguacagcacccgccc

SEQ ID NO: 1668 - RNA, 20 nt, Artificial Sequence
  Synthetic
ggcggacgccgcccccgccc

SEQ ID NO: 1669 - RNA, 20 nt, Artificial Sequence
  Synthetic
gccgguccaauugcccgccc

SEQ ID NO: 1670 - RNA, 20 nt, Artificial Sequence
  Synthetic
ggccugggcgacagccgccc

SEQ ID NO: 1671 - RNA, 20 nt, Artificial Sequence
  Synthetic
gcugccgccgccagccgccc

SEQ ID NO: 1672 - RNA, 20 nt, Artificial Sequence
  Synthetic
cgggcccgcccccgccgccc

SEQ ID NO: 1673 - RNA, 20 nt, Artificial Sequence
  Synthetic
ggggguccucgccgccgccc

SEQ ID NO: 1674 - RNA, 20 nt, Artificial Sequence
  Synthetic
ggcgcccgcggccgccgccc

SEQ ID NO: 1675 - RNA, 20 nt, Artificial Sequence
  Synthetic
cccugccgccggcgccgccc

SEQ ID NO: 1676 - RNA, 20 nt, Artificial Sequence
  Synthetic
cgcggggauccucgccgccc

SEQ ID NO: 1677 - RNA, 20 nt, Artificial Sequence
  Synthetic
ggcgggggcggcguccgccc

SEQ ID NO: 1678 - RNA, 20 nt, Artificial Sequence
  Synthetic
cgacgccgggcgccgcgccc

SEQ ID NO: 1679 - RNA, 20 nt, Artificial Sequence
  Synthetic
cgggccgcagcggcgcgccc

SEQ ID NO: 1680 - RNA, 20 nt, Artificial Sequence
  Synthetic
ccgcccagcccgcggcgccc

SEQ ID NO: 1681 - RNA, 20 nt, Artificial Sequence
  Synthetic
guucgaggccucgggcgccc

SEQ ID NO: 1682 - RNA, 20 nt, Artificial Sequence
  Synthetic
ggcccgggcggcugucgccc

SEQ ID NO: 1683 - RNA, 20 nt, Artificial Sequence
  Synthetic
cgggcgccccccagaggccc

SEQ ID NO: 1684 - RNA, 20 nt, Artificial Sequence
  Synthetic
ccccagaaacuccacggccc

SEQ ID NO: 1685 - RNA, 20 nt, Artificial Sequence
  Synthetic
cgcggcgacgacgacggccc

SEQ ID NO: 1686 - RNA, 20 nt, Artificial Sequence
  Synthetic
ggccugcgccgcggcggccc

SEQ ID NO: 1687 - RNA, 20 nt, Artificial Sequence
  Synthetic
guccugccugcuggcggccc

SEQ ID NO: 1688 - RNA, 20 nt, Artificial Sequence
  Synthetic
ucgggccgcguguucggccc

SEQ ID NO: 1689 - RNA, 20 nt, Artificial Sequence
  Synthetic
cagcgcggggcccagggccc

SEQ ID NO: 1690 - RNA, 20 nt, Artificial Sequence
  Synthetic
ggggcuggcgggccgggccc

SEQ ID NO: 1691 - RNA, 20 nt, Artificial Sequence
  Synthetic
cauguuugacccgcgggccc

SEQ ID NO: 1692 - RNA, 20 nt, Artificial Sequence
  Synthetic
gcgggggcgggcucgggccc

SEQ ID NO: 1693 - RNA, 20 nt, Artificial Sequence
  Synthetic
gagccuggucgccggggccc

SEQ ID NO: 1694 - RNA, 20 nt, Artificial Sequence
  Synthetic
cccgcggcagcgcggggccc

SEQ ID NO: 1695 - RNA, 20 nt, Artificial Sequence
  Synthetic
gccgccguguggcugggccc

SEQ ID NO: 1696 - RNA, 20 nt, Artificial Sequence
  Synthetic
ucggagaggggggguggccc

SEQ ID NO: 1697 - RNA, 20 nt, Artificial Sequence
  Synthetic
gccgaggcccagcgaauccc

SEQ ID NO: 1698 - RNA, 20 nt, Artificial Sequence
  Synthetic
cugguccagcgccacguccc

SEQ ID NO: 1699 - RNA, 20 nt, Artificial Sequence
  Synthetic
ggcgaccuggcggccguccc

SEQ ID NO: 1700 - RNA, 20 nt, Artificial Sequence
  Synthetic
gccgccgucgucuucguccc

SEQ ID NO: 1701 - RNA, 20 nt, Artificial Sequence
  Synthetic
cagaacccgcgcgugguccc

SEQ ID NO: 1702 - RNA, 20 nt, Artificial Sequence
  Synthetic
ggggcgcgggcguccgagcc

SEQ ID NO: 1703 - RNA, 20 nt, Artificial Sequence
  Synthetic
cgccgugcgcgccgugagcc

SEQ ID NO: 1704 - RNA, 20 nt, Artificial Sequence
  Synthetic
cgggcagcagcucgcacgcc

SEQ ID NO: 1705 - RNA, 20 nt, Artificial Sequence
  Synthetic
ccgacgccgacgacgacgcc

SEQ ID NO: 1706 - RNA, 20 nt, Artificial Sequence
  Synthetic
guccccgcgcgaguaccgcc

SEQ ID NO: 1707 - RNA, 20 nt, Artificial Sequence
  Synthetic
ggcguccagcucgacccgcc

SEQ ID NO: 1708 - RNA, 20 nt, Artificial Sequence
  Synthetic
gggcggacgccgcccccgcc

SEQ ID NO: 1709 - RNA, 20 nt, Artificial Sequence
  Synthetic
gcgagcgcgcggugcccgcc

SEQ ID NO: 1710 - RNA, 20 nt, Artificial Sequence
  Synthetic
cggccugggcgacagccgcc

SEQ ID NO: 1711 - RNA, 20 nt, Artificial Sequence
  Synthetic
cggggguccucgccgccgcc

SEQ ID NO: 1712 - RNA, 20 nt, Artificial Sequence
  Synthetic
ugguccccgaggccgccgcc

SEQ ID NO: 1713 - RNA, 20 nt, Artificial Sequence
  Synthetic
gggccgcaucgagcgccgcc

SEQ ID NO: 1714 - RNA, 20 nt, Artificial Sequence
  Synthetic
gcccugccgccggcgccgcc

SEQ ID NO: 1715 - RNA, 20 nt, Artificial Sequence
  Synthetic
cgggcgcccacacggccgcc

SEQ ID NO: 1716 - RNA, 20 nt, Artificial Sequence
  Synthetic
gcgggccggacacggccgcc

SEQ ID NO: 1717 - RNA, 20 nt, Artificial Sequence
  Synthetic
ccagccccgggacggccgcc

SEQ ID NO: 1718 - RNA, 20 nt, Artificial Sequence
  Synthetic
cccggcccggcccggccgcc

SEQ ID NO: 1719 - RNA, 20 nt, Artificial Sequence
  Synthetic
cccacccccacggggccgcc

SEQ ID NO: 1720 - RNA, 20 nt, Artificial Sequence
  Synthetic
gggcgggggcggcguccgcc

SEQ ID NO: 1721 - RNA, 20 nt, Artificial Sequence
  Synthetic
ucgcagaaguccggcgcgcc

SEQ ID NO: 1722 - RNA, 20 nt, Artificial Sequence
  Synthetic
uuguggacugggaaggcgcc

SEQ ID NO: 1723 - RNA, 20 nt, Artificial Sequence
  Synthetic
gggggcgggggcccggcgcc

SEQ ID NO: 1724 - RNA, 20 nt, Artificial Sequence
  Synthetic
gggagccguggcccggcgcc

SEQ ID NO: 1725 - RNA, 20 nt, Artificial Sequence
  Synthetic
ucgucaucugcgccggcgcc

SEQ ID NO: 1726 - RNA, 20 nt, Artificial Sequence
  Synthetic
gccggccugggcgcggcgcc

SEQ ID NO: 1727 - RNA, 20 nt, Artificial Sequence
  Synthetic
accaccgacgccauggcgcc

SEQ ID NO: 1728 - RNA, 20 nt, Artificial Sequence
  Synthetic
cggcggccgccgcgugcgcc

SEQ ID NO: 1729 - RNA, 20 nt, Artificial Sequence
  Synthetic
cgaucgccgcgcggugcgcc

SEQ ID NO: 1730 - RNA, 20 nt, Artificial Sequence
  Synthetic
ccgccggccagguccucgcc

SEQ ID NO: 1731 - RNA, 20 nt, Artificial Sequence
  Synthetic
gcgggcaccgcgcgcucgcc

SEQ ID NO: 1732 - RNA, 20 nt, Artificial Sequence
  Synthetic
aaacaugagggccggucgcc

SEQ ID NO: 1733 - RNA, 20 nt, Artificial Sequence
  Synthetic
gcgccgugagccuggucgcc

SEQ ID NO: 1734 - RNA, 20 nt, Artificial Sequence
  Synthetic
cgcgggaccuggccuucgcc

SEQ ID NO: 1735 - RNA, 20 nt, Artificial Sequence
  Synthetic
ccacggccccggcgaaggcc

SEQ ID NO: 1736 - RNA, 20 nt, Artificial Sequence
  Synthetic
ccgagauccggaagcaggcc

SEQ ID NO: 1737 - RNA, 20 nt, Artificial Sequence
  Synthetic
ucgggcgccccccagaggcc

SEQ ID NO: 1738 - RNA, 20 nt, Artificial Sequence
  Synthetic
accgcgcggcgaucgaggcc

SEQ ID NO: 1739 - RNA, 20 nt, Artificial Sequence
  Synthetic
ccagcgccggcagcacggcc

SEQ ID NO: 1740 - RNA, 20 nt, Artificial Sequence
  Synthetic
ccacgggccgcuucacggcc

SEQ ID NO: 1741 - RNA, 20 nt, Artificial Sequence
  Synthetic
gcgcggcgacgacgacggcc

SEQ ID NO: 1742 - RNA, 20 nt, Artificial Sequence
  Synthetic
gcugccggcgcuggacggcc

SEQ ID NO: 1743 - RNA, 20 nt, Artificial Sequence
  Synthetic
gcaagagucccggcccggcc

SEQ ID NO: 1744 - RNA, 20 nt, Artificial Sequence
  Synthetic
cggugcgcgccggcccggcc

SEQ ID NO: 1745 - RNA, 20 nt, Artificial Sequence
  Synthetic
caagcgcaagagucccggcc

SEQ ID NO: 1746 - RNA, 20 nt, Artificial Sequence
  Synthetic
ccgaggccccgccgccggcc

SEQ ID NO: 1747 - RNA, 20 nt, Artificial Sequence
  Synthetic
cgaggcggugcgcgccggcc

SEQ ID NO: 1748 - RNA, 20 nt, Artificial Sequence
  Synthetic
cgacggccacgcggccggcc

SEQ ID NO: 1749 - RNA, 20 nt, Artificial Sequence
  Synthetic
cgccgccgccgcacgcggcc

SEQ ID NO: 1750 - RNA, 20 nt, Artificial Sequence
  Synthetic
ggaucccgcggcaggcggcc

SEQ ID NO: 1751 - RNA, 20 nt, Artificial Sequence
  Synthetic
gcgggugcuguacggcggcc

SEQ ID NO: 1752 - RNA, 20 nt, Artificial Sequence
  Synthetic
gggccugcgccgcggcggcc

SEQ ID NO: 1753 - RNA, 20 nt, Artificial Sequence
  Synthetic
gccgccgccuccgggcggcc

SEQ ID NO: 1754 - RNA, 20 nt, Artificial Sequence
  Synthetic
cgcugcgccgcauggcggcc

SEQ ID NO: 1755 - RNA, 20 nt, Artificial Sequence
  Synthetic
cgugcgcacgcgcuucggcc

SEQ ID NO: 1756 - RNA, 20 nt, Artificial Sequence
  Synthetic
cucgggccgcguguucggcc

SEQ ID NO: 1757 - RNA, 20 nt, Artificial Sequence
  Synthetic
gcggcccgcgccaccgggcc

SEQ ID NO: 1758 - RNA, 20 nt, Artificial Sequence
  Synthetic
cgccuccgggcggccgggcc

SEQ ID NO: 1759 - RNA, 20 nt, Artificial Sequence
  Synthetic
ccgggcggccgggccgggcc

SEQ ID NO: 1760 - RNA, 20 nt, Artificial Sequence
  Synthetic
cggccaccgccgcgcgggcc

SEQ ID NO: 1761 - RNA, 20 nt, Artificial Sequence
  Synthetic
cugggcggcgggggcgggcc

SEQ ID NO: 1762 - RNA, 20 nt, Artificial Sequence
  Synthetic
ccgcggggggcuggcgggcc

SEQ ID NO: 1763 - RNA, 20 nt, Artificial Sequence
  Synthetic
ucccggggcuggccggggcc

SEQ ID NO: 1764 - RNA, 20 nt, Artificial Sequence
  Synthetic
ccgccccgggggcgggggcc

SEQ ID NO: 1765 - RNA, 20 nt, Artificial Sequence
  Synthetic
cgccugcgcgcgcuggggcc

SEQ ID NO: 1766 - RNA, 20 nt, Artificial Sequence
  Synthetic
cggccgcuucggcuggggcc

SEQ ID NO: 1767 - RNA, 20 nt, Artificial Sequence
  Synthetic
cggccgucccggggcuggcc

SEQ ID NO: 1768 - RNA, 20 nt, Artificial Sequence
  Synthetic
gucagcggggagccguggcc

SEQ ID NO: 1769 - RNA, 20 nt, Artificial Sequence
  Synthetic
cucggagaggggggguggcc

SEQ ID NO: 1770 - RNA, 20 nt, Artificial Sequence
  Synthetic
gcccgcacagccgguuggcc

SEQ ID NO: 1771 - RNA, 20 nt, Artificial Sequence
  Synthetic
gugcuguacucgccgcugcc

SEQ ID NO: 1772 - RNA, 20 nt, Artificial Sequence
  Synthetic
cucgacccgccggggcugcc

SEQ ID NO: 1773 - RNA, 20 nt, Artificial Sequence
  Synthetic
ccgcguggccgucgagugcc

SEQ ID NO: 1774 - RNA, 20 nt, Artificial Sequence
  Synthetic
ggccgaggcccagcgaaucc

SEQ ID NO: 1775 - RNA, 20 nt, Artificial Sequence
  Synthetic
gucggggaucuggcgcaucc

SEQ ID NO: 1776 - RNA, 20 nt, Artificial Sequence
  Synthetic
ggccgccugccgcgggaucc

SEQ ID NO: 1777 - RNA, 20 nt, Artificial Sequence
  Synthetic
caucgaccucgucggacucc

SEQ ID NO: 1778 - RNA, 20 nt, Artificial Sequence
  Synthetic
ggucgcgggccgccgccucc

SEQ ID NO: 1779 - RNA, 20 nt, Artificial Sequence
  Synthetic
agcccucggccagcgccucc

SEQ ID NO: 1780 - RNA, 20 nt, Artificial Sequence
  Synthetic
gcggggagcaguaggccucc

SEQ ID NO: 1781 - RNA, 20 nt, Artificial Sequence
  Synthetic
gggcgcaagcgcaagagucc

SEQ ID NO: 1782 - RNA, 20 nt, Artificial Sequence
  Synthetic
cggcgaccuggcggccgucc

SEQ ID NO: 1783 - RNA, 20 nt, Artificial Sequence
  Synthetic
accccauggccuccgcgucc

SEQ ID NO: 1784 - RNA, 20 nt, Artificial Sequence
  Synthetic
acaugggcaccggcgugucc

SEQ ID NO: 1785 - RNA, 20 nt, Artificial Sequence
  Synthetic
ggcgcccgagauccggaagc

SEQ ID NO: 1786 - RNA, 20 nt, Artificial Sequence
  Synthetic
ugcggcggcggcggggaagc

SEQ ID NO: 1787 - RNA, 20 nt, Artificial Sequence
  Synthetic
ggcucugguugucaaacagc

SEQ ID NO: 1788 - RNA, 20 nt, Artificial Sequence
  Synthetic
gccaggggacggggaacagc

SEQ ID NO: 1789 - RNA, 20 nt, Artificial Sequence
  Synthetic
ccguguccggcccgcacagc

SEQ ID NO: 1790 - RNA, 20 nt, Artificial Sequence
  Synthetic
cgucgccgcgcagcaccagc

SEQ ID NO: 1791 - RNA, 20 nt, Artificial Sequence
  Synthetic
cgcuggccgccgccgccagc

SEQ ID NO: 1792 - RNA, 20 nt, Artificial Sequence
  Synthetic
gguuggccagggccgccagc

SEQ ID NO: 1793 - RNA, 20 nt, Artificial Sequence
  Synthetic
cgucgucgucgggcuccagc

SEQ ID NO: 1794 - RNA, 20 nt, Artificial Sequence
  Synthetic
aggccgccaugcggcgcagc

SEQ ID NO: 1795 - RNA, 20 nt, Artificial Sequence
  Synthetic
aucgcgacggguacgucagc

SEQ ID NO: 1796 - RNA, 20 nt, Artificial Sequence
  Synthetic
cgcggcgcaggcuggucagc

SEQ ID NO: 1797 - RNA, 20 nt, Artificial Sequence
  Synthetic
ggccgugugggcgcccgagc

SEQ ID NO: 1798 - RNA, 20 nt, Artificial Sequence
  Synthetic
gggggcgcgggcguccgagc

SEQ ID NO: 1799 - RNA, 20 nt, Artificial Sequence
  Synthetic
gcagccccggcgggucgagc

SEQ ID NO: 1800 - RNA, 20 nt, Artificial Sequence
  Synthetic
gcgcuucggcccggacacgc

SEQ ID NO: 1801 - RNA, 20 nt, Artificial Sequence
  Synthetic
cgugcugcugcuguccacgc

SEQ ID NO: 1802 - RNA, 20 nt, Artificial Sequence
  Synthetic
gccgacgccgacgacgacgc

SEQ ID NO: 1803 - RNA, 20 nt, Artificial Sequence
  Synthetic
aggcggaggaggcgcgacgc

SEQ ID NO: 1804 - RNA, 20 nt, Artificial Sequence
  Synthetic
gcgugcugccgcgacaccgc

SEQ ID NO: 1805 - RNA, 20 nt, Artificial Sequence
  Synthetic
uguccccgcgcgaguaccgc

SEQ ID NO: 1806 - RNA, 20 nt, Artificial Sequence
  Synthetic
cggcguccagcucgacccgc

SEQ ID NO: 1807 - RNA, 20 nt, Artificial Sequence
  Synthetic
ccgcggccggagggacccgc

SEQ ID NO: 1808 - RNA, 20 nt, Artificial Sequence
  Synthetic
ggcccucauguuugacccgc

SEQ ID NO: 1809 - RNA, 20 nt, Artificial Sequence
  Synthetic
cgacgacgacgcccccccgc

SEQ ID NO: 1810 - RNA, 20 nt, Artificial Sequence
  Synthetic
ucggggucgucgccccccgc

SEQ ID NO: 1811 - RNA, 20 nt, Artificial Sequence
  Synthetic
gccgcgcccgccucccccgc

SEQ ID NO: 1812 - RNA, 20 nt, Artificial Sequence
  Synthetic
cgaucgaggccagggcccgc

SEQ ID NO: 1813 - RNA, 20 nt, Artificial Sequence
  Synthetic
ggcggggaagcggggcccgc

SEQ ID NO: 1814 - RNA, 20 nt, Artificial Sequence
  Synthetic
ggcgagcgcgcggugcccgc

SEQ ID NO: 1815 - RNA, 20 nt, Artificial Sequence
  Synthetic
uguugaccacgaugagccgc

SEQ ID NO: 1816 - RNA, 20 nt, Artificial Sequence
  Synthetic
cccccccgaggccccgccgc

SEQ ID NO: 1817 - RNA, 20 nt, Artificial Sequence
  Synthetic
aguccacaacuucccgccgc

SEQ ID NO: 1818 - RNA, 20 nt, Artificial Sequence
  Synthetic
cgggccgcaucgagcgccgc

SEQ ID NO: 1819 - RNA, 20 nt, Artificial Sequence
  Synthetic
cggcgcaggucccgcgccgc

SEQ ID NO: 1820 - RNA, 20 nt, Artificial Sequence
  Synthetic
cgccgccuccgccgcgccgc

SEQ ID NO: 1821 - RNA, 20 nt, Artificial Sequence
  Synthetic
cccgccggguacggcgccgc

SEQ ID NO: 1822 - RNA, 20 nt, Artificial Sequence
  Synthetic
gcggcggcccggggcgccgc

SEQ ID NO: 1823 - RNA, 20 nt, Artificial Sequence
  Synthetic
augcggcccgcggaggccgc

SEQ ID NO: 1824 - RNA, 20 nt, Artificial Sequence
  Synthetic
ucgggcgcccacacggccgc

SEQ ID NO: 1825 - RNA, 20 nt, Artificial Sequence
  Synthetic
ccgcgggucccuccggccgc

SEQ ID NO: 1826 - RNA, 20 nt, Artificial Sequence
  Synthetic
gccuccagggcggcggccgc

SEQ ID NO: 1827 - RNA, 20 nt, Artificial Sequence
  Synthetic
ccccacccccacggggccgc

SEQ ID NO: 1828 - RNA, 20 nt, Artificial Sequence
  Synthetic
gcggcgcugacgggggccgc

SEQ ID NO: 1829 - RNA, 20 nt, Artificial Sequence
  Synthetic
cggggccucgggggggccgc

SEQ ID NO: 1830 - RNA, 20 nt, Artificial Sequence
  Synthetic
cggcccgggggcccugccgc

SEQ ID NO: 1831 - RNA, 20 nt, Artificial Sequence
  Synthetic
agugccuggccgccugccgc

SEQ ID NO: 1832 - RNA, 20 nt, Artificial Sequence
  Synthetic
ccugggccccgcgcugccgc

SEQ ID NO: 1833 - RNA, 20 nt, Artificial Sequence
  Synthetic
cacggcggccucgcugccgc

SEQ ID NO: 1834 - RNA, 20 nt, Artificial Sequence
  Synthetic
aggacccccgcggccuccgc

SEQ ID NO: 1835 - RNA, 20 nt, Artificial Sequence
  Synthetic
cuggggcugcucgccagcgc

SEQ ID NO: 1836 - RNA, 20 nt, Artificial Sequence
  Synthetic
gccgcccggccguccagcgc

SEQ ID NO: 1837 - RNA, 20 nt, Artificial Sequence
  Synthetic
cgcgggucccgcggcagcgc

SEQ ID NO: 1838 - RNA, 20 nt, Artificial Sequence
  Synthetic
cguccccggggaccacgcgc

SEQ ID NO: 1839 - RNA, 20 nt, Artificial Sequence
  Synthetic
cgcugccgccggccacgcgc

SEQ ID NO: 1840 - RNA, 20 nt, Artificial Sequence
  Synthetic
accggacgccgccgacgcgc

SEQ ID NO: 1841 - RNA, 20 nt, Artificial Sequence
  Synthetic
gcgguucgugcgcgacgcgc

SEQ ID NO: 1842 - RNA, 20 nt, Artificial Sequence
  Synthetic
ccacgcgcagguccccgcgc

SEQ ID NO: 1843 - RNA, 20 nt, Artificial Sequence
  Synthetic
gcggccggccaccgccgcgc

SEQ ID NO: 1844 - RNA, 20 nt, Artificial Sequence
  Synthetic
gcucgcgcagccacgcgcgc

SEQ ID NO: 1845 - RNA, 20 nt, Artificial Sequence
  Synthetic
gcccaggccccagcgcgcgc

SEQ ID NO: 1846 - RNA, 20 nt, Artificial Sequence
  Synthetic
cgcacgccgccugcgcgcgc

SEQ ID NO: 1847 - RNA, 20 nt, Artificial Sequence
  Synthetic
gcagcgggcccgaggcgcgc

SEQ ID NO: 1848 - RNA, 20 nt, Artificial Sequence
  Synthetic
ugagcucggccacggcgcgc

SEQ ID NO: 1849 - RNA, 20 nt, Artificial Sequence
  Synthetic
cgccauggcgcccggcgcgc

SEQ ID NO: 1850 - RNA, 20 nt, Artificial Sequence
  Synthetic
cucgcagaaguccggcgcgc

SEQ ID NO: 1851 - RNA, 20 nt, Artificial Sequence
  Synthetic
gggcgcgaggcggugcgcgc

SEQ ID NO: 1852 - RNA, 20 nt, Artificial Sequence
  Synthetic
cggcccggcgguacucgcgc

SEQ ID NO: 1853 - RNA, 20 nt, Artificial Sequence
  Synthetic
gccccguggccgugucgcgc

SEQ ID NO: 1854 - RNA, 20 nt, Artificial Sequence
  Synthetic
auagcgcgcguagaaggcgc

SEQ ID NO: 1855 - RNA, 20 nt, Artificial Sequence
  Synthetic
ccgcggagcucggcaggcgc

SEQ ID NO: 1856 - RNA, 20 nt, Artificial Sequence
  Synthetic
cgaccacgcacgcgaggcgc

SEQ ID NO: 1857 - RNA, 20 nt, Artificial Sequence
  Synthetic
ccgcgggauccuggaggcgc

SEQ ID NO: 1858 - RNA, 20 nt, Artificial Sequence
  Synthetic
gccgcggggagccccggcgc

SEQ ID NO: 1859 - RNA, 20 nt, Artificial Sequence
  Synthetic
cgggggcgggggcccggcgc

SEQ ID NO: 1860 - RNA, 20 nt, Artificial Sequence
  Synthetic
ggggagccguggcccggcgc

SEQ ID NO: 1861 - RNA, 20 nt, Artificial Sequence
  Synthetic
cucgucaucugcgccggcgc

SEQ ID NO: 1862 - RNA, 20 nt, Artificial Sequence
  Synthetic
gagccgccggucgccggcgc

SEQ ID NO: 1863 - RNA, 20 nt, Artificial Sequence
  Synthetic
ccgggccgugcugccggcgc

SEQ ID NO: 1864 - RNA, 20 nt, Artificial Sequence
  Synthetic
gccccgggccgccgcggcgc

SEQ ID NO: 1865 - RNA, 20 nt, Artificial Sequence
  Synthetic
ggguccgucgagcgcggcgc

SEQ ID NO: 1866 - RNA, 20 nt, Artificial Sequence
  Synthetic
ggggcgcguaggcgcggcgc

SEQ ID NO: 1867 - RNA, 20 nt, Artificial Sequence
  Synthetic
cgugcgcuggccggcggcgc

SEQ ID NO: 1868 - RNA, 20 nt, Artificial Sequence
  Synthetic
cagcgaaucccgggcggcgc

SEQ ID NO: 1869 - RNA, 20 nt, Artificial Sequence
  Synthetic
aggccagcaccgugcggcgc

SEQ ID NO: 1870 - RNA, 20 nt, Artificial Sequence
  Synthetic
cgcccccgacgugucggcgc

SEQ ID NO: 1871 - RNA, 20 nt, Artificial Sequence
  Synthetic
gucgggcuccagcagggcgc

SEQ ID NO: 1872 - RNA, 20 nt, Artificial Sequence
  Synthetic
guggaggggggcgcgggcgc

SEQ ID NO: 1873 - RNA, 20 nt, Artificial Sequence
  Synthetic
gcgacacggccacggggcgc

SEQ ID NO: 1874 - RNA, 20 nt, Artificial Sequence
  Synthetic
ccgccgccagcagggggcgc

SEQ ID NO: 1875 - RNA, 20 nt, Artificial Sequence
  Synthetic
cgccgacacgucgggggcgc

SEQ ID NO: 1876 - RNA, 20 nt, Artificial Sequence
  Synthetic
gggcgcggggaggggggcgc

SEQ ID NO: 1877 - RNA, 20 nt, Artificial Sequence
  Synthetic
gggggcguggaggggggcgc

SEQ ID NO: 1878 - RNA, 20 nt, Artificial Sequence
  Synthetic
gguccccggggacguggcgc

SEQ ID NO: 1879 - RNA, 20 nt, Artificial Sequence
  Synthetic
gcggcccguguacguggcgc

SEQ ID NO: 1880 - RNA, 20 nt, Artificial Sequence
  Synthetic
caucaccggcagcguggcgc

SEQ ID NO: 1881 - RNA, 20 nt, Artificial Sequence
  Synthetic
ccggcccggcccgguggcgc

SEQ ID NO: 1882 - RNA, 20 nt, Artificial Sequence
  Synthetic
uggugcucaugcgccugcgc

SEQ ID NO: 1883 - RNA, 20 nt, Artificial Sequence
  Synthetic
gacccccucgucaucugcgc

SEQ ID NO: 1884 - RNA, 20 nt, Artificial Sequence
  Synthetic
ccgugcagugcgccgugcgc

SEQ ID NO: 1885 - RNA, 20 nt, Artificial Sequence
  Synthetic
gucggcggcguccggugcgc

SEQ ID NO: 1886 - RNA, 20 nt, Artificial Sequence
  Synthetic
ucgaucgccgcgcggugcgc

SEQ ID NO: 1887 - RNA, 20 nt, Artificial Sequence
  Synthetic
cccgucggcgggccagucgc

SEQ ID NO: 1888 - RNA, 20 nt, Artificial Sequence
  Synthetic
cacgaugagccgccggucgc

SEQ ID NO: 1889 - RNA, 20 nt, Artificial Sequence
  Synthetic
ucuucgucuucgggggucgc

SEQ ID NO: 1890 - RNA, 20 nt, Artificial Sequence
  Synthetic
cgcgccgugagccuggucgc

SEQ ID NO: 1891 - RNA, 20 nt, Artificial Sequence
  Synthetic
cggcgccgcccgggauucgc

SEQ ID NO: 1892 - RNA, 20 nt, Artificial Sequence
  Synthetic
acgcgggaccuggccuucgc

SEQ ID NO: 1893 - RNA, 20 nt, Artificial Sequence
  Synthetic
gccgggcgccgcgcccaggc

SEQ ID NO: 1894 - RNA, 20 nt, Artificial Sequence
  Synthetic
ggccagggccgccagcaggc

SEQ ID NO: 1895 - RNA, 20 nt, Artificial Sequence
  Synthetic
gcgcagccacgcgcgcaggc

SEQ ID NO: 1896 - RNA, 20 nt, Artificial Sequence
  Synthetic
cgcguaggcgcggcgcaggc

SEQ ID NO: 1897 - RNA, 20 nt, Artificial Sequence
  Synthetic
gaggugcugggggcggaggc

SEQ ID NO: 1898 - RNA, 20 nt, Artificial Sequence
  Synthetic
ucgccccccgcgggggaggc

SEQ ID NO: 1899 - RNA, 20 nt, Artificial Sequence
  Synthetic
cgcacggcgcacugcacggc

SEQ ID NO: 1900 - RNA, 20 nt, Artificial Sequence
  Synthetic
gccacgggccgcuucacggc

SEQ ID NO: 1901 - RNA, 20 nt, Artificial Sequence
  Synthetic
ugcugccggcgcuggacggc

SEQ ID NO: 1902 - RNA, 20 nt, Artificial Sequence
  Synthetic
cccgcggcgccguacccggc

SEQ ID NO: 1903 - RNA, 20 nt, Artificial Sequence
  Synthetic
cacggccgggcagccccggc

SEQ ID NO: 1904 - RNA, 20 nt, Artificial Sequence
  Synthetic
caggccccagccgaagcggc

SEQ ID NO: 1905 - RNA, 20 nt, Artificial Sequence
  Synthetic
gcacucgacggccacgcggc

SEQ ID NO: 1906 - RNA, 20 nt, Artificial Sequence
  Synthetic
gcccgccagccccccgcggc

SEQ ID NO: 1907 - RNA, 20 nt, Artificial Sequence
  Synthetic
cuuggccacgcccccgcggc

SEQ ID NO: 1908 - RNA, 20 nt, Artificial Sequence
  Synthetic
cgccuccaggaucccgcggc

SEQ ID NO: 1909 - RNA, 20 nt, Artificial Sequence
  Synthetic
agugguccgccgagcgcggc

SEQ ID NO: 1910 - RNA, 20 nt, Artificial Sequence
  Synthetic
gcggcccguggcgucgcggc

SEQ ID NO: 1911 - RNA, 20 nt, Artificial Sequence
  Synthetic
ucccgggcggcgccggcggc

SEQ ID NO: 1912 - RNA, 20 nt, Artificial Sequence
  Synthetic
gcgaggaccuggccggcggc

SEQ ID NO: 1913 - RNA, 20 nt, Artificial Sequence
  Synthetic
cgucggcgugcggcggcggc

SEQ ID NO: 1914 - RNA, 20 nt, Artificial Sequence
  Synthetic
ggcaccgugcuggcggcggc

SEQ ID NO: 1915 - RNA, 20 nt, Artificial Sequence
  Synthetic
ggccgccgccuccgggcggc

SEQ ID NO: 1916 - RNA, 20 nt, Artificial Sequence
  Synthetic
gccccgacccccugggcggc

SEQ ID NO: 1917 - RNA, 20 nt, Artificial Sequence
  Synthetic
ccgcacgcggccugggcggc

SEQ ID NO: 1918 - RNA, 20 nt, Artificial Sequence
  Synthetic
cugggcuacgccauggcggc

SEQ ID NO: 1919 - RNA, 20 nt, Artificial Sequence
  Synthetic
agggggucggggcccucggc

SEQ ID NO: 1920 - RNA, 20 nt, Artificial Sequence
  Synthetic
cggcggccgcggagcucggc

SEQ ID NO: 1921 - RNA, 20 nt, Artificial Sequence
  Synthetic
gacaccgcgggcccgucggc

SEQ ID NO: 1922 - RNA, 20 nt, Artificial Sequence
  Synthetic
uggcggccggccgcuucggc

SEQ ID NO: 1923 - RNA, 20 nt, Artificial Sequence
  Synthetic
cgcgggucaaacaugagggc

SEQ ID NO: 1924 - RNA, 20 nt, Artificial Sequence
  Synthetic
cgcggcccgcgccaccgggc

SEQ ID NO: 1925 - RNA, 20 nt, Artificial Sequence
  Synthetic
agaggggggguggcccgggc

SEQ ID NO: 1926 - RNA, 20 nt, Artificial Sequence
  Synthetic
ccgccuccgggcggccgggc

SEQ ID NO: 1927 - RNA, 20 nt, Artificial Sequence
  Synthetic
cccgcgccaccgggccgggc

SEQ ID NO: 1928 - RNA, 20 nt, Artificial Sequence
  Synthetic
uccgggcggccgggccgggc

SEQ ID NO: 1929 - RNA, 20 nt, Artificial Sequence
  Synthetic
cggcccggggcgccgcgggc

SEQ ID NO: 1930 - RNA, 20 nt, Artificial Sequence
  Synthetic
cacggccacggggcgcgggc

SEQ ID NO: 1931 - RNA, 20 nt, Artificial Sequence
  Synthetic
ggucggggcccucggcgggc

SEQ ID NO: 1932 - RNA, 20 nt, Artificial Sequence
  Synthetic
gccgcggggggcuggcgggc

SEQ ID NO: 1933 - RNA, 20 nt, Artificial Sequence
  Synthetic
ggccaaccggcugugcgggc

SEQ ID NO: 1934 - RNA, 20 nt, Artificial Sequence
  Synthetic
cgaggcgcgggccgucgggc

SEQ ID NO: 1935 - RNA, 20 nt, Artificial Sequence
  Synthetic
cgggcccccgcccccggggc

SEQ ID NO: 1936 - RNA, 20 nt, Artificial Sequence
  Synthetic
ccuggcggccgucccggggc

SEQ ID NO: 1937 - RNA, 20 nt, Artificial Sequence
  Synthetic
acagcacccgccccgggggc

SEQ ID NO: 1938 - RNA, 20 nt, Artificial Sequence
  Synthetic
gcggccugggcggcgggggc

SEQ ID NO: 1939 - RNA, 20 nt, Artificial Sequence
  Synthetic
gccgcgggcugggcgggggc

SEQ ID NO: 1940 - RNA, 20 nt, Artificial Sequence
  Synthetic
ucccuccggccgcggggggc

SEQ ID NO: 1941 - RNA, 20 nt, Artificial Sequence
  Synthetic
ccggacacggccgccugggc

SEQ ID NO: 1942 - RNA, 20 nt, Artificial Sequence
  Synthetic
cggggcgccgcgggcugggc

SEQ ID NO: 1943 - RNA, 20 nt, Artificial Sequence
  Synthetic
cugccgggcgaggaccuggc

SEQ ID NO: 1944 - RNA, 20 nt, Artificial Sequence
  Synthetic
gcagugcgccgugcgcuggc

SEQ ID NO: 1945 - RNA, 20 nt, Artificial Sequence
  Synthetic
gcggccgucccggggcuggc

SEQ ID NO: 1946 - RNA, 20 nt, Artificial Sequence
  Synthetic
uccggccgcggggggcuggc

SEQ ID NO: 1947 - RNA, 20 nt, Artificial Sequence
  Synthetic
cgcggggaccugcgcguggc

SEQ ID NO: 1948 - RNA, 20 nt, Artificial Sequence
  Synthetic
gucgucggcgucggcguggc

SEQ ID NO: 1949 - RNA, 20 nt, Artificial Sequence
  Synthetic
cgggcccgcgcggcgguggc

SEQ ID NO: 1950 - RNA, 20 nt, Artificial Sequence
  Synthetic
cgcgggcgccgccguguggc

SEQ ID NO: 1951 - RNA, 20 nt, Artificial Sequence
  Synthetic
ccagagccugcgcccccugc

SEQ ID NO: 1952 - RNA, 20 nt, Artificial Sequence
  Synthetic
cuuuugcgcccgcgcccugc

SEQ ID NO: 1953 - RNA, 20 nt, Artificial Sequence
  Synthetic
cggcgggcuguccugccugc

SEQ ID NO: 1954 - RNA, 20 nt, Artificial Sequence
  Synthetic
cacggcccgcgccacgcugc

SEQ ID NO: 1955 - RNA, 20 nt, Artificial Sequence
  Synthetic
ggugcuguacucgccgcugc

SEQ ID NO: 1956 - RNA, 20 nt, Artificial Sequence
  Synthetic
ggcguccgcccgggggcugc

SEQ ID NO: 1957 - RNA, 20 nt, Artificial Sequence
  Synthetic
guaccgccgggccgugcugc

SEQ ID NO: 1958 - RNA, 20 nt, Artificial Sequence
  Synthetic
gggccgcagcggcaccgugc

SEQ ID NO: 1959 - RNA, 20 nt, Artificial Sequence
  Synthetic
ggcgggggccguggaggugc

SEQ ID NO: 1960 - RNA, 20 nt, Artificial Sequence
  Synthetic
ggaccugcgccgcacggugc

SEQ ID NO: 1961 - RNA, 20 nt, Artificial Sequence
  Synthetic
cccuggccaaccggcugugc

SEQ ID NO: 1962 - RNA, 20 nt, Artificial Sequence
  Synthetic
ugcgcgcggcgcccgagauc

SEQ ID NO: 1963 - RNA, 20 nt, Artificial Sequence
  Synthetic
cguccucggggucggggauc

SEQ ID NO: 1964 - RNA, 20 nt, Artificial Sequence
  Synthetic
uguacagcagccgcgugauc

SEQ ID NO: 1965 - RNA, 20 nt, Artificial Sequence
  Synthetic
ccgcgcucggcggaccacuc

SEQ ID NO: 1966 - RNA, 20 nt, Artificial Sequence
  Synthetic
ucaucgaccucgucggacuc

SEQ ID NO: 1967 - RNA, 20 nt, Artificial Sequence
  Synthetic
cuggacgccgacgcgaccuc

SEQ ID NO: 1968 - RNA, 20 nt, Artificial Sequence
  Synthetic
gcggggcccgcgggucccuc

SEQ ID NO: 1969 - RNA, 20 nt, Artificial Sequence
  Synthetic
gggucgcgggccgccgccuc

SEQ ID NO: 1970 - RNA, 20 nt, Artificial Sequence
  Synthetic
cgucgcgccuccuccgccuc

SEQ ID NO: 1971 - RNA, 20 nt, Artificial Sequence
  Synthetic
uuuggcccccugcgcgccuc

SEQ ID NO: 1972 - RNA, 20 nt, Artificial Sequence
  Synthetic
cgacgccgguucgaggccuc

SEQ ID NO: 1973 - RNA, 20 nt, Artificial Sequence
  Synthetic
gacggccgggcggcggccuc

SEQ ID NO: 1974 - RNA, 20 nt, Artificial Sequence
  Synthetic
gcgacagccgcccgggccuc

SEQ ID NO: 1975 - RNA, 20 nt, Artificial Sequence
  Synthetic
cuggccggcggcggggccuc

SEQ ID NO: 1976 - RNA, 20 nt, Artificial Sequence
  Synthetic
cgccgcacggugcuggccuc

SEQ ID NO: 1977 - RNA, 20 nt, Artificial Sequence
  Synthetic
accaccacgcgcacguccuc

SEQ ID NO: 1978 - RNA, 20 nt, Artificial Sequence
  Synthetic
ugcgcggcgucgcccagcuc

SEQ ID NO: 1979 - RNA, 20 nt, Artificial Sequence
  Synthetic
ccagcagggggcgcaggcuc

SEQ ID NO: 1980 - RNA, 20 nt, Artificial Sequence
  Synthetic
ggcugggcgggggcgggcuc

SEQ ID NO: 1981 - RNA, 20 nt, Artificial Sequence
  Synthetic
caggccugcuuccggaucuc

SEQ ID NO: 1982 - RNA, 20 nt, Artificial Sequence
  Synthetic
gccuccuccucgcagaaguc

SEQ ID NO: 1983 - RNA, 20 nt, Artificial Sequence
  Synthetic
gcgcccagcgccgacacguc

SEQ ID NO: 1984 - RNA, 20 nt, Artificial Sequence
  Synthetic
cacgcgaggcgcgggccguc

SEQ ID NO: 1985 - RNA, 20 nt, Artificial Sequence
  Synthetic
caccccauggccuccgcguc

SEQ ID NO: 1986 - RNA, 20 nt, Artificial Sequence
  Synthetic
aggcgcagcggcggcgcguc

SEQ ID NO: 1987 - RNA, 20 nt, Artificial Sequence
  Synthetic
gccagcgcgucggcggcguc

SEQ ID NO: 1988 - RNA, 20 nt, Artificial Sequence
  Synthetic
ucggcguggcgggcggcguc

SEQ ID NO: 1989 - RNA, 20 nt, Artificial Sequence
  Synthetic
agcgggggggcgucgucguc

SEQ ID NO: 1990 - RNA, 20 nt, Artificial Sequence
  Synthetic
acgcgcacguccucgggguc

SEQ ID NO: 1991 - RNA, 20 nt, Artificial Sequence
  Synthetic
cgccagccgcccaggggguc

SEQ ID NO: 1992 - RNA, 20 nt, Artificial Sequence
  Synthetic
cccgcccaggcggccguguc

SEQ ID NO: 1993 - RNA, 20 nt, Artificial Sequence
  Synthetic
gacaugggcaccggcguguc

SEQ ID NO: 1994 - RNA, 20 nt, Artificial Sequence
  Synthetic
cgcuggaccaggccugcuuc

SEQ ID NO: 1995 - RNA, 20 nt, Artificial Sequence
  Synthetic
cgccgcucuucuucgucuuc

SEQ ID NO: 1996 - RNA, 20 nt, Artificial Sequence
  Synthetic
cggggaccacgcgcggguuc

SEQ ID NO: 1997 - RNA, 20 nt, Artificial Sequence
  Synthetic
cgccggggccguggaguuuc

SEQ ID NO: 1998 - RNA, 20 nt, Artificial Sequence
  Synthetic
aggcgcgcagggggccaaag

SEQ ID NO: 1999 - RNA, 20 nt, Artificial Sequence
  Synthetic
gucggacgacgaggacgaag

SEQ ID NO: 2000 - RNA, 20 nt, Artificial Sequence
  Synthetic
gcgccaggccccagccgaag

SEQ ID NO: 2001 - RNA, 20 nt, Artificial Sequence
  Synthetic
gugcggcggcggcggggaag

SEQ ID NO: 2002 - RNA, 20 nt, Artificial Sequence
  Synthetic
ggggcugcccggccgugaag

SEQ ID NO: 2003 - RNA, 20 nt, Artificial Sequence
  Synthetic
gcguucucgcgcgccaacag

SEQ ID NO: 2004 - RNA, 20 nt, Artificial Sequence
  Synthetic
cgccaggggacggggaacag

SEQ ID NO: 2005 - RNA, 20 nt, Artificial Sequence
  Synthetic
ucgucgccgcgcagcaccag

SEQ ID NO: 2006 - RNA, 20 nt, Artificial Sequence
  Synthetic
ccgccucgggcgccccccag

SEQ ID NO: 2007 - RNA, 20 nt, Artificial Sequence
  Synthetic
ugccgccgccagccgcccag

SEQ ID NO: 2008 - RNA, 20 nt, Artificial Sequence
  Synthetic
acaugagggccggucgccag

SEQ ID NO: 2009 - RNA, 20 nt, Artificial Sequence
  Synthetic
cuggccgccgccgccagcag

SEQ ID NO: 2010 - RNA, 20 nt, Artificial Sequence
  Synthetic
gccacguacacgggccgcag

SEQ ID NO: 2011 - RNA, 20 nt, Artificial Sequence
  Synthetic
gccucggccacgggccgcag

SEQ ID NO: 2012 - RNA, 20 nt, Artificial Sequence
  Synthetic
agcgggcccgaggcgcgcag

SEQ ID NO: 2013 - RNA, 20 nt, Artificial Sequence
  Synthetic
ccgccgcggcacaggcgcag

SEQ ID NO: 2014 - RNA, 20 nt, Artificial Sequence
  Synthetic
caggccgccaugcggcgcag

SEQ ID NO: 2015 - RNA, 20 nt, Artificial Sequence
  Synthetic
gccagguccucgcccggcag

SEQ ID NO: 2016 - RNA, 20 nt, Artificial Sequence
  Synthetic
uaucgcgacggguacgucag

SEQ ID NO: 2017 - RNA, 20 nt, Artificial Sequence
  Synthetic
cccccgaagacgaagaagag

SEQ ID NO: 2018 - RNA, 20 nt, Artificial Sequence
  Synthetic
uugggcgcggccucggagag

SEQ ID NO: 2019 - RNA, 20 nt, Artificial Sequence
  Synthetic
gcgccggcgcagaugacgag

SEQ ID NO: 2020 - RNA, 20 nt, Artificial Sequence
  Synthetic
gcgcgcaggcggcgugcgag

SEQ ID NO: 2021 - RNA, 20 nt, Artificial Sequence
  Synthetic
acgacggcggcgcguucgag

SEQ ID NO: 2022 - RNA, 20 nt, Artificial Sequence
  Synthetic
ccucgggggggccgccggag

SEQ ID NO: 2023 - RNA, 20 nt, Artificial Sequence
  Synthetic
gcuugggcgcggccucggag

SEQ ID NO: 2024 - RNA, 20 nt, Artificial Sequence
  Synthetic
ccuccgccgcgccgcgggag

SEQ ID NO: 2025 - RNA, 20 nt, Artificial Sequence
  Synthetic
gggggcgcgggcgcggggag

SEQ ID NO: 2026 - RNA, 20 nt, Artificial Sequence
  Synthetic
cgggccccgggggcguggag

SEQ ID NO: 2027 - RNA, 20 nt, Artificial Sequence
  Synthetic
ccuguuggcgcgcgagaacg

SEQ ID NO: 2028 - RNA, 20 nt, Artificial Sequence
  Synthetic
agacccccgggccgaacacg

SEQ ID NO: 2029 - RNA, 20 nt, Artificial Sequence
  Synthetic
cgauaacccccacccccacg

SEQ ID NO: 2030 - RNA, 20 nt, Artificial Sequence
  Synthetic
gccggcgcgacacggccacg

SEQ ID NO: 2031 - RNA, 20 nt, Artificial Sequence
  Synthetic
ccaggcacucgacggccacg

SEQ ID NO: 2032 - RNA, 20 nt, Artificial Sequence
  Synthetic
gcgugcugcugcuguccacg

SEQ ID NO: 2033 - RNA, 20 nt, Artificial Sequence
  Synthetic
gucgucgccgccgccgcacg

SEQ ID NO: 2034 - RNA, 20 nt, Artificial Sequence
  Synthetic
cggcuggggccuggcgcacg

SEQ ID NO: 2035 - RNA, 20 nt, Artificial Sequence
  Synthetic
ggccgaagcgcgugcgcacg

SEQ ID NO: 2036 - RNA, 20 nt, Artificial Sequence
  Synthetic
agcaguacgcccugaucacg

SEQ ID NO: 2037 - RNA, 20 nt, Artificial Sequence
  Synthetic
ggacgacgacggcaacgacg

SEQ ID NO: 2038 - RNA, 20 nt, Artificial Sequence
  Synthetic
cgaagaggaugcggacgacg

SEQ ID NO: 2039 - RNA, 20 nt, Artificial Sequence
  Synthetic
cucguccucgucggacgacg

SEQ ID NO: 2040 - RNA, 20 nt, Artificial Sequence
  Synthetic
cgaggacccggaguccgacg

SEQ ID NO: 2041 - RNA, 20 nt, Artificial Sequence
  Synthetic
uucguccucgucguccgacg

SEQ ID NO: 2042 - RNA, 20 nt, Artificial Sequence
  Synthetic
ggaugcggacgacgaggacg

SEQ ID NO: 2043 - RNA, 20 nt, Artificial Sequence
  Synthetic
cucgucguccgacgaggacg

SEQ ID NO: 2044 - RNA, 20 nt, Artificial Sequence
  Synthetic
gcugcuguacaccccggacg

SEQ ID NO: 2045 - RNA, 20 nt, Artificial Sequence
  Synthetic
gggccggucgccaggggacg

SEQ ID NO: 2046 - RNA, 20 nt, Artificial Sequence
  Synthetic
gcgcgugguccccggggacg

SEQ ID NO: 2047 - RNA, 20 nt, Artificial Sequence
  Synthetic
cggcgcguucgagggggacg

SEQ ID NO: 2048 - RNA, 20 nt, Artificial Sequence
  Synthetic
cggcgccggcgcagaugacg

SEQ ID NO: 2049 - RNA, 20 nt, Artificial Sequence
  Synthetic
gcgagaacgcggcgcugacg

SEQ ID NO: 2050 - RNA, 20 nt, Artificial Sequence
  Synthetic
gccgcugcggcccguguacg

SEQ ID NO: 2051 - RNA, 20 nt, Artificial Sequence
  Synthetic
ggcgugcugccgcgacaccg

SEQ ID NO: 2052 - RNA, 20 nt, Artificial Sequence
  Synthetic
cccgcggccggagggacccg

SEQ ID NO: 2053 - RNA, 20 nt, Artificial Sequence
  Synthetic
cggcccucauguuugacccg

SEQ ID NO: 2054 - RNA, 20 nt, Artificial Sequence
  Synthetic
gcgccagauccccgaccccg

SEQ ID NO: 2055 - RNA, 20 nt, Artificial Sequence
  Synthetic
ggcggcggcgaggacccccg

SEQ ID NO: 2056 - RNA, 20 nt, Artificial Sequence
  Synthetic
ccacuccggcggcccccccg

SEQ ID NO: 2057 - RNA, 20 nt, Artificial Sequence
  Synthetic
cccggcccgccagccccccg

SEQ ID NO: 2058 - RNA, 20 nt, Artificial Sequence
  Synthetic
gucggggucgucgccccccg

SEQ ID NO: 2059 - RNA, 20 nt, Artificial Sequence
  Synthetic
gcuggcggcggcagcccccg

SEQ ID NO: 2060 - RNA, 20 nt, Artificial Sequence
  Synthetic
cgggcuuggccacgcccccg

SEQ ID NO: 2061 - RNA, 20 nt, Artificial Sequence
  Synthetic
cgccccccuccacgcccccg

SEQ ID NO: 2062 - RNA, 20 nt, Artificial Sequence
  Synthetic
gcgccgggcccccgcccccg

SEQ ID NO: 2063 - RNA, 20 nt, Artificial Sequence
  Synthetic
cgccgcgcccgccucccccg

SEQ ID NO: 2064 - RNA, 20 nt, Artificial Sequence
  Synthetic
gccguacagcacccgccccg

SEQ ID NO: 2065 - RNA, 20 nt, Artificial Sequence
  Synthetic
gcaggcccgcccgcgccccg

SEQ ID NO: 2066 - RNA, 20 nt, Artificial Sequence
  Synthetic
ggcggcccccggcggccccg

SEQ ID NO: 2067 - RNA, 20 nt, Artificial Sequence
  Synthetic
gggggcgggcucgggccccg

SEQ ID NO: 2068 - RNA, 20 nt, Artificial Sequence
  Synthetic
cgccguguggcugggccccg

SEQ ID NO: 2069 - RNA, 20 nt, Artificial Sequence
  Synthetic
cagggcggcgaggauccccg

SEQ ID NO: 2070 - RNA, 20 nt, Artificial Sequence
  Synthetic
gccggcgccggggcuccccg

SEQ ID NO: 2071 - RNA, 20 nt, Artificial Sequence
  Synthetic
gguccagcgccacguccccg

SEQ ID NO: 2072 - RNA, 20 nt, Artificial Sequence
  Synthetic
gaacccgcgcgugguccccg

SEQ ID NO: 2073 - RNA, 20 nt, Artificial Sequence
  Synthetic
cauggcgucggugguccccg

SEQ ID NO: 2074 - RNA, 20 nt, Artificial Sequence
  Synthetic
gcccgcccccgcccagcccg

SEQ ID NO: 2075 - RNA, 20 nt, Artificial Sequence
  Synthetic
gggguccucgccgccgcccg

SEQ ID NO: 2076 - RNA, 20 nt, Artificial Sequence
  Synthetic
gcgggggcggcguccgcccg

SEQ ID NO: 2077 - RNA, 20 nt, Artificial Sequence
  Synthetic
cagccacacggcggcgcccg

SEQ ID NO: 2078 - RNA, 20 nt, Artificial Sequence
  Synthetic
cacggccgccggggcgcccg

SEQ ID NO: 2079 - RNA, 20 nt, Artificial Sequence
  Synthetic
gggccucuggggggcgcccg

SEQ ID NO: 2080 - RNA, 20 nt, Artificial Sequence
  Synthetic
gcggcgacgacgacggcccg

SEQ ID NO: 2081 - RNA, 20 nt, Artificial Sequence
  Synthetic
cccggccgugaagcggcccg

SEQ ID NO: 2082 - RNA, 20 nt, Artificial Sequence
  Synthetic
cgggccgaacacgcggcccg

SEQ ID NO: 2083 - RNA, 20 nt, Artificial Sequence
  Synthetic
gccugcgccgcggcggcccg

SEQ ID NO: 2084 - RNA, 20 nt, Artificial Sequence
  Synthetic
gcggcgcucgaugcggcccg

SEQ ID NO: 2085 - RNA, 20 nt, Artificial Sequence
  Synthetic
cacggugccgcugcggcccg

SEQ ID NO: 2086 - RNA, 20 nt, Artificial Sequence
  Synthetic
cgggccgcguguucggcccg

SEQ ID NO: 2087 - RNA, 20 nt, Artificial Sequence
  Synthetic
gcgaucgaggccagggcccg

SEQ ID NO: 2088 - RNA, 20 nt, Artificial Sequence
  Synthetic
cuggcccgccgacgggcccg

SEQ ID NO: 2089 - RNA, 20 nt, Artificial Sequence
  Synthetic
caugcggcgcagcgggcccg

SEQ ID NO: 2090 - RNA, 20 nt, Artificial Sequence
  Synthetic
cggcggggaagcggggcccg

SEQ ID NO: 2091 - RNA, 20 nt, Artificial Sequence
  Synthetic
ccagcgccuccaggaucccg

SEQ ID NO: 2092 - RNA, 20 nt, Artificial Sequence
  Synthetic
uugcgcuugcgccccucccg

SEQ ID NO: 2093 - RNA, 20 nt, Artificial Sequence
  Synthetic
gcgaccuggcggccgucccg

SEQ ID NO: 2094 - RNA, 20 nt, Artificial Sequence
  Synthetic
cucggcaggcgcgggucccg

SEQ ID NO: 2095 - RNA, 20 nt, Artificial Sequence
  Synthetic
gggcgcgggcguccgagccg

SEQ ID NO: 2096 - RNA, 20 nt, Artificial Sequence
  Synthetic
gguacgucagcggggagccg

SEQ ID NO: 2097 - RNA, 20 nt, Artificial Sequence
  Synthetic
gcguccagcucgacccgccg

SEQ ID NO: 2098 - RNA, 20 nt, Artificial Sequence
  Synthetic
cgugucgcgccggcccgccg

SEQ ID NO: 2099 - RNA, 20 nt, Artificial Sequence
  Synthetic
caguccacaacuucccgccg

SEQ ID NO: 2100 - RNA, 20 nt, Artificial Sequence
  Synthetic
cuccgcggccgccgccgccg

SEQ ID NO: 2101 - RNA, 20 nt, Artificial Sequence
  Synthetic
cggcggcagcgaggccgccg

SEQ ID NO: 2102 - RNA, 20 nt, Artificial Sequence
  Synthetic
gggcgcccacacggccgccg

SEQ ID NO: 2103 - RNA, 20 nt, Artificial Sequence
  Synthetic
ggcgcacgcggcggccgccg

SEQ ID NO: 2104 - RNA, 20 nt, Artificial Sequence
  Synthetic
cgcggcgccccgggccgccg

SEQ ID NO: 2105 - RNA, 20 nt, Artificial Sequence
  Synthetic
ccacccccacggggccgccg

SEQ ID NO: 2106 - RNA, 20 nt, Artificial Sequence
  Synthetic
gguagcgcacguugccgccg

SEQ ID NO: 2107 - RNA, 20 nt, Artificial Sequence
  Synthetic
ccgccgccuccgccgcgccg

SEQ ID NO: 2108 - RNA, 20 nt, Artificial Sequence
  Synthetic
cuacugcuccccgcgcgccg

SEQ ID NO: 2109 - RNA, 20 nt, Artificial Sequence
  Synthetic
gcccgccggguacggcgccg

SEQ ID NO: 2110 - RNA, 20 nt, Artificial Sequence
  Synthetic
cgucaucugcgccggcgccg

SEQ ID NO: 2111 - RNA, 20 nt, Artificial Sequence
  Synthetic
cgcggcggcccggggcgccg

SEQ ID NO: 2112 - RNA, 20 nt, Artificial Sequence
  Synthetic
gcgcgggcgggccugcgccg

SEQ ID NO: 2113 - RNA, 20 nt, Artificial Sequence
  Synthetic
cgccgugagccuggucgccg

SEQ ID NO: 2114 - RNA, 20 nt, Artificial Sequence
  Synthetic
gcgggaccuggccuucgccg

SEQ ID NO: 2115 - RNA, 20 nt, Artificial Sequence
  Synthetic
gaugcggcccgcggaggccg

SEQ ID NO: 2116 - RNA, 20 nt, Artificial Sequence
  Synthetic
cccgcgggucccuccggccg

SEQ ID NO: 2117 - RNA, 20 nt, Artificial Sequence
  Synthetic
guccgcggcggcggcggccg

SEQ ID NO: 2118 - RNA, 20 nt, Artificial Sequence
  Synthetic
ggccuccagggcggcggccg

SEQ ID NO: 2119 - RNA, 20 nt, Artificial Sequence
  Synthetic
cggcccgguggcgcgggccg

SEQ ID NO: 2120 - RNA, 20 nt, Artificial Sequence
  Synthetic
ccuggccuucgccggggccg

SEQ ID NO: 2121 - RNA, 20 nt, Artificial Sequence
  Synthetic
cgcggcgcugacgggggccg

SEQ ID NO: 2122 - RNA, 20 nt, Artificial Sequence
  Synthetic
gcuggcggcggcgggggccg

SEQ ID NO: 2123 - RNA, 20 nt, Artificial Sequence
  Synthetic
gauccuggaggcgcuggccg

SEQ ID NO: 2124 - RNA, 20 nt, Artificial Sequence
  Synthetic
ggccgucccggggcuggccg

SEQ ID NO: 2125 - RNA, 20 nt, Artificial Sequence
  Synthetic
gccgcugcggcccguggccg

SEQ ID NO: 2126 - RNA, 20 nt, Artificial Sequence
  Synthetic
gagugccuggccgccugccg

SEQ ID NO: 2127 - RNA, 20 nt, Artificial Sequence
  Synthetic
cccugggccccgcgcugccg

SEQ ID NO: 2128 - RNA, 20 nt, Artificial Sequence
  Synthetic
ccgccgcugcgccugugccg

SEQ ID NO: 2129 - RNA, 20 nt, Artificial Sequence
  Synthetic
cgggcgcaaaagucccuccg

SEQ ID NO: 2130 - RNA, 20 nt, Artificial Sequence
  Synthetic
gaggacccccgcggccuccg

SEQ ID NO: 2131 - RNA, 20 nt, Artificial Sequence
  Synthetic
cccgcgccugccgagcuccg

SEQ ID NO: 2132 - RNA, 20 nt, Artificial Sequence
  Synthetic
cgggccacccccccucuccg

SEQ ID NO: 2133 - RNA, 20 nt, Artificial Sequence
  Synthetic
ccccauggccuccgcguccg

SEQ ID NO: 2134 - RNA, 20 nt, Artificial Sequence
  Synthetic
guugucaaacagcagguccg

SEQ ID NO: 2135 - RNA, 20 nt, Artificial Sequence
  Synthetic
gcggcggcggcggggaagcg

SEQ ID NO: 2136 - RNA, 20 nt, Artificial Sequence
  Synthetic
gucgccgcgcagcaccagcg

SEQ ID NO: 2137 - RNA, 20 nt, Artificial Sequence
  Synthetic
cuccuucaucaccggcagcg

SEQ ID NO: 2138 - RNA, 20 nt, Artificial Sequence
  Synthetic
gcgcgggucccgcggcagcg

SEQ ID NO: 2139 - RNA, 20 nt, Artificial Sequence
  Synthetic
gcgcguggccggcggcagcg

SEQ ID NO: 2140 - RNA, 20 nt, Artificial Sequence
  Synthetic
ucgcgacggguacgucagcg

SEQ ID NO: 2141 - RNA, 20 nt, Artificial Sequence
  Synthetic
ccggagugguccgccgagcg

SEQ ID NO: 2142 - RNA, 20 nt, Artificial Sequence
  Synthetic
cgggcgggguccgucgagcg

SEQ ID NO: 2143 - RNA, 20 nt, Artificial Sequence
  Synthetic
acguccccggggaccacgcg

SEQ ID NO: 2144 - RNA, 20 nt, Artificial Sequence
  Synthetic
cgcggccgaccacgcacgcg

SEQ ID NO: 2145 - RNA, 20 nt, Artificial Sequence
  Synthetic
ggcgggcccggcgcaccgcg

SEQ ID NO: 2146 - RNA, 20 nt, Artificial Sequence
  Synthetic
cggggucgucgccccccgcg

SEQ ID NO: 2147 - RNA, 20 nt, Artificial Sequence
  Synthetic
ccgcgcccgccucccccgcg

SEQ ID NO: 2148 - RNA, 20 nt, Artificial Sequence
  Synthetic
cgagcgccgccgggcccgcg

SEQ ID NO: 2149 - RNA, 20 nt, Artificial Sequence
  Synthetic
ggcgaaggccaggucccgcg

SEQ ID NO: 2150 - RNA, 20 nt, Artificial Sequence
  Synthetic
cgcggccggccaccgccgcg

SEQ ID NO: 2151 - RNA, 20 nt, Artificial Sequence
  Synthetic
guccacaacuucccgccgcg

SEQ ID NO: 2152 - RNA, 20 nt, Artificial Sequence
  Synthetic
ccgccggguacggcgccgcg

SEQ ID NO: 2153 - RNA, 20 nt, Artificial Sequence
  Synthetic
cccuggccucgaucgccgcg

SEQ ID NO: 2154 - RNA, 20 nt, Artificial Sequence
  Synthetic
ugcggcccgcggaggccgcg

SEQ ID NO: 2155 - RNA, 20 nt, Artificial Sequence
  Synthetic
ccgcgcccaggccggccgcg

SEQ ID NO: 2156 - RNA, 20 nt, Artificial Sequence
  Synthetic
cgcgggucccuccggccgcg

SEQ ID NO: 2157 - RNA, 20 nt, Artificial Sequence
  Synthetic
cggcgcugacgggggccgcg

SEQ ID NO: 2158 - RNA, 20 nt, Artificial Sequence
  Synthetic
gcgggucccgcggcagcgcg

SEQ ID NO: 2159 - RNA, 20 nt, Artificial Sequence
  Synthetic
cgccgcaccgggcgagcgcg

SEQ ID NO: 2160 - RNA, 20 nt, Artificial Sequence
  Synthetic
guggcuccagaacccgcgcg

SEQ ID NO: 2161 - RNA, 20 nt, Artificial Sequence
  Synthetic
cccgggggucuucgcgcgcg

SEQ ID NO: 2162 - RNA, 20 nt, Artificial Sequence
  Synthetic
gagcucggccacggcgcgcg

SEQ ID NO: 2163 - RNA, 20 nt, Artificial Sequence
  Synthetic
acgcgccccgccugcgcgcg

SEQ ID NO: 2164 - RNA, 20 nt, Artificial Sequence
  Synthetic
ggcccggcgguacucgcgcg

SEQ ID NO: 2165 - RNA, 20 nt, Artificial Sequence
  Synthetic
gugagcucggccacggcgcg

SEQ ID NO: 2166 - RNA, 20 nt, Artificial Sequence
  Synthetic
uggaggggggcgcgggcgcg

SEQ ID NO: 2167 - RNA, 20 nt, Artificial Sequence
  Synthetic
guacguggcgcuggggcgcg

SEQ ID NO: 2168 - RNA, 20 nt, Artificial Sequence
  Synthetic
ccugcgcggggaccugcgcg

SEQ ID NO: 2169 - RNA, 20 nt, Artificial Sequence
  Synthetic
ggugcucaugcgccugcgcg

SEQ ID NO: 2170 - RNA, 20 nt, Artificial Sequence
  Synthetic
gcaggaagcccuucugcgcg

SEQ ID NO: 2171 - RNA, 20 nt, Artificial Sequence
  Synthetic
cgaccccgaggacgugcgcg

SEQ ID NO: 2172 - RNA, 20 nt, Artificial Sequence
  Synthetic
gaaggagcugcuguugcgcg

SEQ ID NO: 2173 - RNA, 20 nt, Artificial Sequence
  Synthetic
acggcccggcgguacucgcg

SEQ ID NO: 2174 - RNA, 20 nt, Artificial Sequence
  Synthetic
cgcagccacgcgcgcaggcg

SEQ ID NO: 2175 - RNA, 20 nt, Artificial Sequence
  Synthetic
gccgcggagcucggcaggcg

SEQ ID NO: 2176 - RNA, 20 nt, Artificial Sequence
  Synthetic
ccgaccacgcacgcgaggcg

SEQ ID NO: 2177 - RNA, 20 nt, Artificial Sequence
  Synthetic
ccaacaggggcgcguaggcg

SEQ ID NO: 2178 - RNA, 20 nt, Artificial Sequence
  Synthetic
gaagacgaagaagagcggcg

SEQ ID NO: 2179 - RNA, 20 nt, Artificial Sequence
  Synthetic
cuugcgccccucccgcggcg

SEQ ID NO: 2180 - RNA, 20 nt, Artificial Sequence
  Synthetic
cgaggaccuggccggcggcg

SEQ ID NO: 2181 - RNA, 20 nt, Artificial Sequence
  Synthetic
ccgugcgcuggccggcggcg

SEQ ID NO: 2182 - RNA, 20 nt, Artificial Sequence
  Synthetic
gucggcgugcggcggcggcg

SEQ ID NO: 2183 - RNA, 20 nt, Artificial Sequence
  Synthetic
ccaagccccgggcggcggcg

SEQ ID NO: 2184 - RNA, 20 nt, Artificial Sequence
  Synthetic
gcaccgugcuggcggcggcg

SEQ ID NO: 2185 - RNA, 20 nt, Artificial Sequence
  Synthetic
acagccgccccagggcggcg

SEQ ID NO: 2186 - RNA, 20 nt, Artificial Sequence
  Synthetic
cgcacgcggccugggcggcg

SEQ ID NO: 2187 - RNA, 20 nt, Artificial Sequence
  Synthetic
cgucgucgucggcgucggcg

SEQ ID NO: 2188 - RNA, 20 nt, Artificial Sequence
  Synthetic
cgucgggcuccagcagggcg

SEQ ID NO: 2189 - RNA, 20 nt, Artificial Sequence
  Synthetic
gaggggggguggcccgggcg

SEQ ID NO: 2190 - RNA, 20 nt, Artificial Sequence
  Synthetic
guacucgccgcugccgggcg

SEQ ID NO: 2191 - RNA, 20 nt, Artificial Sequence
  Synthetic
cguggaggggggcgcgggcg

SEQ ID NO: 2192 - RNA, 20 nt, Artificial Sequence
  Synthetic
ccccgcgggggaggcgggcg

SEQ ID NO: 2193 - RNA, 20 nt, Artificial Sequence
  Synthetic
gaggcgcgggccgucgggcg

SEQ ID NO: 2194 - RNA, 20 nt, Artificial Sequence
  Synthetic
cgcgacacggccacggggcg

SEQ ID NO: 2195 - RNA, 20 nt, Artificial Sequence
  Synthetic
cagcacccgccccgggggcg

SEQ ID NO: 2196 - RNA, 20 nt, Artificial Sequence
  Synthetic
gggcucgggccccgggggcg

SEQ ID NO: 2197 - RNA, 20 nt, Artificial Sequence
  Synthetic
aacuucccgccgcgggggcg

SEQ ID NO: 2198 - RNA, 20 nt, Artificial Sequence
  Synthetic
cgggcgcggggaggggggcg

SEQ ID NO: 2199 - RNA, 20 nt, Artificial Sequence
  Synthetic
cgggggcguggaggggggcg

SEQ ID NO: 2200 - RNA, 20 nt, Artificial Sequence
  Synthetic
ccacgcggccggccugggcg

SEQ ID NO: 2201 - RNA, 20 nt, Artificial Sequence
  Synthetic
ggggcgccgcgggcugggcg

SEQ ID NO: 2202 - RNA, 20 nt, Artificial Sequence
  Synthetic
cgccgcccggggcuugggcg

SEQ ID NO: 2203 - RNA, 20 nt, Artificial Sequence
  Synthetic
ucaucaccggcagcguggcg

SEQ ID NO: 2204 - RNA, 20 nt, Artificial Sequence
  Synthetic
gccggcccggcccgguggcg

SEQ ID NO: 2205 - RNA, 20 nt, Artificial Sequence
  Synthetic
cuggugcucaugcgccugcg

SEQ ID NO: 2206 - RNA, 20 nt, Artificial Sequence
  Synthetic
gaucagggcguacugcugcg

SEQ ID NO: 2207 - RNA, 20 nt, Artificial Sequence
  Synthetic
gcccccccgcuggugcugcg

SEQ ID NO: 2208 - RNA, 20 nt, Artificial Sequence
  Synthetic
cggcgcgccggacuucugcg

SEQ ID NO: 2209 - RNA, 20 nt, Artificial Sequence
  Synthetic
gggguacaggcgcgcgugcg

SEQ ID NO: 2210 - RNA, 20 nt, Artificial Sequence
  Synthetic
cggcccgcgccucgcgugcg

SEQ ID NO: 2211 - RNA, 20 nt, Artificial Sequence
  Synthetic
cggcgaccggcggcucaucg

SEQ ID NO: 2212 - RNA, 20 nt, Artificial Sequence
  Synthetic
ggcgcaccgcgcggcgaucg

SEQ ID NO: 2213 - RNA, 20 nt, Artificial Sequence
  Synthetic
acggccgggcggcggccucg

SEQ ID NO: 2214 - RNA, 20 nt, Artificial Sequence
  Synthetic
uggccggcggcggggccucg

SEQ ID NO: 2215 - RNA, 20 nt, Artificial Sequence
  Synthetic
ccaccacgcgcacguccucg

SEQ ID NO: 2216 - RNA, 20 nt, Artificial Sequence
  Synthetic
cgcccagcgccgacacgucg

SEQ ID NO: 2217 - RNA, 20 nt, Artificial Sequence
  Synthetic
ggcgcagcggcggcgcgucg

SEQ ID NO: 2218 - RNA, 20 nt, Artificial Sequence
  Synthetic
cggcguggcgggcggcgucg

SEQ ID NO: 2219 - RNA, 20 nt, Artificial Sequence
  Synthetic
ugaagcggcccguggcgucg

SEQ ID NO: 2220 - RNA, 20 nt, Artificial Sequence
  Synthetic
cgcgcacguccucggggucg

SEQ ID NO: 2221 - RNA, 20 nt, Artificial Sequence
  Synthetic
gccagccgcccagggggucg

SEQ ID NO: 2222 - RNA, 20 nt, Artificial Sequence
  Synthetic
uucuucgucuucgggggucg

SEQ ID NO: 2223 - RNA, 20 nt, Artificial Sequence
  Synthetic
ccgacgggcccgcggugucg

SEQ ID NO: 2224 - RNA, 20 nt, Artificial Sequence
  Synthetic
gccgcucuucuucgucuucg

SEQ ID NO: 2225 - RNA, 20 nt, Artificial Sequence
  Synthetic
agacgacggcggcgcguucg

SEQ ID NO: 2226 - RNA, 20 nt, Artificial Sequence
  Synthetic
ggaggcgcgacgccgguucg

SEQ ID NO: 2227 - RNA, 20 nt, Artificial Sequence
  Synthetic
ccgccauggcguagcccagg

SEQ ID NO: 2228 - RNA, 20 nt, Artificial Sequence
  Synthetic
gguccaauugcccgcccagg

SEQ ID NO: 2229 - RNA, 20 nt, Artificial Sequence
  Synthetic
gccgccgccagccgcccagg

SEQ ID NO: 2230 - RNA, 20 nt, Artificial Sequence
  Synthetic
uggccgccgccgccagcagg

SEQ ID NO: 2231 - RNA, 20 nt, Artificial Sequence
  Synthetic
cgcgcagccacgcgcgcagg

SEQ ID NO: 2232 - RNA, 20 nt, Artificial Sequence
  Synthetic
caggccccagcgcgcgcagg

SEQ ID NO: 2233 - RNA, 20 nt, Artificial Sequence
  Synthetic
gcgggcccgaggcgcgcagg

SEQ ID NO: 2234 - RNA, 20 nt, Artificial Sequence
  Synthetic
cuccaggaucccgcggcagg

SEQ ID NO: 2235 - RNA, 20 nt, Artificial Sequence
  Synthetic
cgcgcagggggccaaagagg

SEQ ID NO: 2236 - RNA, 20 nt, Artificial Sequence
  Synthetic
ugggcgcggccucggagagg

SEQ ID NO: 2237 - RNA, 20 nt, Artificial Sequence
  Synthetic
cgccggcgcagaugacgagg

SEQ ID NO: 2238 - RNA, 20 nt, Artificial Sequence
  Synthetic
ccucuggggggcgcccgagg

SEQ ID NO: 2239 - RNA, 20 nt, Artificial Sequence
  Synthetic
cguggcgcuggggcgcgagg

SEQ ID NO: 2240 - RNA, 20 nt, Artificial Sequence
  Synthetic
cgcgccggacuucugcgagg

SEQ ID NO: 2241 - RNA, 20 nt, Artificial Sequence
  Synthetic
cgacggcggcgcguucgagg

SEQ ID NO: 2242 - RNA, 20 nt, Artificial Sequence
  Synthetic
gccggacuucugcgaggagg

SEQ ID NO: 2243 - RNA, 20 nt, Artificial Sequence
  Synthetic
ccggcccggccgcccggagg

SEQ ID NO: 2244 - RNA, 20 nt, Artificial Sequence
  Synthetic
gggggcgcccgaggcggagg

SEQ ID NO: 2245 - RNA, 20 nt, Artificial Sequence
  Synthetic
cucccgcggcgcggcggagg

SEQ ID NO: 2246 - RNA, 20 nt, Artificial Sequence
  Synthetic
ggaggugcugggggcggagg

SEQ ID NO: 2247 - RNA, 20 nt, Artificial Sequence
  Synthetic
ggggcgcgggcgcggggagg

SEQ ID NO: 2248 - RNA, 20 nt, Artificial Sequence
  Synthetic
gucgccccccgcgggggagg

SEQ ID NO: 2249 - RNA, 20 nt, Artificial Sequence
  Synthetic
gggccccgggggcguggagg

SEQ ID NO: 2250 - RNA, 20 nt, Artificial Sequence
  Synthetic
cccggggcccagccacacgg

SEQ ID NO: 2251 - RNA, 20 nt, Artificial Sequence
  Synthetic
ggcgcgcacggcggccacgg

SEQ ID NO: 2252 - RNA, 20 nt, Artificial Sequence
  Synthetic
ucggcggcucauggccacgg

SEQ ID NO: 2253 - RNA, 20 nt, Artificial Sequence
  Synthetic
caggcucacggcgcgcacgg

SEQ ID NO: 2254 - RNA, 20 nt, Artificial Sequence
  Synthetic
gcgcacggcgcacugcacgg

SEQ ID NO: 2255 - RNA, 20 nt, Artificial Sequence
  Synthetic
gccugggacgaagacgacgg

SEQ ID NO: 2256 - RNA, 20 nt, Artificial Sequence
  Synthetic
cggugcggcggcggcgacgg

SEQ ID NO: 2257 - RNA, 20 nt, Artificial Sequence
  Synthetic
cgagaacgcggcgcugacgg

SEQ ID NO: 2258 - RNA, 20 nt, Artificial Sequence
  Synthetic
ccggggcgggugcuguacgg

SEQ ID NO: 2259 - RNA, 20 nt, Artificial Sequence
  Synthetic
ucgccagcgccggcgaccgg

SEQ ID NO: 2260 - RNA, 20 nt, Artificial Sequence
  Synthetic
ccccgcggcgccguacccgg

SEQ ID NO: 2261 - RNA, 20 nt, Artificial Sequence
  Synthetic
gccaaagaggcggcccccgg

SEQ ID NO: 2262 - RNA, 20 nt, Artificial Sequence
  Synthetic
ucacggccgggcagccccgg

SEQ ID NO: 2263 - RNA, 20 nt, Artificial Sequence
  Synthetic
ccguacagcacccgccccgg

SEQ ID NO: 2264 - RNA, 20 nt, Artificial Sequence
  Synthetic
cgaggccucgggcgccccgg

SEQ ID NO: 2265 - RNA, 20 nt, Artificial Sequence
  Synthetic
ggggcgggcucgggccccgg

SEQ ID NO: 2266 - RNA, 20 nt, Artificial Sequence
  Synthetic
gccguguggcugggccccgg

SEQ ID NO: 2267 - RNA, 20 nt, Artificial Sequence
  Synthetic
ggcccggcccggccgcccgg

SEQ ID NO: 2268 - RNA, 20 nt, Artificial Sequence
  Synthetic
cgggggcggcguccgcccgg

SEQ ID NO: 2269 - RNA, 20 nt, Artificial Sequence
  Synthetic
gcgccggcagcacggcccgg

SEQ ID NO: 2270 - RNA, 20 nt, Artificial Sequence
  Synthetic
cggcgacgacgacggcccgg

SEQ ID NO: 2271 - RNA, 20 nt, Artificial Sequence
  Synthetic
ugcgcgccggcccggcccgg

SEQ ID NO: 2272 - RNA, 20 nt, Artificial Sequence
  Synthetic
gggccgcguguucggcccgg

SEQ ID NO: 2273 - RNA, 20 nt, Artificial Sequence
  Synthetic
ccaccgccgcgcgggcccgg

SEQ ID NO: 2274 - RNA, 20 nt, Artificial Sequence
  Synthetic
ggcgcgggcguccgagccgg

SEQ ID NO: 2275 - RNA, 20 nt, Artificial Sequence
  Synthetic
cacccccacggggccgccgg

SEQ ID NO: 2276 - RNA, 20 nt, Artificial Sequence
  Synthetic
gcgcgcguagaaggcgccgg

SEQ ID NO: 2277 - RNA, 20 nt, Artificial Sequence
  Synthetic
cgaaucccgggcggcgccgg

SEQ ID NO: 2278 - RNA, 20 nt, Artificial Sequence
  Synthetic
cgccagccccccgcggccgg

SEQ ID NO: 2279 - RNA, 20 nt, Artificial Sequence
  Synthetic
ccgggcgaggaccuggccgg

SEQ ID NO: 2280 - RNA, 20 nt, Artificial Sequence
  Synthetic
gugcgccgugcgcuggccgg

SEQ ID NO: 2281 - RNA, 20 nt, Artificial Sequence
  Synthetic
ggggaccugcgcguggccgg

SEQ ID NO: 2282 - RNA, 20 nt, Artificial Sequence
  Synthetic
cgcucggcggaccacuccgg

SEQ ID NO: 2283 - RNA, 20 nt, Artificial Sequence
  Synthetic
ucgccgcgcagcaccagcgg

SEQ ID NO: 2284 - RNA, 20 nt, Artificial Sequence
  Synthetic
ccgcggcacaggcgcagcgg

SEQ ID NO: 2285 - RNA, 20 nt, Artificial Sequence
  Synthetic
cuggggccuggcgcacgcgg

SEQ ID NO: 2286 - RNA, 20 nt, Artificial Sequence
  Synthetic
gcuguacaccccggacgcgg

SEQ ID NO: 2287 - RNA, 20 nt, Artificial Sequence
  Synthetic
ggggucgucgccccccgcgg

SEQ ID NO: 2288 - RNA, 20 nt, Artificial Sequence
  Synthetic
gcuuggccacgcccccgcgg

SEQ ID NO: 2289 - RNA, 20 nt, Artificial Sequence
  Synthetic
cgcgcccgccucccccgcgg

SEQ ID NO: 2290 - RNA, 20 nt, Artificial Sequence
  Synthetic
gcgcucgaugcggcccgcgg

SEQ ID NO: 2291 - RNA, 20 nt, Artificial Sequence
  Synthetic
uccacaacuucccgccgcgg

SEQ ID NO: 2292 - RNA, 20 nt, Artificial Sequence
  Synthetic
cgggcgggccugcgccgcgg

SEQ ID NO: 2293 - RNA, 20 nt, Artificial Sequence
  Synthetic
gcggcccgcggaggccgcgg

SEQ ID NO: 2294 - RNA, 20 nt, Artificial Sequence
  Synthetic
gcgggucccuccggccgcgg

SEQ ID NO: 2295 - RNA, 20 nt, Artificial Sequence
  Synthetic
cccgguggcgcgggccgcgg

SEQ ID NO: 2296 - RNA, 20 nt, Artificial Sequence
  Synthetic
ccgcugcgccugugccgcgg

SEQ ID NO: 2297 - RNA, 20 nt, Artificial Sequence
  Synthetic
gucaaacagcagguccgcgg

SEQ ID NO: 2298 - RNA, 20 nt, Artificial Sequence
  Synthetic
gagugguccgccgagcgcgg

SEQ ID NO: 2299 - RNA, 20 nt, Artificial Sequence
  Synthetic
gcgccgccgggcccgcgcgg

SEQ ID NO: 2300 - RNA, 20 nt, Artificial Sequence
  Synthetic
gcgccccucccgcggcgcgg

SEQ ID NO: 2301 - RNA, 20 nt, Artificial Sequence
  Synthetic
cgcgggggaggcgggcgcgg

SEQ ID NO: 2302 - RNA, 20 nt, Artificial Sequence
  Synthetic
cuggggggcgcccgaggcgg

SEQ ID NO: 2303 - RNA, 20 nt, Artificial Sequence
  Synthetic
gcccggccgcccggaggcgg

SEQ ID NO: 2304 - RNA, 20 nt, Artificial Sequence
  Synthetic
ccgcggcgcggcggaggcgg

SEQ ID NO: 2305 - RNA, 20 nt, Artificial Sequence
  Synthetic
ggcgaggaccuggccggcgg

SEQ ID NO: 2306 - RNA, 20 nt, Artificial Sequence
  Synthetic
aaacagcagguccgcggcgg

SEQ ID NO: 2307 - RNA, 20 nt, Artificial Sequence
  Synthetic
ccgccgggcccgcgcggcgg

SEQ ID NO: 2308 - RNA, 20 nt, Artificial Sequence
  Synthetic
ccccucccgcggcgcggcgg

SEQ ID NO: 2309 - RNA, 20 nt, Artificial Sequence
  Synthetic
cggcgcggcggaggcggcgg

SEQ ID NO: 2310 - RNA, 20 nt, Artificial Sequence
  Synthetic
cagcagguccgcggcggcgg

SEQ ID NO: 2311 - RNA, 20 nt, Artificial Sequence
  Synthetic
caccgugcuggcggcggcgg

SEQ ID NO: 2312 - RNA, 20 nt, Artificial Sequence
  Synthetic
gcgucggcgugcggcggcgg

SEQ ID NO: 2313 - RNA, 20 nt, Artificial Sequence
  Synthetic
gcacgcggccugggcggcgg

SEQ ID NO: 2314 - RNA, 20 nt, Artificial Sequence
  Synthetic
gcgcccccugcuggcggcgg

SEQ ID NO: 2315 - RNA, 20 nt, Artificial Sequence
  Synthetic
cggcaccgugcuggcggcgg

SEQ ID NO: 2316 - RNA, 20 nt, Artificial Sequence
  Synthetic
gcccaggccgcgugcggcgg

SEQ ID NO: 2317 - RNA, 20 nt, Artificial Sequence
  Synthetic
ggcgcgucggcgugcggcgg

SEQ ID NO: 2318 - RNA, 20 nt, Artificial Sequence
  Synthetic
gcgcucgcccggugcggcgg

SEQ ID NO: 2319 - RNA, 20 nt, Artificial Sequence
  Synthetic
gcaguaggccuccagggcgg

SEQ ID NO: 2320 - RNA, 20 nt, Artificial Sequence
  Synthetic
cgcgcccaagccccgggcgg

SEQ ID NO: 2321 - RNA, 20 nt, Artificial Sequence
  Synthetic
aggggggguggcccgggcgg

SEQ ID NO: 2322 - RNA, 20 nt, Artificial Sequence
  Synthetic
ggcgcuggacggccgggcgg

SEQ ID NO: 2323 - RNA, 20 nt, Artificial Sequence
  Synthetic
agcacccgccccgggggcgg

SEQ ID NO: 2324 - RNA, 20 nt, Artificial Sequence
  Synthetic
cguggaggugcugggggcgg

SEQ ID NO: 2325 - RNA, 20 nt, Artificial Sequence
  Synthetic
gccgcacgcggccugggcgg

SEQ ID NO: 2326 - RNA, 20 nt, Artificial Sequence
  Synthetic
gggcgccgcgggcugggcgg

SEQ ID NO: 2327 - RNA, 20 nt, Artificial Sequence
  Synthetic
acccccugggcggcuggcgg

SEQ ID NO: 2328 - RNA, 20 nt, Artificial Sequence
  Synthetic
ccugcgcccccugcuggcgg

SEQ ID NO: 2329 - RNA, 20 nt, Artificial Sequence
  Synthetic
cagcggcaccgugcuggcgg

SEQ ID NO: 2330 - RNA, 20 nt, Artificial Sequence
  Synthetic
gccgcccaggccgcgugcgg

SEQ ID NO: 2331 - RNA, 20 nt, Artificial Sequence
  Synthetic
cggggcgcgucggcgugcgg

SEQ ID NO: 2332 - RNA, 20 nt, Artificial Sequence
  Synthetic
cgcgcgcucgcccggugcgg

SEQ ID NO: 2333 - RNA, 20 nt, Artificial Sequence
  Synthetic
ucugcgcgcggucguaucgg

SEQ ID NO: 2334 - RNA, 20 nt, Artificial Sequence
  Synthetic
cagggggucggggcccucgg

SEQ ID NO: 2335 - RNA, 20 nt, Artificial Sequence
  Synthetic
ggccggcggcggggccucgg

SEQ ID NO: 2336 - RNA, 20 nt, Artificial Sequence
  Synthetic
ggacagcccgccgcgcucgg

SEQ ID NO: 2337 - RNA, 20 nt, Artificial Sequence
  Synthetic
gcccagcgccgacacgucgg

SEQ ID NO: 2338 - RNA, 20 nt, Artificial Sequence
  Synthetic
cgacaccgcgggcccgucgg

SEQ ID NO: 2339 - RNA, 20 nt, Artificial Sequence
  Synthetic
ggcggccgccagcgcgucgg

SEQ ID NO: 2340 - RNA, 20 nt, Artificial Sequence
  Synthetic
gccgggcgccauggcgucgg

SEQ ID NO: 2341 - RNA, 20 nt, Artificial Sequence
  Synthetic
ccgcucuucuucgucuucgg

SEQ ID NO: 2342 - RNA, 20 nt, Artificial Sequence
  Synthetic
ggcggacagccgccccaggg

SEQ ID NO: 2343 - RNA, 20 nt, Artificial Sequence
  Synthetic
ggagcaguaggccuccaggg

SEQ ID NO: 2344 - RNA, 20 nt, Artificial Sequence
  Synthetic
gggcgcggccucggagaggg

SEQ ID NO: 2345 - RNA, 20 nt, Artificial Sequence
  Synthetic
gggcgcgggcgcggggaggg

SEQ ID NO: 2346 - RNA, 20 nt, Artificial Sequence
  Synthetic
ggccccgggggcguggaggg

SEQ ID NO: 2347 - RNA, 20 nt, Artificial Sequence
  Synthetic
cggcgccggcagcccccggg

SEQ ID NO: 2348 - RNA, 20 nt, Artificial Sequence
  Synthetic
ggccgcgcccaagccccggg

SEQ ID NO: 2349 - RNA, 20 nt, Artificial Sequence
  Synthetic
gcgccccccagaggcccggg

SEQ ID NO: 2350 - RNA, 20 nt, Artificial Sequence
  Synthetic
gagaggggggguggcccggg

SEQ ID NO: 2351 - RNA, 20 nt, Artificial Sequence
  Synthetic
gaggcccagcgaaucccggg

SEQ ID NO: 2352 - RNA, 20 nt, Artificial Sequence
  Synthetic
gccggcgcuggacggccggg

SEQ ID NO: 2353 - RNA, 20 nt, Artificial Sequence
  Synthetic
cgcgggccgccgccuccggg

SEQ ID NO: 2354 - RNA, 20 nt, Artificial Sequence
  Synthetic
aggggacggggaacagcggg

SEQ ID NO: 2355 - RNA, 20 nt, Artificial Sequence
  Synthetic
cgccgcgcagcaccagcggg

SEQ ID NO: 2356 - RNA, 20 nt, Artificial Sequence
  Synthetic
gcgcccgccucccccgcggg

SEQ ID NO: 2357 - RNA, 20 nt, Artificial Sequence
  Synthetic
cgccuccgccgcgccgcggg

SEQ ID NO: 2358 - RNA, 20 nt, Artificial Sequence
  Synthetic
cgggucccuccggccgcggg

SEQ ID NO: 2359 - RNA, 20 nt, Artificial Sequence
  Synthetic
acacggccacggggcgcggg

SEQ ID NO: 2360 - RNA, 20 nt, Artificial Sequence
  Synthetic
gucggcgucggcguggcggg

SEQ ID NO: 2361 - RNA, 20 nt, Artificial Sequence
  Synthetic
gccggcggcggggccucggg

SEQ ID NO: 2362 - RNA, 20 nt, Artificial Sequence
  Synthetic
gcgaggcgcgggccgucggg

SEQ ID NO: 2363 - RNA, 20 nt, Artificial Sequence
  Synthetic
ggcgcggccucggagagggg

SEQ ID NO: 2364 - RNA, 20 nt, Artificial Sequence
  Synthetic
ccgggcccccgcccccgggg

SEQ ID NO: 2365 - RNA, 20 nt, Artificial Sequence
  Synthetic
gccgcgcagcaccagcgggg

SEQ ID NO: 2366 - RNA, 20 nt, Artificial Sequence
  Synthetic
aggggggcgcgggcgcgggg

SEQ ID NO: 2367 - RNA, 20 nt, Artificial Sequence
  Synthetic
ccggcggcggggccucgggg

SEQ ID NO: 2368 - RNA, 20 nt, Artificial Sequence
  Synthetic
uacagcacccgccccggggg

SEQ ID NO: 2369 - RNA, 20 nt, Artificial Sequence
  Synthetic
gucgucgccccccgcggggg

SEQ ID NO: 2370 - RNA, 20 nt, Artificial Sequence
  Synthetic
cgcggccugggcggcggggg

SEQ ID NO: 2371 - RNA, 20 nt, Artificial Sequence
  Synthetic
ggggguggcccgggcggggg

SEQ ID NO: 2372 - RNA, 20 nt, Artificial Sequence
  Synthetic
cgccgcgggcugggcggggg

SEQ ID NO: 2373 - RNA, 20 nt, Artificial Sequence
  Synthetic
gcggccucggagaggggggg

SEQ ID NO: 2374 - RNA, 20 nt, Artificial Sequence
  Synthetic
ggccguggaggugcuggggg

SEQ ID NO: 2375 - RNA, 20 nt, Artificial Sequence
  Synthetic
ccccggcggccccguggggg

SEQ ID NO: 2376 - RNA, 20 nt, Artificial Sequence
  Synthetic
cggacgcggaggccaugggg

SEQ ID NO: 2377 - RNA, 20 nt, Artificial Sequence
  Synthetic
ggauccucgccgcccugggg

SEQ ID NO: 2378 - RNA, 20 nt, Artificial Sequence
  Synthetic
gagggccccgacccccuggg

SEQ ID NO: 2379 - RNA, 20 nt, Artificial Sequence
  Synthetic
gccggacacggccgccuggg

SEQ ID NO: 2380 - RNA, 20 nt, Artificial Sequence
  Synthetic
gccgccgcacgcggccuggg

SEQ ID NO: 2381 - RNA, 20 nt, Artificial Sequence
  Synthetic
ccggggcgccgcgggcuggg

SEQ ID NO: 2382 - RNA, 20 nt, Artificial Sequence
  Synthetic
cagccgcccgggccucuggg

SEQ ID NO: 2383 - RNA, 20 nt, Artificial Sequence
  Synthetic
ccaccugggcuacgccaugg

SEQ ID NO: 2384 - RNA, 20 nt, Artificial Sequence
  Synthetic
gggcccgcugcgccgcaugg

SEQ ID NO: 2385 - RNA, 20 nt, Artificial Sequence
  Synthetic
gggcuucgacggcgaccugg

SEQ ID NO: 2386 - RNA, 20 nt, Artificial Sequence
  Synthetic
gcccgcggccgccgcccugg

SEQ ID NO: 2387 - RNA, 20 nt, Artificial Sequence
  Synthetic
cgccugccgcgggauccugg

SEQ ID NO: 2388 - RNA, 20 nt, Artificial Sequence
  Synthetic
ggacgccgccgacgcgcugg

SEQ ID NO: 2389 - RNA, 20 nt, Artificial Sequence
  Synthetic
ccgacccccugggcggcugg

SEQ ID NO: 2390 - RNA, 20 nt, Artificial Sequence
  Synthetic
cuccggccgcggggggcugg

SEQ ID NO: 2391 - RNA, 20 nt, Artificial Sequence
  Synthetic
gagccugcgcccccugcugg

SEQ ID NO: 2392 - RNA, 20 nt, Artificial Sequence
  Synthetic
cgggcuguccugccugcugg

SEQ ID NO: 2393 - RNA, 20 nt, Artificial Sequence
  Synthetic
ccgcagcggcaccgugcugg

SEQ ID NO: 2394 - RNA, 20 nt, Artificial Sequence
  Synthetic
gggggccguggaggugcugg

SEQ ID NO: 2395 - RNA, 20 nt, Artificial Sequence
  Synthetic
acagccgcccgggccucugg

SEQ ID NO: 2396 - RNA, 20 nt, Artificial Sequence
  Synthetic
ggcccccggcggccccgugg

SEQ ID NO: 2397 - RNA, 20 nt, Artificial Sequence
  Synthetic
ggcggcggcgggggccgugg

SEQ ID NO: 2398 - RNA, 20 nt, Artificial Sequence
  Synthetic
gggggucuucgcgcgcgugg

SEQ ID NO: 2399 - RNA, 20 nt, Artificial Sequence
  Synthetic
ccccgaggacgugcgcgugg

SEQ ID NO: 2400 - RNA, 20 nt, Artificial Sequence
  Synthetic
cgucgucggcgucggcgugg

SEQ ID NO: 2401 - RNA, 20 nt, Artificial Sequence
  Synthetic
cucgggccccgggggcgugg

SEQ ID NO: 2402 - RNA, 20 nt, Artificial Sequence
  Synthetic
cggcggccccgugggggugg

SEQ ID NO: 2403 - RNA, 20 nt, Artificial Sequence
  Synthetic
gggcccgcgggucaaacaug

SEQ ID NO: 2404 - RNA, 20 nt, Artificial Sequence
  Synthetic
ggcgcauccaggccgccaug

SEQ ID NO: 2405 - RNA, 20 nt, Artificial Sequence
  Synthetic
ccccggacgcggaggccaug

SEQ ID NO: 2406 - RNA, 20 nt, Artificial Sequence
  Synthetic
gggcccggcggcgcucgaug

SEQ ID NO: 2407 - RNA, 20 nt, Artificial Sequence
  Synthetic
cgacgaggacgaagaggaug

SEQ ID NO: 2408 - RNA, 20 nt, Artificial Sequence
  Synthetic
cggggauccucgccgcccug

SEQ ID NO: 2409 - RNA, 20 nt, Artificial Sequence
  Synthetic
gcgcguggcugcgcgagcug

SEQ ID NO: 2410 - RNA, 20 nt, Artificial Sequence
  Synthetic
ggggccugggcgcgccgcug

SEQ ID NO: 2411 - RNA, 20 nt, Artificial Sequence
  Synthetic
ccgccagcacggugccgcug

SEQ ID NO: 2412 - RNA, 20 nt, Artificial Sequence
  Synthetic
cacgccgccugcgcgcgcug

SEQ ID NO: 2413 - RNA, 20 nt, Artificial Sequence
  Synthetic
ggcccguguacguggcgcug

SEQ ID NO: 2414 - RNA, 20 nt, Artificial Sequence
  Synthetic
gcggccggccgcuucggcug

SEQ ID NO: 2415 - RNA, 20 nt, Artificial Sequence
  Synthetic
cgggggccguggaggugcug

SEQ ID NO: 2416 - RNA, 20 nt, Artificial Sequence
  Synthetic
gacagccgcccgggccucug

SEQ ID NO: 2417 - RNA, 20 nt, Artificial Sequence
  Synthetic
ccggggccguggaguuucug

SEQ ID NO: 2418 - RNA, 20 nt, Artificial Sequence
  Synthetic
ggcccgaggccagcaccgug

SEQ ID NO: 2419 - RNA, 20 nt, Artificial Sequence
  Synthetic
cggcccccggcggccccgug

SEQ ID NO: 2420 - RNA, 20 nt, Artificial Sequence
  Synthetic
cggccgcgggcgccgccgug

SEQ ID NO: 2421 - RNA, 20 nt, Artificial Sequence
  Synthetic
cgggcgccccggcggccgug

SEQ ID NO: 2422 - RNA, 20 nt, Artificial Sequence
  Synthetic
cccgccgcccaggccgcgug

SEQ ID NO: 2423 - RNA, 20 nt, Artificial Sequence
  Synthetic
aggcggggcgcgucggcgug

SEQ ID NO: 2424 - RNA, 20 nt, Artificial Sequence
  Synthetic
gccauggcguagcccaggug

SEQ ID NO: 2425 - RNA, 20 nt, Artificial Sequence
  Synthetic
caccgcgcgcucgcccggug

SEQ ID NO: 2426 - RNA, 20 nt, Artificial Sequence
  Synthetic
ccggcggccccgugggggug

SEQ ID NO: 2427 - RNA, 20 nt, Artificial Sequence
  Synthetic
gcccuggccaaccggcugug

SEQ ID NO: 2428 - RNA, 20 nt, Artificial Sequence
  Synthetic
gcccccgcggcgggaaguug

SEQ ID NO: 2429 - RNA, 20 nt, Artificial Sequence
  Synthetic
cggccgccugggcgggcaau

SEQ ID NO: 2430 - RNA, 20 nt, Artificial Sequence
  Synthetic
cgguacucgcgcggggacau

SEQ ID NO: 2431 - RNA, 20 nt, Artificial Sequence
  Synthetic
accccggacgcggaggccau

SEQ ID NO: 2432 - RNA, 20 nt, Artificial Sequence
  Synthetic
ucacggccgguggcggccau

SEQ ID NO: 2433 - RNA, 20 nt, Artificial Sequence
  Synthetic
ccuucugcgcgcggucguau

SEQ ID NO: 2434 - RNA, 20 nt, Artificial Sequence
  Synthetic
gcggcgggaaguuguggacu

SEQ ID NO: 2435 - RNA, 20 nt, Artificial Sequence
  Synthetic
gcgcgggccgugccccaccu

SEQ ID NO: 2436 - RNA, 20 nt, Artificial Sequence
  Synthetic
gccgagggccccgacccccu

SEQ ID NO: 2437 - RNA, 20 nt, Artificial Sequence
  Synthetic
caggucgccgucgaagcccu

SEQ ID NO: 2438 - RNA, 20 nt, Artificial Sequence
  Synthetic
gcggggauccucgccgcccu

SEQ ID NO: 2439 - RNA, 20 nt, Artificial Sequence
  Synthetic
agccuggucgccggggcccu

SEQ ID NO: 2440 - RNA, 20 nt, Artificial Sequence
  Synthetic
gcccagggggucggggcccu

SEQ ID NO: 2441 - RNA, 20 nt, Artificial Sequence
  Synthetic
cgggccggacacggccgccu

SEQ ID NO: 2442 - RNA, 20 nt, Artificial Sequence
  Synthetic
gcgucgcgccuccuccgccu

SEQ ID NO: 2443 - RNA, 20 nt, Artificial Sequence
  Synthetic
cuuuggcccccugcgcgccu

SEQ ID NO: 2444 - RNA, 20 nt, Artificial Sequence
  Synthetic
uguggacugggaaggcgccu

SEQ ID NO: 2445 - RNA, 20 nt, Artificial Sequence
  Synthetic
gcgacgccgguucgaggccu

SEQ ID NO: 2446 - RNA, 20 nt, Artificial Sequence
  Synthetic
gacggccacgcggccggccu

SEQ ID NO: 2447 - RNA, 20 nt, Artificial Sequence
  Synthetic
gccgccgccgcacgcggccu

SEQ ID NO: 2448 - RNA, 20 nt, Artificial Sequence
  Synthetic
ccggggcuugggcgcggccu

SEQ ID NO: 2449 - RNA, 20 nt, Artificial Sequence
  Synthetic
cgggugcuguacggcggccu

SEQ ID NO: 2450 - RNA, 20 nt, Artificial Sequence
  Synthetic
ggacggccgggcggcggccu

SEQ ID NO: 2451 - RNA, 20 nt, Artificial Sequence
  Synthetic
ccuggccggcggcggggccu

SEQ ID NO: 2452 - RNA, 20 nt, Artificial Sequence
  Synthetic
gccugcgcgcgcuggggccu

SEQ ID NO: 2453 - RNA, 20 nt, Artificial Sequence
  Synthetic
gcccgggauucgcugggccu

SEQ ID NO: 2454 - RNA, 20 nt, Artificial Sequence
  Synthetic
gcgccgcacggugcuggccu

SEQ ID NO: 2455 - RNA, 20 nt, Artificial Sequence
  Synthetic
caccaccacgcgcacguccu

SEQ ID NO: 2456 - RNA, 20 nt, Artificial Sequence
  Synthetic
cugcgcggcgucgcccagcu

SEQ ID NO: 2457 - RNA, 20 nt, Artificial Sequence
  Synthetic
gccgugugggcgcccgagcu

SEQ ID NO: 2458 - RNA, 20 nt, Artificial Sequence
  Synthetic
gcggcggcggccgcggagcu

SEQ ID NO: 2459 - RNA, 20 nt, Artificial Sequence
  Synthetic
cagcgggugguccgugagcu

SEQ ID NO: 2460 - RNA, 20 nt, Artificial Sequence
  Synthetic
gcaggacagcccgccgcgcu

SEQ ID NO: 2461 - RNA, 20 nt, Artificial Sequence
  Synthetic
gcacgccgccugcgcgcgcu

SEQ ID NO: 2462 - RNA, 20 nt, Artificial Sequence
  Synthetic
gcccccgacgugucggcgcu

SEQ ID NO: 2463 - RNA, 20 nt, Artificial Sequence
  Synthetic
cggcccguguacguggcgcu

SEQ ID NO: 2464 - RNA, 20 nt, Artificial Sequence
  Synthetic
ggcgccgcccgggauucgcu

SEQ ID NO: 2465 - RNA, 20 nt, Artificial Sequence
  Synthetic
cggcgcggacgcccccggcu

SEQ ID NO: 2466 - RNA, 20 nt, Artificial Sequence
  Synthetic
ggcggccggccgcuucggcu

SEQ ID NO: 2467 - RNA, 20 nt, Artificial Sequence
  Synthetic
ggcccggggcgccgcgggcu

SEQ ID NO: 2468 - RNA, 20 nt, Artificial Sequence
  Synthetic
gcugggggcggaggcgggcu

SEQ ID NO: 2469 - RNA, 20 nt, Artificial Sequence
  Synthetic
gggcugggcgggggcgggcu

SEQ ID NO: 2470 - RNA, 20 nt, Artificial Sequence
  Synthetic
ccucgccgccgcccggggcu

SEQ ID NO: 2471 - RNA, 20 nt, Artificial Sequence
  Synthetic
gcgggcgccgccguguggcu

SEQ ID NO: 2472 - RNA, 20 nt, Artificial Sequence
  Synthetic
gcgggggccguggaggugcu

SEQ ID NO: 2473 - RNA, 20 nt, Artificial Sequence
  Synthetic
ccaggccugcuuccggaucu

SEQ ID NO: 2474 - RNA, 20 nt, Artificial Sequence
  Synthetic
cgacagccgcccgggccucu

SEQ ID NO: 2475 - RNA, 20 nt, Artificial Sequence
  Synthetic
gccggggccguggaguuucu

SEQ ID NO: 2476 - RNA, 20 nt, Artificial Sequence
  Synthetic
cacggcgcgcggggagcagu

SEQ ID NO: 2477 - RNA, 20 nt, Artificial Sequence
  Synthetic
cgcgcaggcggcgugcgagu

SEQ ID NO: 2478 - RNA, 20 nt, Artificial Sequence
  Synthetic
ugcgcccagcgccgacacgu

SEQ ID NO: 2479 - RNA, 20 nt, Artificial Sequence
  Synthetic
gcggcccccggcggccccgu

SEQ ID NO: 2480 - RNA, 20 nt, Artificial Sequence
  Synthetic
ccgcgacaccgcgggcccgu

SEQ ID NO: 2481 - RNA, 20 nt, Artificial Sequence
  Synthetic
gcacgcgaggcgcgggccgu

SEQ ID NO: 2482 - RNA, 20 nt, Artificial Sequence
  Synthetic
ggcggcggccgccagcgcgu

SEQ ID NO: 2483 - RNA, 20 nt, Artificial Sequence
  Synthetic
caggcgcagcggcggcgcgu

SEQ ID NO: 2484 - RNA, 20 nt, Artificial Sequence
  Synthetic
gcgcgccaacaggggcgcgu

SEQ ID NO: 2485 - RNA, 20 nt, Artificial Sequence
  Synthetic
cgcgcgcaggcggggcgcgu

SEQ ID NO: 2486 - RNA, 20 nt, Artificial Sequence
  Synthetic
gaaggcgccggaggucgcgu

SEQ ID NO: 2487 - RNA, 20 nt, Artificial Sequence
  Synthetic
gucggcguggcgggcggcgu

SEQ ID NO: 2488 - RNA, 20 nt, Artificial Sequence
  Synthetic
cccggcgucgucgucggcgu

SEQ ID NO: 2489 - RNA, 20 nt, Artificial Sequence
  Synthetic
cgcgccgggcgccauggcgu

SEQ ID NO: 2490 - RNA, 20 nt, Artificial Sequence
  Synthetic
aucggcgucaucgaccucgu

SEQ ID NO: 2491 - RNA, 20 nt, Artificial Sequence
  Synthetic
gucgucguccucguccucgu

SEQ ID NO: 2492 - RNA, 20 nt, Artificial Sequence
  Synthetic
gcggcgcccggcgucgucgu

SEQ ID NO: 2493 - RNA, 20 nt, Artificial Sequence
  Synthetic
cagcgggggggcgucgucgu

SEQ ID NO: 2494 - RNA, 20 nt, Artificial Sequence
  Synthetic
cgccauggcguagcccaggu

SEQ ID NO: 2495 - RNA, 20 nt, Artificial Sequence
  Synthetic
cagcagcucgcacgccaggu

SEQ ID NO: 2496 - RNA, 20 nt, Artificial Sequence
  Synthetic
guccggcccgcacagccggu

SEQ ID NO: 2497 - RNA, 20 nt, Artificial Sequence
  Synthetic
cacgcgcacguccucggggu

SEQ ID NO: 2498 - RNA, 20 nt, Artificial Sequence
  Synthetic
ccgccagccgcccagggggu

SEQ ID NO: 2499 - RNA, 20 nt, Artificial Sequence
  Synthetic
cccggcggccccgugggggu

SEQ ID NO: 2500 - RNA, 20 nt, Artificial Sequence
  Synthetic
ccgcgccucgcgugcguggu

SEQ ID NO: 2501 - RNA, 20 nt, Artificial Sequence
  Synthetic
ccgcgccuacgcgccccugu

SEQ ID NO: 2502 - RNA, 20 nt, Artificial Sequence
  Synthetic
gaccggcgcccccgacgugu

SEQ ID NO: 2503 - RNA, 20 nt, Artificial Sequence
  Synthetic
gggcgccccggcggccgugu

SEQ ID NO: 2504 - RNA, 20 nt, Artificial Sequence
  Synthetic
gccauggcggccggccgcuu

SEQ ID NO: 2505 - RNA, 20 nt, Artificial Sequence
  Synthetic
uaccgcgugcgcacgcgcuu

SEQ ID NO: 2506 - RNA, 20 nt, Artificial Sequence
  Synthetic
cucgccgccgcccggggcuu

SEQ ID NO: 2507 - RNA, 20 nt, Artificial Sequence
  Synthetic
gccgccgggggccgccucuu

SEQ ID NO: 2508 - RNA, 20 nt, Artificial Sequence
  Synthetic
gcgccgcucuucuucgucuu

SEQ ID NO: 2509 - RNA, 20 nt, Artificial Sequence
  Synthetic
cuggccucgggccgcguguu

SEQ ID NO: 2510 - RNA, 18 nt, Artificial Sequence
  Synthetic
gucgucggcucgaaaggc

SEQ ID NO: 2511 - RNA, 24 nt, Artificial Sequence
  Synthetic
gucaucgucgucggcucgaaaggc

SEQ ID NO: 2512 - RNA, 18 nt, Artificial Sequence
  Synthetic
gcggcgacaggcgguccg

SEQ ID NO: 2513 - RNA, 20 nt, Artificial Sequence
  Synthetic
gcgcggcgacaggcgguccg

SEQ ID NO: 2514 - RNA, 21 nt, Artificial Sequence
  Synthetic
ggcgcggcgacaggcgguccg

SEQ ID NO: 2515 - RNA, 22 nt, Artificial Sequence
  Synthetic
gggcgcggcgacaggcgguccg

SEQ ID NO: 2516 - RNA, 24 nt, Artificial Sequence
  Synthetic
gcgggcgcggcgacaggcgguccg

SEQ ID NO: 2517 - RNA, 22 nt, Artificial Sequence
  Synthetic
gcgaggccgcggggucgggcgu

SEQ ID NO: 2518 - RNA, 23 nt, Artificial Sequence
  Synthetic
ggcgaggccgcggggucgggcgu

SEQ ID NO: 2519 - RNA, 18 nt, Artificial Sequence
  Synthetic
gggcgucgucgaggucgu

SEQ ID NO: 2520 - RNA, 21 nt, Artificial Sequence
  Synthetic
gccgggcgucgucgaggucgu

SEQ ID NO: 2521 - RNA, 19 nt, Artificial Sequence
  Synthetic
gacaggcgguccguggggu

SEQ ID NO: 2522 - RNA, 21 nt, Artificial Sequence
  Synthetic
gcgacaggcgguccguggggu

SEQ ID NO: 2523 - RNA, 22 nt, Artificial Sequence
  Synthetic
ggcgacaggcgguccguggggu

SEQ ID NO: 2524 - RNA, 24 nt, Artificial Sequence
  Synthetic
gcggcgacaggcgguccguggggu

SEQ ID NO: 2525 - RNA, 18 nt, Artificial Sequence
  Synthetic
gguggucggggucguggu

SEQ ID NO: 2526 - RNA, 19 nt, Artificial Sequence
  Synthetic
ggguggucggggucguggu

SEQ ID NO: 2527 - RNA, 20 nt, Artificial Sequence
  Synthetic
gggguggucggggucguggu

SEQ ID NO: 2528 - RNA, 23 nt, Artificial Sequence
  Synthetic
gucgucgaggucguggggguggu

SEQ ID NO: 2529 - RNA, 22 nt, Artificial Sequence
  Synthetic
gaccgcgacgagcggggggccc

SEQ ID NO: 2530 - RNA, 19 nt, Artificial Sequence
  Synthetic
gccgacgacgaugacgggg

SEQ ID NO: 2531 - RNA, 21 nt, Artificial Sequence
  Synthetic
gagccgacgacgaugacgggg

SEQ ID NO: 2532 - RNA, 19 nt, Artificial Sequence
  Synthetic
cgucgucggcucgaaaggc

SEQ ID NO: 2533 - RNA, 20 nt, Artificial Sequence
  Synthetic
ucgucgucggcucgaaaggc

SEQ ID NO: 2534 - RNA, 21 nt, Artificial Sequence
  Synthetic
aucgucgucggcucgaaaggc

SEQ ID NO: 2535 - RNA, 22 nt, Artificial Sequence
  Synthetic
caucgucgucggcucgaaaggc

SEQ ID NO: 2536 - RNA, 23 nt, Artificial Sequence
  Synthetic
ucaucgucgucggcucgaaaggc

SEQ ID NO: 2537 - RNA, 19 nt, Artificial Sequence
  Synthetic
cgcggcgacaggcgguccg

SEQ ID NO: 2538 - RNA, 23 nt, Artificial Sequence
  Synthetic
cgggcgcggcgacaggcgguccg

SEQ ID NO: 2539 - RNA, 21 nt, Artificial Sequence
  Synthetic
ccgcucgucgcggucugggcu

SEQ ID NO: 2540 - RNA, 22 nt, Artificial Sequence
  Synthetic
cccgcucgucgcggucugggcu

SEQ ID NO: 2541 - RNA, 23 nt, Artificial Sequence
  Synthetic
ccccgcucgucgcggucugggcu

SEQ ID NO: 2542 - RNA, 24 nt, Artificial Sequence
  Synthetic
cccccgcucgucgcggucugggcu

SEQ ID NO: 2543 - RNA, 21 nt, Artificial Sequence
  Synthetic
cgaggccgcggggucgggcgu

SEQ ID NO: 2544 - RNA, 24 nt, Artificial Sequence
  Synthetic
cggcgaggccgcggggucgggcgu

SEQ ID NO: 2545 - RNA, 19 nt, Artificial Sequence
  Synthetic
cgggcgucgucgaggucgu

SEQ ID NO: 2546 - RNA, 20 nt, Artificial Sequence
  Synthetic
ccgggcgucgucgaggucgu

SEQ ID NO: 2547 - RNA, 22 nt, Artificial Sequence
  Synthetic
cgccgggcgucgucgaggucgu

SEQ ID NO: 2548 - RNA, 23 nt, Artificial Sequence
  Synthetic
ccgccgggcgucgucgaggucgu

SEQ ID NO: 2549 - RNA, 24 nt, Artificial Sequence
  Synthetic
cccgccgggcgucgucgaggucgu

SEQ ID NO: 2550 - RNA, 18 nt, Artificial Sequence
  Synthetic
acaggcgguccguggggu

SEQ ID NO: 2551 - RNA, 20 nt, Artificial Sequence
  Synthetic
cgacaggcgguccguggggu

SEQ ID NO: 2552 - RNA, 23 nt, Artificial Sequence
  Synthetic
cggcgacaggcgguccguggggu

SEQ ID NO: 2553 - RNA, 21 nt, Artificial Sequence
  Synthetic
cgucgaggucguggggguggu

SEQ ID NO: 2554 - RNA, 22 nt, Artificial Sequence
  Synthetic
ucgucgaggucguggggguggu

SEQ ID NO: 2555 - RNA, 24 nt, Artificial Sequence
  Synthetic
cgucgucgaggucguggggguggu

SEQ ID NO: 2556 - RNA, 21 nt, Artificial Sequence
  Synthetic
accgcgacgagcggggggccc

SEQ ID NO: 2557 - RNA, 23 nt, Artificial Sequence
  Synthetic
agaccgcgacgagcggggggccc

SEQ ID NO: 2558 - RNA, 24 nt, Artificial Sequence
  Synthetic
cagaccgcgacgagcggggggccc

SEQ ID NO: 2559 - RNA, 18 nt, Artificial Sequence
  Synthetic
ccgacgacgaugacgggg

SEQ ID NO: 2560 - RNA, 20 nt, Artificial Sequence
  Synthetic
agccgacgacgaugacgggg

SEQ ID NO: 2561 - RNA, 22 nt, Artificial Sequence
  Synthetic
cgagccgacgacgaugacgggg

SEQ ID NO: 2562 - RNA, 23 nt, Artificial Sequence
  Synthetic
ucgagccgacgacgaugacgggg

SEQ ID NO: 2563 - RNA, 24 nt, Artificial Sequence
  Synthetic
uucgagccgacgacgaugacgggg

SEQ ID NO: 2564 - RNA, 18 nt, Artificial Sequence
  Synthetic
uccggggcggcgaggccg

SEQ ID NO: 2565 - RNA, 19 nt, Artificial Sequence
  Synthetic
guccggggcggcgaggccg

SEQ ID NO: 2566 - RNA, 20 nt, Artificial Sequence
  Synthetic
gguccggggcggcgaggccg

SEQ ID NO: 2567 - RNA, 21 nt, Artificial Sequence
  Synthetic
ggguccggggcggcgaggccg

SEQ ID NO: 2568 - RNA, 22 nt, Artificial Sequence
  Synthetic
gggguccggggcggcgaggccg

SEQ ID NO: 2569 - RNA, 23 nt, Artificial Sequence
  Synthetic
ggggguccggggcggcgaggccg

SEQ ID NO: 2570 - RNA, 24 nt, Artificial Sequence
  Synthetic
cggggguccggggcggcgaggccg

SEQ ID NO: 2571 - RNA, 18 nt, Artificial Sequence
  Synthetic
cucgucgcggucugggcu

SEQ ID NO: 2572 - RNA, 19 nt, Artificial Sequence
  Synthetic
gcucgucgcggucugggcu

SEQ ID NO: 2573 - RNA, 20 nt, Artificial Sequence
  Synthetic
cgcucgucgcggucugggcu

SEQ ID NO: 2574 - RNA, 18 nt, Artificial Sequence
  Synthetic
ggccgcggggucgggcgu

SEQ ID NO: 2575 - RNA, 19 nt, Artificial Sequence
  Synthetic
aggccgcggggucgggcgu

SEQ ID NO: 2576 - RNA, 20 nt, Artificial Sequence
  Synthetic
gaggccgcggggucgggcgu

SEQ ID NO: 2577 - RNA, 21 nt, Artificial Sequence
  Synthetic
ggggguggucggggucguggu

SEQ ID NO: 2578 - RNA, 22 nt, Artificial Sequence
  Synthetic
uggggguggucggggucguggu

SEQ ID NO: 2579 - RNA, 23 nt, Artificial Sequence
  Synthetic
guggggguggucggggucguggu

SEQ ID NO: 2580 - RNA, 24 nt, Artificial Sequence
  Synthetic
cguggggguggucggggucguggu

SEQ ID NO: 2581 - RNA, 18 nt, Artificial Sequence
  Synthetic
cgaggucguggggguggu

SEQ ID NO: 2582 - RNA, 19 nt, Artificial Sequence
  Synthetic
ucgaggucguggggguggu

SEQ ID NO: 2583 - RNA, 20 nt, Artificial Sequence
  Synthetic
gucgaggucguggggguggu

SEQ ID NO: 2584 - RNA, 18 nt, Artificial Sequence
  Synthetic
gcgacgagcggggggccc

SEQ ID NO: 2585 - RNA, 19 nt, Artificial Sequence
  Synthetic
cgcgacgagcggggggccc

SEQ ID NO: 2586 - RNA, 20 nt, Artificial Sequence
  Synthetic
ccgcgacgagcggggggccc

SEQ ID NO: 2587 - RNA, 18 nt, Artificial Sequence
  Synthetic
ggacggccuccucuacca

SEQ ID NO: 2588 - RNA, 19 nt, Artificial Sequence
  Synthetic
cggacggccuccucuacca

SEQ ID NO: 2589 - RNA, 20 nt, Artificial Sequence
  Synthetic
ccggacggccuccucuacca

SEQ ID NO: 2590 - RNA, 21 nt, Artificial Sequence
  Synthetic
uccggacggccuccucuacca

SEQ ID NO: 2591 - RNA, 22 nt, Artificial Sequence
  Synthetic
guccggacggccuccucuacca

SEQ ID NO: 2592 - RNA, 23 nt, Artificial Sequence
  Synthetic
cguccggacggccuccucuacca

SEQ ID NO: 2593 - RNA, 24 nt, Artificial Sequence
  Synthetic
ucguccggacggccuccucuacca

SEQ ID NO: 2594 - RNA, 18 nt, Artificial Sequence
  Synthetic
ccggauacgcgccgcgua

SEQ ID NO: 2595 - RNA, 19 nt, Artificial Sequence
  Synthetic
uccggauacgcgccgcgua

SEQ ID NO: 2596 - RNA, 20 nt, Artificial Sequence
  Synthetic
guccggauacgcgccgcgua

SEQ ID NO: 2597 - RNA, 21 nt, Artificial Sequence
  Synthetic
gguccggauacgcgccgcgua

SEQ ID NO: 2598 - RNA, 22 nt, Artificial Sequence
  Synthetic
ggguccggauacgcgccgcgua

SEQ ID NO: 2599 - RNA, 23 nt, Artificial Sequence
  Synthetic
gggguccggauacgcgccgcgua

SEQ ID NO: 2600 - RNA, 24 nt, Artificial Sequence
  Synthetic
ugggguccggauacgcgccgcgua

SEQ ID NO: 2601 - RNA, 18 nt, Artificial Sequence
  Synthetic
uccgucuccgcgccccac

SEQ ID NO: 2602 - RNA, 19 nt, Artificial Sequence
  Synthetic
cuccgucuccgcgccccac

SEQ ID NO: 2603 - RNA, 20 nt, Artificial Sequence
  Synthetic
ccuccgucuccgcgccccac

SEQ ID NO: 2604 - RNA, 21 nt, Artificial Sequence
  Synthetic
uccuccgucuccgcgccccac

SEQ ID NO: 2605 - RNA, 22 nt, Artificial Sequence
  Synthetic
cuccuccgucuccgcgccccac

SEQ ID NO: 2606 - RNA, 23 nt, Artificial Sequence
  Synthetic
ccuccuccgucuccgcgccccac

SEQ ID NO: 2607 - RNA, 24 nt, Artificial Sequence
  Synthetic
cccuccuccgucuccgcgccccac

SEQ ID NO: 2608 - RNA, 18 nt, Artificial Sequence
  Synthetic
cggacggccuccucuacc

SEQ ID NO: 2609 - RNA, 19 nt, Artificial Sequence
  Synthetic
ccggacggccuccucuacc

SEQ ID NO: 2610 - RNA, 20 nt, Artificial Sequence
  Synthetic
uccggacggccuccucuacc

SEQ ID NO: 2611 - RNA, 21 nt, Artificial Sequence
  Synthetic
guccggacggccuccucuacc

SEQ ID NO: 2612 - RNA, 22 nt, Artificial Sequence
  Synthetic
cguccggacggccuccucuacc

SEQ ID NO: 2613 - RNA, 23 nt, Artificial Sequence
  Synthetic
ucguccggacggccuccucuacc

SEQ ID NO: 2614 - RNA, 24 nt, Artificial Sequence
  Synthetic
aucguccggacggccuccucuacc

SEQ ID NO: 2615 - RNA, 18 nt, Artificial Sequence
  Synthetic
cgucuccgcgccccaccc

SEQ ID NO: 2616 - RNA, 19 nt, Artificial Sequence
  Synthetic
ccgucuccgcgccccaccc

SEQ ID NO: 2617 - RNA, 20 nt, Artificial Sequence
  Synthetic
uccgucuccgcgccccaccc

SEQ ID NO: 2618 - RNA, 21 nt, Artificial Sequence
  Synthetic
cuccgucuccgcgccccaccc

SEQ ID NO: 2619 - RNA, 22 nt, Artificial Sequence
  Synthetic
ccuccgucuccgcgccccaccc

SEQ ID NO: 2620 - RNA, 23 nt, Artificial Sequence
  Synthetic
uccuccgucuccgcgccccaccc

SEQ ID NO: 2621 - RNA, 24 nt, Artificial Sequence
  Synthetic
cuccuccgucuccgcgccccaccc

SEQ ID NO: 2622 - RNA, 18 nt, Artificial Sequence
  Synthetic
ggcccgucgguggggccc

SEQ ID NO: 2623 - RNA, 19 nt, Artificial Sequence
  Synthetic
cggcccgucgguggggccc

SEQ ID NO: 2624 - RNA, 20 nt, Artificial Sequence
  Synthetic
gcggcccgucgguggggccc

SEQ ID NO: 2625 - RNA, 21 nt, Artificial Sequence
  Synthetic
ggcggcccgucgguggggccc

SEQ ID NO: 2626 - RNA, 22 nt, Artificial Sequence
  Synthetic
cggcggcccgucgguggggccc

SEQ ID NO: 2627 - RNA, 23 nt, Artificial Sequence
  Synthetic
gcggcggcccgucgguggggccc

SEQ ID NO: 2628 - RNA, 24 nt, Artificial Sequence
  Synthetic
ggcggcggcccgucgguggggccc

SEQ ID NO: 2629 - RNA, 18 nt, Artificial Sequence
  Synthetic
ccggcgucggugcccgcc

SEQ ID NO: 2630 - RNA, 19 nt, Artificial Sequence
  Synthetic
gccggcgucggugcccgcc

SEQ ID NO: 2631 - RNA, 20 nt, Artificial Sequence
  Synthetic
cgccggcgucggugcccgcc

SEQ ID NO: 2632 - RNA, 21 nt, Artificial Sequence
  Synthetic
ucgccggcgucggugcccgcc

SEQ ID NO: 2633 - RNA, 22 nt, Artificial Sequence
  Synthetic
cucgccggcgucggugcccgcc

SEQ ID NO: 2634 - RNA, 23 nt, Artificial Sequence
  Synthetic
ccucgccggcgucggugcccgcc

SEQ ID NO: 2635 - RNA, 24 nt, Artificial Sequence
  Synthetic
uccucgccggcgucggugcccgcc

SEQ ID NO: 2636 - RNA, 18 nt, Artificial Sequence
  Synthetic
guccggggcggcgaggcc

SEQ ID NO: 2637 - RNA, 19 nt, Artificial Sequence
  Synthetic
gguccggggcggcgaggcc

SEQ ID NO: 2638 - RNA, 20 nt, Artificial Sequence
  Synthetic
ggguccggggcggcgaggcc

SEQ ID NO: 2639 - RNA, 21 nt, Artificial Sequence
  Synthetic
gggguccggggcggcgaggcc

SEQ ID NO: 2640 - RNA, 22 nt, Artificial Sequence
  Synthetic
ggggguccggggcggcgaggcc

SEQ ID NO: 2641 - RNA, 23 nt, Artificial Sequence
  Synthetic
cggggguccggggcggcgaggcc

SEQ ID NO: 2642 - RNA, 24 nt, Artificial Sequence
  Synthetic
gcggggguccggggcggcgaggcc

SEQ ID NO: 2643 - RNA, 18 nt, Artificial Sequence
  Synthetic
ggccucccguucgcggcc

SEQ ID NO: 2644 - RNA, 19 nt, Artificial Sequence
  Synthetic
gggccucccguucgcggcc

SEQ ID NO: 2645 - RNA, 20 nt, Artificial Sequence
  Synthetic
ggggccucccguucgcggcc

SEQ ID NO: 2646 - RNA, 21 nt, Artificial Sequence
  Synthetic
cggggccucccguucgcggcc

SEQ ID NO: 2647 - RNA, 22 nt, Artificial Sequence
  Synthetic
gcggggccucccguucgcggcc

SEQ ID NO: 2648 - RNA, 23 nt, Artificial Sequence
  Synthetic
agcggggccucccguucgcggcc

SEQ ID NO: 2649 - RNA, 24 nt, Artificial Sequence
  Synthetic
uagcggggccucccguucgcggcc

SEQ ID NO: 2650 - RNA, 18 nt, Artificial Sequence
  Synthetic
cggcccgucgguggggcc

SEQ ID NO: 2651 - RNA, 19 nt, Artificial Sequence
  Synthetic
gcggcccgucgguggggcc

SEQ ID NO: 2652 - RNA, 20 nt, Artificial Sequence
  Synthetic
ggcggcccgucgguggggcc

SEQ ID NO: 2653 - RNA, 21 nt, Artificial Sequence
  Synthetic
cggcggcccgucgguggggcc

SEQ ID NO: 2654 - RNA, 22 nt, Artificial Sequence
  Synthetic
gcggcggcccgucgguggggcc

SEQ ID NO: 2655 - RNA, 23 nt, Artificial Sequence
  Synthetic
ggcggcggcccgucgguggggcc

SEQ ID NO: 2656 - RNA, 24 nt, Artificial Sequence
  Synthetic
gggcggcggcccgucgguggggcc

SEQ ID NO: 2657 - RNA, 18 nt, Artificial Sequence
  Synthetic
cgcggcgacaggcggucc

SEQ ID NO: 2658 - RNA, 19 nt, Artificial Sequence
  Synthetic
gcgcggcgacaggcggucc

SEQ ID NO: 2659 - RNA, 20 nt, Artificial Sequence
  Synthetic
ggcgcggcgacaggcggucc

SEQ ID NO: 2660 - RNA, 21 nt, Artificial Sequence
  Synthetic
gggcgcggcgacaggcggucc

SEQ ID NO: 2661 - RNA, 22 nt, Artificial Sequence
  Synthetic
cgggcgcggcgacaggcggucc

SEQ ID NO: 2662 - RNA, 23 nt, Artificial Sequence
  Synthetic
gcgggcgcggcgacaggcggucc

SEQ ID NO: 2663 - RNA, 24 nt, Artificial Sequence
  Synthetic
ggcgggcgcggcgacaggcggucc

SEQ ID NO: 2664 - RNA, 18 nt, Artificial Sequence
  Synthetic
cgguggggcccggggagc

SEQ ID NO: 2665 - RNA, 19 nt, Artificial Sequence
  Synthetic
ucgguggggcccggggagc

SEQ ID NO: 2666 - RNA, 20 nt, Artificial Sequence
  Synthetic
gucgguggggcccggggagc

SEQ ID NO: 2667 - RNA, 21 nt, Artificial Sequence
  Synthetic
cgucgguggggcccggggagc

SEQ ID NO: 2668 - RNA, 22 nt, Artificial Sequence
  Synthetic
ccgucgguggggcccggggagc

SEQ ID NO: 2669 - RNA, 23 nt, Artificial Sequence
  Synthetic
cccgucgguggggcccggggagc

SEQ ID NO: 2670 - RNA, 24 nt, Artificial Sequence
  Synthetic
gcccgucgguggggcccggggagc

SEQ ID NO: 2671 - RNA, 18 nt, Artificial Sequence
  Synthetic
ggcgucggugcccgccgc

SEQ ID NO: 2672 - RNA, 19 nt, Artificial Sequence
  Synthetic
cggcgucggugcccgccgc

SEQ ID NO: 2673 - RNA, 20 nt, Artificial Sequence
  Synthetic
ccggcgucggugcccgccgc

SEQ ID NO: 2674 - RNA, 21 nt, Artificial Sequence
  Synthetic
gccggcgucggugcccgccgc

SEQ ID NO: 2675 - RNA, 22 nt, Artificial Sequence
  Synthetic
cgccggcgucggugcccgccgc

SEQ ID NO: 2676 - RNA, 23 nt, Artificial Sequence
  Synthetic
ucgccggcgucggugcccgccgc

SEQ ID NO: 2677 - RNA, 24 nt, Artificial Sequence
  Synthetic
cucgccggcgucggugcccgccgc

SEQ ID NO: 2678 - RNA, 18 nt, Artificial Sequence
  Synthetic
cccgucaucgucgucggc

SEQ ID NO: 2679 - RNA, 19 nt, Artificial Sequence
  Synthetic
ccccgucaucgucgucggc

SEQ ID NO: 2680 - RNA, 20 nt, Artificial Sequence
  Synthetic
uccccgucaucgucgucggc

SEQ ID NO: 2681 - RNA, 21 nt, Artificial Sequence
  Synthetic
guccccgucaucgucgucggc

SEQ ID NO: 2682 - RNA, 22 nt, Artificial Sequence
  Synthetic
cguccccgucaucgucgucggc

SEQ ID NO: 2683 - RNA, 23 nt, Artificial Sequence
  Synthetic
ucguccccgucaucgucgucggc

SEQ ID NO: 2684 - RNA, 24 nt, Artificial Sequence
  Synthetic
cucguccccgucaucgucgucggc

SEQ ID NO: 2685 - RNA, 18 nt, Artificial Sequence
  Synthetic
ccguucgcggccccgggc

SEQ ID NO: 2686 - RNA, 19 nt, Artificial Sequence
  Synthetic
cccguucgcggccccgggc

SEQ ID NO: 2687 - RNA, 20 nt, Artificial Sequence
  Synthetic
ucccguucgcggccccgggc

SEQ ID NO: 2688 - RNA, 21 nt, Artificial Sequence
  Synthetic
cucccguucgcggccccgggc

SEQ ID NO: 2689 - RNA, 22 nt, Artificial Sequence
  Synthetic
ccucccguucgcggccccgggc

SEQ ID NO: 2690 - RNA, 23 nt, Artificial Sequence
  Synthetic
gccucccguucgcggccccgggc

SEQ ID NO: 2691 - RNA, 24 nt, Artificial Sequence
  Synthetic
ggccucccguucgcggccccgggc

SEQ ID NO: 2692 - RNA, 18 nt, Artificial Sequence
  Synthetic
gcggcccgucgguggggc

SEQ ID NO: 2693 - RNA, 19 nt, Artificial Sequence
  Synthetic
ggcggcccgucgguggggc

SEQ ID NO: 2694 - RNA, 20 nt, Artificial Sequence
  Synthetic
cggcggcccgucgguggggc

SEQ ID NO: 2695 - RNA, 21 nt, Artificial Sequence
  Synthetic
gcggcggcccgucgguggggc

SEQ ID NO: 2696 - RNA, 22 nt, Artificial Sequence
  Synthetic
ggcggcggcccgucgguggggc

SEQ ID NO: 2697 - RNA, 23 nt, Artificial Sequence
  Synthetic
gggcggcggcccgucgguggggc

SEQ ID NO: 2698 - RNA, 24 nt, Artificial Sequence
  Synthetic
ugggcggcggcccgucgguggggc

SEQ ID NO: 2699 - RNA, 18 nt, Artificial Sequence
  Synthetic
gcucgucgcggucugggc

SEQ ID NO: 2700 - RNA, 19 nt, Artificial Sequence
  Synthetic
cgcucgucgcggucugggc

SEQ ID NO: 2701 - RNA, 20 nt, Artificial Sequence
  Synthetic
ccgcucgucgcggucugggc

SEQ ID NO: 2702 - RNA, 21 nt, Artificial Sequence
  Synthetic
cccgcucgucgcggucugggc

SEQ ID NO: 2703 - RNA, 22 nt, Artificial Sequence
  Synthetic
ccccgcucgucgcggucugggc

SEQ ID NO: 2704 - RNA, 23 nt, Artificial Sequence
  Synthetic
cccccgcucgucgcggucugggc

SEQ ID NO: 2705 - RNA, 24 nt, Artificial Sequence
  Synthetic
ccccccgcucgucgcggucugggc

SEQ ID NO: 2706 - RNA, 18 nt, Artificial Sequence
  Synthetic
ccgggcgucgucgagguc

SEQ ID NO: 2707 - RNA, 19 nt, Artificial Sequence
  Synthetic
gccgggcgucgucgagguc

SEQ ID NO: 2708 - RNA, 20 nt, Artificial Sequence
  Synthetic
cgccgggcgucgucgagguc

SEQ ID NO: 2709 - RNA, 21 nt, Artificial Sequence
  Synthetic
ccgccgggcgucgucgagguc

SEQ ID NO: 2710 - RNA, 22 nt, Artificial Sequence
  Synthetic
cccgccgggcgucgucgagguc

SEQ ID NO: 2711 - RNA, 23 nt, Artificial Sequence
  Synthetic
ucccgccgggcgucgucgagguc

SEQ ID NO: 2712 - RNA, 24 nt, Artificial Sequence
  Synthetic
gucccgccgggcgucgucgagguc

SEQ ID NO: 2713 - RNA, 18 nt, Artificial Sequence
  Synthetic
gcucgaaaggcggggguc

SEQ ID NO: 2714 - RNA, 19 nt, Artificial Sequence
  Synthetic
ggcucgaaaggcggggguc

SEQ ID NO: 2715 - RNA, 20 nt, Artificial Sequence
  Synthetic
cggcucgaaaggcggggguc

SEQ ID NO: 2716 - RNA, 21 nt, Artificial Sequence
  Synthetic
ucggcucgaaaggcggggguc

SEQ ID NO: 2717 - RNA, 22 nt, Artificial Sequence
  Synthetic
gucggcucgaaaggcggggguc

SEQ ID NO: 2718 - RNA, 23 nt, Artificial Sequence
  Synthetic
cgucggcucgaaaggcggggguc

SEQ ID NO: 2719 - RNA, 24 nt, Artificial Sequence
  Synthetic
ucgucggcucgaaaggcggggguc

SEQ ID NO: 2720 - RNA, 18 nt, Artificial Sequence
  Synthetic
ucgucgucggcucgaaag

SEQ ID NO: 2721 - RNA, 19 nt, Artificial Sequence
  Synthetic
aucgucgucggcucgaaag

SEQ ID NO: 2722 - RNA, 20 nt, Artificial Sequence
  Synthetic
caucgucgucggcucgaaag

SEQ ID NO: 2723 - RNA, 21 nt, Artificial Sequence
  Synthetic
ucaucgucgucggcucgaaag

SEQ ID NO: 2724 - RNA, 22 nt, Artificial Sequence
  Synthetic
gucaucgucgucggcucgaaag

SEQ ID NO: 2725 - RNA, 23 nt, Artificial Sequence
  Synthetic
cgucaucgucgucggcucgaaag

SEQ ID NO: 2726 - RNA, 24 nt, Artificial Sequence
  Synthetic
ccgucaucgucgucggcucgaaag

SEQ ID NO: 2727 - RNA, 18 nt, Artificial Sequence
  Synthetic
cucuaccauggaggccag

SEQ ID NO: 2728 - RNA, 19 nt, Artificial Sequence
  Synthetic
ccucuaccauggaggccag

SEQ ID NO: 2729 - RNA, 20 nt, Artificial Sequence
  Synthetic
uccucuaccauggaggccag

SEQ ID NO: 2730 - RNA, 21 nt, Artificial Sequence
  Synthetic
cuccucuaccauggaggccag

SEQ ID NO: 2731 - RNA, 22 nt, Artificial Sequence
  Synthetic
ccuccucuaccauggaggccag

SEQ ID NO: 2732 - RNA, 23 nt, Artificial Sequence
  Synthetic
gccuccucuaccauggaggccag

SEQ ID NO: 2733 - RNA, 24 nt, Artificial Sequence
  Synthetic
ggccuccucuaccauggaggccag

SEQ ID NO: 2734 - RNA, 18 nt, Artificial Sequence
  Synthetic
ucgguggggcccggggag

SEQ ID NO: 2735 - RNA, 19 nt, Artificial Sequence
  Synthetic
gucgguggggcccggggag

SEQ ID NO: 2736 - RNA, 20 nt, Artificial Sequence
  Synthetic
cgucgguggggcccggggag

SEQ ID NO: 2737 - RNA, 21 nt, Artificial Sequence
  Synthetic
ccgucgguggggcccggggag

SEQ ID NO: 2738 - RNA, 22 nt, Artificial Sequence
  Synthetic
cccgucgguggggcccggggag

SEQ ID NO: 2739 - RNA, 23 nt, Artificial Sequence
  Synthetic
gcccgucgguggggcccggggag

SEQ ID NO: 2740 - RNA, 24 nt, Artificial Sequence
  Synthetic
ggcccgucgguggggcccggggag

SEQ ID NO: 2741 - RNA, 18 nt, Artificial Sequence
  Synthetic
cggauacgcgccgcguag

SEQ ID NO: 2742 - RNA, 19 nt, Artificial Sequence
  Synthetic
ccggauacgcgccgcguag

SEQ ID NO: 2743 - RNA, 20 nt, Artificial Sequence
  Synthetic
uccggauacgcgccgcguag

SEQ ID NO: 2744 - RNA, 21 nt, Artificial Sequence
  Synthetic
guccggauacgcgccgcguag

SEQ ID NO: 2745 - RNA, 22 nt, Artificial Sequence
  Synthetic
gguccggauacgcgccgcguag

SEQ ID NO: 2746 - RNA, 23 nt, Artificial Sequence
  Synthetic
ggguccggauacgcgccgcguag

SEQ ID NO: 2747 - RNA, 24 nt, Artificial Sequence
  Synthetic
gggguccggauacgcgccgcguag

SEQ ID NO: 2748 - RNA, 18 nt, Artificial Sequence
  Synthetic
gcccgucgguggggcccg

SEQ ID NO: 2749 - RNA, 19 nt, Artificial Sequence
  Synthetic
ggcccgucgguggggcccg

SEQ ID NO: 2750 - RNA, 20 nt, Artificial Sequence
  Synthetic
cggcccgucgguggggcccg

SEQ ID NO: 2751 - RNA, 21 nt, Artificial Sequence
  Synthetic
gcggcccgucgguggggcccg

SEQ ID NO: 2752 - RNA, 22 nt, Artificial Sequence
  Synthetic
ggcggcccgucgguggggcccg

SEQ ID NO: 2753 - RNA, 23 nt, Artificial Sequence
  Synthetic
cggcggcccgucgguggggcccg

SEQ ID NO: 2754 - RNA, 24 nt, Artificial Sequence
  Synthetic
gcggcggcccgucgguggggcccg

SEQ ID NO: 2755 - RNA, 18 nt, Artificial Sequence
  Synthetic
gggggcccucccgucccg

SEQ ID NO: 2756 - RNA, 19 nt, Artificial Sequence
  Synthetic
cgggggcccucccgucccg

SEQ ID NO: 2757 - RNA, 20 nt, Artificial Sequence
  Synthetic
gcgggggcccucccgucccg

SEQ ID NO: 2758 - RNA, 21 nt, Artificial Sequence
  Synthetic
cgcgggggcccucccgucccg

SEQ ID NO: 2759 - RNA, 22 nt, Artificial Sequence
  Synthetic
ccgcgggggcccucccgucccg

SEQ ID NO: 2760 - RNA, 23 nt, Artificial Sequence
  Synthetic
gccgcgggggcccucccgucccg

SEQ ID NO: 2761 - RNA, 24 nt, Artificial Sequence
  Synthetic
cgccgcgggggcccucccgucccg

SEQ ID NO: 2762 - RNA, 18 nt, Artificial Sequence
  Synthetic
cggcgucggugcccgccg

SEQ ID NO: 2763 - RNA, 19 nt, Artificial Sequence
  Synthetic
ccggcgucggugcccgccg

SEQ ID NO: 2764 - RNA, 20 nt, Artificial Sequence
  Synthetic
gccggcgucggugcccgccg

SEQ ID NO: 2765 - RNA, 21 nt, Artificial Sequence
  Synthetic
cgccggcgucggugcccgccg

SEQ ID NO: 2766 - RNA, 22 nt, Artificial Sequence
  Synthetic
ucgccggcgucggugcccgccg

SEQ ID NO: 2767 - RNA, 23 nt, Artificial Sequence
  Synthetic
cucgccggcgucggugcccgccg

SEQ ID NO: 2768 - RNA, 24 nt, Artificial Sequence
  Synthetic
ccucgccggcgucggugcccgccg

SEQ ID NO: 2769 - RNA, 18 nt, Artificial Sequence
  Synthetic
gcagagccagcugucgcg

SEQ ID NO: 2770 - RNA, 19 nt, Artificial Sequence
  Synthetic
agcagagccagcugucgcg

SEQ ID NO: 2771 - RNA, 20 nt, Artificial Sequence
  Synthetic
cagcagagccagcugucgcg

SEQ ID NO: 2772 - RNA, 21 nt, Artificial Sequence
  Synthetic
ccagcagagccagcugucgcg

SEQ ID NO: 2773 - RNA, 22 nt, Artificial Sequence
  Synthetic
gccagcagagccagcugucgcg

SEQ ID NO: 2774 - RNA, 23 nt, Artificial Sequence
  Synthetic
ggccagcagagccagcugucgcg

SEQ ID NO: 2775 - RNA, 24 nt, Artificial Sequence
  Synthetic
aggccagcagagccagcugucgcg

SEQ ID NO: 2776 - RNA, 18 nt, Artificial Sequence
  Synthetic
aggccgcggggucgggcg

SEQ ID NO: 2777 - RNA, 19 nt, Artificial Sequence
  Synthetic
gaggccgcggggucgggcg

SEQ ID NO: 2778 - RNA, 20 nt, Artificial Sequence
  Synthetic
cgaggccgcggggucgggcg

SEQ ID NO: 2779 - RNA, 21 nt, Artificial Sequence
  Synthetic
gcgaggccgcggggucgggcg

SEQ ID NO: 2780 - RNA, 22 nt, Artificial Sequence
  Synthetic
ggcgaggccgcggggucgggcg

SEQ ID NO: 2781 - RNA, 23 nt, Artificial Sequence
  Synthetic
cggcgaggccgcggggucgggcg

SEQ ID NO: 2782 - RNA, 24 nt, Artificial Sequence
  Synthetic
gcggcgaggccgcggggucgggcg

SEQ ID NO: 2783 - RNA, 18 nt, Artificial Sequence
  Synthetic
aggcggggguccggggcg

SEQ ID NO: 2784 - RNA, 19 nt, Artificial Sequence
  Synthetic
aaggcggggguccggggcg

SEQ ID NO: 2785 - RNA, 20 nt, Artificial Sequence
  Synthetic
aaaggcggggguccggggcg

SEQ ID NO: 2786 - RNA, 21 nt, Artificial Sequence
  Synthetic
gaaaggcggggguccggggcg

SEQ ID NO: 2787 - RNA, 22 nt, Artificial Sequence
  Synthetic
cgaaaggcggggguccggggcg

SEQ ID NO: 2788 - RNA, 23 nt, Artificial Sequence
  Synthetic
ucgaaaggcggggguccggggcg

SEQ ID NO: 2789 - RNA, 24 nt, Artificial Sequence
  Synthetic
cucgaaaggcggggguccggggcg

SEQ ID NO: 2790 - RNA, 18 nt, Artificial Sequence
  Synthetic
gugggcggcggcccgucg

SEQ ID NO: 2791 - RNA, 19 nt, Artificial Sequence
  Synthetic
ggugggcggcggcccgucg

SEQ ID NO: 2792 - RNA, 20 nt, Artificial Sequence
  Synthetic
gggugggcggcggcccgucg

SEQ ID NO: 2793 - RNA, 21 nt, Artificial Sequence
  Synthetic
ggggugggcggcggcccgucg

SEQ ID NO: 2794 - RNA, 22 nt, Artificial Sequence
  Synthetic
cggggugggcggcggcccgucg

SEQ ID NO: 2795 - RNA, 23 nt, Artificial Sequence
  Synthetic
ucggggugggcggcggcccgucg

SEQ ID NO: 2796 - RNA, 24 nt, Artificial Sequence
  Synthetic
cucggggugggcggcggcccgucg

SEQ ID NO: 2797 - RNA, 18 nt, Artificial Sequence
  Synthetic
ccgucccgccgggcgucg

SEQ ID NO: 2798 - RNA, 19 nt, Artificial Sequence
  Synthetic
cccgucccgccgggcgucg

SEQ ID NO: 2799 - RNA, 20 nt, Artificial Sequence
  Synthetic
ucccgucccgccgggcgucg

SEQ ID NO: 2800 - RNA, 21 nt, Artificial Sequence
  Synthetic
cucccgucccgccgggcgucg

SEQ ID NO: 2801 - RNA, 22 nt, Artificial Sequence
  Synthetic
ccucccgucccgccgggcgucg

SEQ ID NO: 2802 - RNA, 23 nt, Artificial Sequence
  Synthetic
cccucccgucccgccgggcgucg

SEQ ID NO: 2803 - RNA, 24 nt, Artificial Sequence
  Synthetic
gcccucccgucccgccgggcgucg

SEQ ID NO: 2804 - RNA, 18 nt, Artificial Sequence
  Synthetic
cgggcgucgucgaggucg

SEQ ID NO: 2805 - RNA, 19 nt, Artificial Sequence
  Synthetic
ccgggcgucgucgaggucg

SEQ ID NO: 2806 - RNA, 20 nt, Artificial Sequence
  Synthetic
gccgggcgucgucgaggucg

SEQ ID NO: 2807 - RNA, 21 nt, Artificial Sequence
  Synthetic
cgccgggcgucgucgaggucg

SEQ ID NO: 2808 - RNA, 22 nt, Artificial Sequence
  Synthetic
ccgccgggcgucgucgaggucg

SEQ ID NO: 2809 - RNA, 23 nt, Artificial Sequence
  Synthetic
cccgccgggcgucgucgaggucg

SEQ ID NO: 2810 - RNA, 24 nt, Artificial Sequence
  Synthetic
ucccgccgggcgucgucgaggucg

SEQ ID NO: 2811 - RNA, 18 nt, Artificial Sequence
  Synthetic
cgucgucggcucgaaagg

SEQ ID NO: 2812 - RNA, 19 nt, Artificial Sequence
  Synthetic
ucgucgucggcucgaaagg

SEQ ID NO: 2813 - RNA, 20 nt, Artificial Sequence
  Synthetic
aucgucgucggcucgaaagg

SEQ ID NO: 2814 - RNA, 21 nt, Artificial Sequence
  Synthetic
caucgucgucggcucgaaagg

SEQ ID NO: 2815 - RNA, 22 nt, Artificial Sequence
  Synthetic
ucaucgucgucggcucgaaagg

SEQ ID NO: 2816 - RNA, 23 nt, Artificial Sequence
  Synthetic
gucaucgucgucggcucgaaagg

SEQ ID NO: 2817 - RNA, 24 nt, Artificial Sequence
  Synthetic
cgucaucgucgucggcucgaaagg

SEQ ID NO: 2818 - RNA, 18 nt, Artificial Sequence
  Synthetic
ugggcggcggcccgucgg

SEQ ID NO: 2819 - RNA, 19 nt, Artificial Sequence
  Synthetic
gugggcggcggcccgucgg

SEQ ID NO: 2820 - RNA, 20 nt, Artificial Sequence
  Synthetic
ggugggcggcggcccgucgg

SEQ ID NO: 2821 - RNA, 21 nt, Artificial Sequence
  Synthetic
gggugggcggcggcccgucgg

SEQ ID NO: 2822 - RNA, 22 nt, Artificial Sequence
  Synthetic
ggggugggcggcggcccgucgg

SEQ ID NO: 2823 - RNA, 23 nt, Artificial Sequence
  Synthetic
cggggugggcggcggcccgucgg

SEQ ID NO: 2824 - RNA, 24 nt, Artificial Sequence
  Synthetic
ucggggugggcggcggcccgucgg

SEQ ID NO: 2825 - RNA, 18 nt, Artificial Sequence
  Synthetic
cccguucgcggccccggg

SEQ ID NO: 2826 - RNA, 19 nt, Artificial Sequence
  Synthetic
ucccguucgcggccccggg

SEQ ID NO: 2827 - RNA, 20 nt, Artificial Sequence
  Synthetic
cucccguucgcggccccggg

SEQ ID NO: 2828 - RNA, 21 nt, Artificial Sequence
  Synthetic
ccucccguucgcggccccggg

SEQ ID NO: 2829 - RNA, 22 nt, Artificial Sequence
  Synthetic
gccucccguucgcggccccggg

SEQ ID NO: 2830 - RNA, 23 nt, Artificial Sequence
  Synthetic
ggccucccguucgcggccccggg

SEQ ID NO: 2831 - RNA, 24 nt, Artificial Sequence
  Synthetic
gggccucccguucgcggccccggg

SEQ ID NO: 2832 - RNA, 18 nt, Artificial Sequence
  Synthetic
ucgcggucugggcucggg

SEQ ID NO: 2833 - RNA, 19 nt, Artificial Sequence
  Synthetic
gucgcggucugggcucggg

SEQ ID NO: 2834 - RNA, 20 nt, Artificial Sequence
  Synthetic
cgucgcggucugggcucggg

SEQ ID NO: 2835 - RNA, 21 nt, Artificial Sequence
  Synthetic
ucgucgcggucugggcucggg

SEQ ID NO: 2836 - RNA, 22 nt, Artificial Sequence
  Synthetic
cucgucgcggucugggcucggg

SEQ ID NO: 2837 - RNA, 23 nt, Artificial Sequence
  Synthetic
gcucgucgcggucugggcucggg

SEQ ID NO: 2838 - RNA, 24 nt, Artificial Sequence
  Synthetic
cgcucgucgcggucugggcucggg

SEQ ID NO: 2839 - RNA, 18 nt, Artificial Sequence
  Synthetic
ggcggcgaggccgcgggg

SEQ ID NO: 2840 - RNA, 19 nt, Artificial Sequence
  Synthetic
gggcggcgaggccgcgggg

SEQ ID NO: 2841 - RNA, 20 nt, Artificial Sequence
  Synthetic
ggggcggcgaggccgcgggg

SEQ ID NO: 2842 - RNA, 21 nt, Artificial Sequence
  Synthetic
cggggcggcgaggccgcgggg

SEQ ID NO: 2843 - RNA, 22 nt, Artificial Sequence
  Synthetic
ccggggcggcgaggccgcgggg

SEQ ID NO: 2844 - RNA, 23 nt, Artificial Sequence
  Synthetic
uccggggcggcgaggccgcgggg

SEQ ID NO: 2845 - RNA, 24 nt, Artificial Sequence
  Synthetic
guccggggcggcgaggccgcgggg

SEQ ID NO: 2846 - RNA, 18 nt, Artificial Sequence
  Synthetic
ggguggucggggucgugg

SEQ ID NO: 2847 - RNA, 19 nt, Artificial Sequence
  Synthetic
gggguggucggggucgugg

SEQ ID NO: 2848 - RNA, 20 nt, Artificial Sequence
  Synthetic
ggggguggucggggucgugg

SEQ ID NO: 2849 - RNA, 21 nt, Artificial Sequence
  Synthetic
uggggguggucggggucgugg

SEQ ID NO: 2850 - RNA, 22 nt, Artificial Sequence
  Synthetic
guggggguggucggggucgugg

SEQ ID NO: 2851 - RNA, 23 nt, Artificial Sequence
  Synthetic
cguggggguggucggggucgugg

SEQ ID NO: 2852 - RNA, 24 nt, Artificial Sequence
  Synthetic
ucguggggguggucggggucgugg

SEQ ID NO: 2853 - RNA, 18 nt, Artificial Sequence
  Synthetic
ucgaggucgugggggugg

SEQ ID NO: 2854 - RNA, 19 nt, Artificial Sequence
  Synthetic
gucgaggucgugggggugg

SEQ ID NO: 2855 - RNA, 20 nt, Artificial Sequence
  Synthetic
cgucgaggucgugggggugg

SEQ ID NO: 2856 - RNA, 21 nt, Artificial Sequence
  Synthetic
ucgucgaggucgugggggugg

SEQ ID NO: 2857 - RNA, 22 nt, Artificial Sequence
  Synthetic
gucgucgaggucgugggggugg

SEQ ID NO: 2858 - RNA, 23 nt, Artificial Sequence
  Synthetic
cgucgucgaggucgugggggugg

SEQ ID NO: 2859 - RNA, 24 nt, Artificial Sequence
  Synthetic
gcgucgucgaggucgugggggugg

SEQ ID NO: 2860 - RNA, 18 nt, Artificial Sequence
  Synthetic
gucgggcgucgggaucgu

SEQ ID NO: 2861 - RNA, 19 nt, Artificial Sequence
  Synthetic
ggucgggcgucgggaucgu

SEQ ID NO: 2862 - RNA, 20 nt, Artificial Sequence
  Synthetic
gggucgggcgucgggaucgu

SEQ ID NO: 2863 - RNA, 21 nt, Artificial Sequence
  Synthetic
ggggucgggcgucgggaucgu

SEQ ID NO: 2864 - RNA, 22 nt, Artificial Sequence
  Synthetic
cggggucgggcgucgggaucgu

SEQ ID NO: 2865 - RNA, 23 nt, Artificial Sequence
  Synthetic
gcggggucgggcgucgggaucgu

SEQ ID NO: 2866 - RNA, 24 nt, Artificial Sequence
  Synthetic
cgcggggucgggcgucgggaucgu

SEQ ID NO: 2867 - RNA, 18 nt, Artificial Sequence
  Synthetic
ccccccgcucgucgcggu

SEQ ID NO: 2868 - RNA, 19 nt, Artificial Sequence
  Synthetic
gccccccgcucgucgcggu

SEQ ID NO: 2869 - RNA, 20 nt, Artificial Sequence
  Synthetic
ggccccccgcucgucgcggu

SEQ ID NO: 2870 - RNA, 21 nt, Artificial Sequence
  Synthetic
gggccccccgcucgucgcggu

SEQ ID NO: 2871 - RNA, 22 nt, Artificial Sequence
  Synthetic
agggccccccgcucgucgcggu

SEQ ID NO: 2872 - RNA, 23 nt, Artificial Sequence
  Synthetic
gagggccccccgcucgucgcggu

SEQ ID NO: 2873 - RNA, 24 nt, Artificial Sequence
  Synthetic
cgagggccccccgcucgucgcggu

SEQ ID NO: 2874 - RNA, 18 nt, Artificial Sequence
  Synthetic
ggcucgaaaggcgggggu

SEQ ID NO: 2875 - RNA, 19 nt, Artificial Sequence
  Synthetic
cggcucgaaaggcgggggu

SEQ ID NO: 2876 - RNA, 20 nt, Artificial Sequence
  Synthetic
ucggcucgaaaggcgggggu

SEQ ID NO: 2877 - RNA, 21 nt, Artificial Sequence
  Synthetic
gucggcucgaaaggcgggggu

SEQ ID NO: 2878 - RNA, 22 nt, Artificial Sequence
  Synthetic
cgucggcucgaaaggcgggggu

SEQ ID NO: 2879 - RNA, 23 nt, Artificial Sequence
  Synthetic
ucgucggcucgaaaggcgggggu

SEQ ID NO: 2880 - RNA, 24 nt, Artificial Sequence
  Synthetic
gucgucggcucgaaaggcgggggu

SEQ ID NO: 2881 - RNA, 18 nt, Artificial Sequence
  Synthetic
ccggcccggggccgcgaa

SEQ ID NO: 2882 - RNA, 19 nt, Artificial Sequence
  Synthetic
cccggcccggggccgcgaa

SEQ ID NO: 2883 - RNA, 20 nt, Artificial Sequence
  Synthetic
ccccggcccggggccgcgaa

SEQ ID NO: 2884 - RNA, 21 nt, Artificial Sequence
  Synthetic
gccccggcccggggccgcgaa

SEQ ID NO: 2885 - RNA, 22 nt, Artificial Sequence
  Synthetic
ggccccggcccggggccgcgaa

SEQ ID NO: 2886 - RNA, 23 nt, Artificial Sequence
  Synthetic
gggccccggcccggggccgcgaa

SEQ ID NO: 2887 - RNA, 24 nt, Artificial Sequence
  Synthetic
cgggccccggcccggggccgcgaa

SEQ ID NO: 2888 - RNA, 18 nt, Artificial Sequence
  Synthetic
ucggguggggcgcggaga

SEQ ID NO: 2889 - RNA, 19 nt, Artificial Sequence
  Synthetic
cucggguggggcgcggaga

SEQ ID NO: 2890 - RNA, 20 nt, Artificial Sequence
  Synthetic
ccucggguggggcgcggaga

SEQ ID NO: 2891 - RNA, 21 nt, Artificial Sequence
  Synthetic
cccucggguggggcgcggaga

SEQ ID NO: 2892 - RNA, 22 nt, Artificial Sequence
  Synthetic
gcccucggguggggcgcggaga

SEQ ID NO: 2893 - RNA, 23 nt, Artificial Sequence
  Synthetic
ggcccucggguggggcgcggaga

SEQ ID NO: 2894 - RNA, 24 nt, Artificial Sequence
  Synthetic
gggcccucggguggggcgcggaga

SEQ ID NO: 2895 - RNA, 18 nt, Artificial Sequence
  Synthetic
gagcccagaccgcgacga

SEQ ID NO: 2896 - RNA, 19 nt, Artificial Sequence
  Synthetic
cgagcccagaccgcgacga

SEQ ID NO: 2897 - RNA, 20 nt, Artificial Sequence
  Synthetic
ccgagcccagaccgcgacga

SEQ ID NO: 2898 - RNA, 21 nt, Artificial Sequence
  Synthetic
cccgagcccagaccgcgacga

SEQ ID NO: 2899 - RNA, 22 nt, Artificial Sequence
  Synthetic
ccccgagcccagaccgcgacga

SEQ ID NO: 2900 - RNA, 23 nt, Artificial Sequence
  Synthetic
accccgagcccagaccgcgacga

SEQ ID NO: 2901 - RNA, 24 nt, Artificial Sequence
  Synthetic
caccccgagcccagaccgcgacga

SEQ ID NO: 2902 - RNA, 18 nt, Artificial Sequence
  Synthetic
cccggcccggggccgcga

SEQ ID NO: 2903 - RNA, 19 nt, Artificial Sequence
  Synthetic
ccccggcccggggccgcga

SEQ ID NO: 2904 - RNA, 20 nt, Artificial Sequence
  Synthetic
gccccggcccggggccgcga

SEQ ID NO: 2905 - RNA, 21 nt, Artificial Sequence
  Synthetic
ggccccggcccggggccgcga

SEQ ID NO: 2906 - RNA, 22 nt, Artificial Sequence
  Synthetic
gggccccggcccggggccgcga

SEQ ID NO: 2907 - RNA, 23 nt, Artificial Sequence
  Synthetic
cgggccccggcccggggccgcga

SEQ ID NO: 2908 - RNA, 24 nt, Artificial Sequence
  Synthetic
ccgggccccggcccggggccgcga

SEQ ID NO: 2909 - RNA, 18 nt, Artificial Sequence
  Synthetic
agccgacgccgccggcga

SEQ ID NO: 2910 - RNA, 19 nt, Artificial Sequence
  Synthetic
cagccgacgccgccggcga

SEQ ID NO: 2911 - RNA, 20 nt, Artificial Sequence
  Synthetic
gcagccgacgccgccggcga

SEQ ID NO: 2912 - RNA, 21 nt, Artificial Sequence
  Synthetic
cgcagccgacgccgccggcga

SEQ ID NO: 2913 - RNA, 22 nt, Artificial Sequence
  Synthetic
acgcagccgacgccgccggcga

SEQ ID NO: 2914 - RNA, 23 nt, Artificial Sequence
  Synthetic
gacgcagccgacgccgccggcga

SEQ ID NO: 2915 - RNA, 24 nt, Artificial Sequence
  Synthetic
cgacgcagccgacgccgccggcga

SEQ ID NO: 2916 - RNA, 18 nt, Artificial Sequence
  Synthetic
cgacgacgcccggcggga

SEQ ID NO: 2917 - RNA, 19 nt, Artificial Sequence
  Synthetic
ucgacgacgcccggcggga

SEQ ID NO: 2918 - RNA, 20 nt, Artificial Sequence
  Synthetic
cucgacgacgcccggcggga

SEQ ID NO: 2919 - RNA, 21 nt, Artificial Sequence
  Synthetic
ccucgacgacgcccggcggga

SEQ ID NO: 2920 - RNA, 22 nt, Artificial Sequence
  Synthetic
accucgacgacgcccggcggga

SEQ ID NO: 2921 - RNA, 23 nt, Artificial Sequence
  Synthetic
gaccucgacgacgcccggcggga

SEQ ID NO: 2922 - RNA, 24 nt, Artificial Sequence
  Synthetic
cgaccucgacgacgcccggcggga

SEQ ID NO: 2923 - RNA, 18 nt, Artificial Sequence
  Synthetic
ucgagccgacgacgauga

SEQ ID NO: 2924 - RNA, 19 nt, Artificial Sequence
  Synthetic
uucgagccgacgacgauga

SEQ ID NO: 2925 - RNA, 20 nt, Artificial Sequence
  Synthetic
uuucgagccgacgacgauga

SEQ ID NO: 2926 - RNA, 21 nt, Artificial Sequence
  Synthetic
cuuucgagccgacgacgauga

SEQ ID NO: 2927 - RNA, 22 nt, Artificial Sequence
  Synthetic
ccuuucgagccgacgacgauga

SEQ ID NO: 2928 - RNA, 23 nt, Artificial Sequence
  Synthetic
gccuuucgagccgacgacgauga

SEQ ID NO: 2929 - RNA, 24 nt, Artificial Sequence
  Synthetic
cgccuuucgagccgacgacgauga

SEQ ID NO: 2930 - RNA, 18 nt, Artificial Sequence
  Synthetic
cugcuggccuccauggua

SEQ ID NO: 2931 - RNA, 19 nt, Artificial Sequence
  Synthetic
ucugcuggccuccauggua

SEQ ID NO: 2932 - RNA, 20 nt, Artificial Sequence
  Synthetic
cucugcuggccuccauggua

SEQ ID NO: 2933 - RNA, 21 nt, Artificial Sequence
  Synthetic
gcucugcuggccuccauggua

SEQ ID NO: 2934 - RNA, 22 nt, Artificial Sequence
  Synthetic
ggcucugcuggccuccauggua

SEQ ID NO: 2935 - RNA, 23 nt, Artificial Sequence
  Synthetic
uggcucugcuggccuccauggua

SEQ ID NO: 2936 - RNA, 24 nt, Artificial Sequence
  Synthetic
cuggcucugcuggccuccauggua

SEQ ID NO: 2937 - RNA, 18 nt, Artificial Sequence
  Synthetic
cggcccggggccgcgaac

SEQ ID NO: 2938 - RNA, 19 nt, Artificial Sequence
  Synthetic
ccggcccggggccgcgaac

SEQ ID NO: 2939 - RNA, 20 nt, Artificial Sequence
  Synthetic
cccggcccggggccgcgaac

SEQ ID NO: 2940 - RNA, 21 nt, Artificial Sequence
  Synthetic
ccccggcccggggccgcgaac

SEQ ID NO: 2941 - RNA, 22 nt, Artificial Sequence
  Synthetic
gccccggcccggggccgcgaac

SEQ ID NO: 2942 - RNA, 23 nt, Artificial Sequence
  Synthetic
ggccccggcccggggccgcgaac

SEQ ID NO: 2943 - RNA, 24 nt, Artificial Sequence
  Synthetic
gggccccggcccggggccgcgaac

SEQ ID NO: 2944 - RNA, 18 nt, Artificial Sequence
  Synthetic
gacgacgcccggcgggac

SEQ ID NO: 2945 - RNA, 19 nt, Artificial Sequence
  Synthetic
cgacgacgcccggcgggac

SEQ ID NO: 2946 - RNA, 20 nt, Artificial Sequence
  Synthetic
ucgacgacgcccggcgggac

SEQ ID NO: 2947 - RNA, 21 nt, Artificial Sequence
  Synthetic
cucgacgacgcccggcgggac

SEQ ID NO: 2948 - RNA, 22 nt, Artificial Sequence
  Synthetic
ccucgacgacgcccggcgggac

SEQ ID NO: 2949 - RNA, 23 nt, Artificial Sequence
  Synthetic
accucgacgacgcccggcgggac

SEQ ID NO: 2950 - RNA, 24 nt, Artificial Sequence
  Synthetic
gaccucgacgacgcccggcgggac

SEQ ID NO: 2951 - RNA, 18 nt, Artificial Sequence
  Synthetic
cgagccgacgacgaugac

SEQ ID NO: 2952 - RNA, 19 nt, Artificial Sequence
  Synthetic
ucgagccgacgacgaugac

SEQ ID NO: 2953 - RNA, 20 nt, Artificial Sequence
  Synthetic
uucgagccgacgacgaugac

SEQ ID NO: 2954 - RNA, 21 nt, Artificial Sequence
  Synthetic
uuucgagccgacgacgaugac

SEQ ID NO: 2955 - RNA, 22 nt, Artificial Sequence
  Synthetic
cuuucgagccgacgacgaugac

SEQ ID NO: 2956 - RNA, 23 nt, Artificial Sequence
  Synthetic
ccuuucgagccgacgacgaugac

SEQ ID NO: 2957 - RNA, 24 nt, Artificial Sequence
  Synthetic
gccuuucgagccgacgacgaugac

SEQ ID NO: 2958 - RNA, 18 nt, Artificial Sequence
  Synthetic
gacgggccgccgcccacc

SEQ ID NO: 2959 - RNA, 19 nt, Artificial Sequence
  Synthetic
cgacgggccgccgcccacc

SEQ ID NO: 2960 - RNA, 20 nt, Artificial Sequence
  Synthetic
ccgacgggccgccgcccacc

SEQ ID NO: 2961 - RNA, 21 nt, Artificial Sequence
  Synthetic
accgacgggccgccgcccacc

SEQ ID NO: 2962 - RNA, 22 nt, Artificial Sequence
  Synthetic
caccgacgggccgccgcccacc

SEQ ID NO: 2963 - RNA, 23 nt, Artificial Sequence
  Synthetic
ccaccgacgggccgccgcccacc

SEQ ID NO: 2964 - RNA, 24 nt, Artificial Sequence
  Synthetic
cccaccgacgggccgccgcccacc

SEQ ID NO: 2965 - RNA, 18 nt, Artificial Sequence
  Synthetic
ggcgcguauccggacccc

SEQ ID NO: 2966 - RNA, 19 nt, Artificial Sequence
  Synthetic
cggcgcguauccggacccc

SEQ ID NO: 2967 - RNA, 20 nt, Artificial Sequence
  Synthetic
gcggcgcguauccggacccc

SEQ ID NO: 2968 - RNA, 21 nt, Artificial Sequence
  Synthetic
cgcggcgcguauccggacccc

SEQ ID NO: 2969 - RNA, 22 nt, Artificial Sequence
  Synthetic
acgcggcgcguauccggacccc

SEQ ID NO: 2970 - RNA, 23 nt, Artificial Sequence
  Synthetic
uacgcggcgcguauccggacccc

SEQ ID NO: 2971 - RNA, 24 nt, Artificial Sequence
  Synthetic
cuacgcggcgcguauccggacccc

SEQ ID NO: 2972 - RNA, 18 nt, Artificial Sequence
  Synthetic
gacgccggcgaggacgcc

SEQ ID NO: 2973 - RNA, 19 nt, Artificial Sequence
  Synthetic
cgacgccggcgaggacgcc

SEQ ID NO: 2974 - RNA, 20 nt, Artificial Sequence
  Synthetic
ccgacgccggcgaggacgcc

SEQ ID NO: 2975 - RNA, 21 nt, Artificial Sequence
  Synthetic
accgacgccggcgaggacgcc

SEQ ID NO: 2976 - RNA, 22 nt, Artificial Sequence
  Synthetic
caccgacgccggcgaggacgcc

SEQ ID NO: 2977 - RNA, 23 nt, Artificial Sequence
  Synthetic
gcaccgacgccggcgaggacgcc

SEQ ID NO: 2978 - RNA, 24 nt, Artificial Sequence
  Synthetic
ggcaccgacgccggcgaggacgcc

SEQ ID NO: 2979 - RNA, 18 nt, Artificial Sequence
  Synthetic
cccgccggcccagccgcc

SEQ ID NO: 2980 - RNA, 19 nt, Artificial Sequence
  Synthetic
gcccgccggcccagccgcc

SEQ ID NO: 2981 - RNA, 20 nt, Artificial Sequence
  Synthetic
cgcccgccggcccagccgcc

SEQ ID NO: 2982 - RNA, 21 nt, Artificial Sequence
  Synthetic
gcgcccgccggcccagccgcc

SEQ ID NO: 2983 - RNA, 22 nt, Artificial Sequence
  Synthetic
cgcgcccgccggcccagccgcc

SEQ ID NO: 2984 - RNA, 23 nt, Artificial Sequence
  Synthetic
ccgcgcccgccggcccagccgcc

SEQ ID NO: 2985 - RNA, 24 nt, Artificial Sequence
  Synthetic
gccgcgcccgccggcccagccgcc

SEQ ID NO: 2986 - RNA, 18 nt, Artificial Sequence
  Synthetic
ccccgcggccucgccgcc

SEQ ID NO: 2987 - RNA, 19 nt, Artificial Sequence
  Synthetic
accccgcggccucgccgcc

SEQ ID NO: 2988 - RNA, 20 nt, Artificial Sequence
  Synthetic
gaccccgcggccucgccgcc

SEQ ID NO: 2989 - RNA, 21 nt, Artificial Sequence
  Synthetic
cgaccccgcggccucgccgcc

SEQ ID NO: 2990 - RNA, 22 nt, Artificial Sequence
  Synthetic
ccgaccccgcggccucgccgcc

SEQ ID NO: 2991 - RNA, 23 nt, Artificial Sequence
  Synthetic
cccgaccccgcggccucgccgcc

SEQ ID NO: 2992 - RNA, 24 nt, Artificial Sequence
  Synthetic
gcccgaccccgcggccucgccgcc

SEQ ID NO: 2993 - RNA, 18 nt, Artificial Sequence
  Synthetic
ggcgaccgggccccggcc

SEQ ID NO: 2994 - RNA, 19 nt, Artificial Sequence
  Synthetic
cggcgaccgggccccggcc

SEQ ID NO: 2995 - RNA, 20 nt, Artificial Sequence
  Synthetic
ccggcgaccgggccccggcc

SEQ ID NO: 2996 - RNA, 21 nt, Artificial Sequence
  Synthetic
gccggcgaccgggccccggcc

SEQ ID NO: 2997 - RNA, 22 nt, Artificial Sequence
  Synthetic
cgccggcgaccgggccccggcc

SEQ ID NO: 2998 - RNA, 23 nt, Artificial Sequence
  Synthetic
ccgccggcgaccgggccccggcc

SEQ ID NO: 2999 - RNA, 24 nt, Artificial Sequence
  Synthetic
gccgccggcgaccgggccccggcc

SEQ ID NO: 3000 - RNA, 18 nt, Artificial Sequence
  Synthetic
gggccccggcccggggcc

SEQ ID NO: 3001 - RNA, 19 nt, Artificial Sequence
  Synthetic
cgggccccggcccggggcc

SEQ ID NO: 3002 - RNA, 20 nt, Artificial Sequence
  Synthetic
ccgggccccggcccggggcc

SEQ ID NO: 3003 - RNA, 21 nt, Artificial Sequence
  Synthetic
accgggccccggcccggggcc

SEQ ID NO: 3004 - RNA, 22 nt, Artificial Sequence
  Synthetic
gaccgggccccggcccggggcc

SEQ ID NO: 3005 - RNA, 23 nt, Artificial Sequence
  Synthetic
cgaccgggccccggcccggggcc

SEQ ID NO: 3006 - RNA, 24 nt, Artificial Sequence
  Synthetic
gcgaccgggccccggcccggggcc

SEQ ID NO: 3007 - RNA, 18 nt, Artificial Sequence
  Synthetic
aagcagcgccccggcucc

SEQ ID NO: 3008 - RNA, 19 nt, Artificial Sequence
  Synthetic
caagcagcgccccggcucc

SEQ ID NO: 3009 - RNA, 20 nt, Artificial Sequence
  Synthetic
acaagcagcgccccggcucc

SEQ ID NO: 3010 - RNA, 21 nt, Artificial Sequence
  Synthetic
aacaagcagcgccccggcucc

SEQ ID NO: 3011 - RNA, 22 nt, Artificial Sequence
  Synthetic
gaacaagcagcgccccggcucc

SEQ ID NO: 3012 - RNA, 23 nt, Artificial Sequence
  Synthetic
agaacaagcagcgccccggcucc

SEQ ID NO: 3013 - RNA, 24 nt, Artificial Sequence
  Synthetic
gagaacaagcagcgccccggcucc

SEQ ID NO: 3014 - RNA, 18 nt, Artificial Sequence
  Synthetic
gcccagaccgcgacgagc

SEQ ID NO: 3015 - RNA, 19 nt, Artificial Sequence
  Synthetic
agcccagaccgcgacgagc

SEQ ID NO: 3016 - RNA, 20 nt, Artificial Sequence
  Synthetic
gagcccagaccgcgacgagc

SEQ ID NO: 3017 - RNA, 21 nt, Artificial Sequence
  Synthetic
cgagcccagaccgcgacgagc

SEQ ID NO: 3018 - RNA, 22 nt, Artificial Sequence
  Synthetic
ccgagcccagaccgcgacgagc

SEQ ID NO: 3019 - RNA, 23 nt, Artificial Sequence
  Synthetic
cccgagcccagaccgcgacgagc

SEQ ID NO: 3020 - RNA, 24 nt, Artificial Sequence
  Synthetic
ccccgagcccagaccgcgacgagc

SEQ ID NO: 3021 - RNA, 18 nt, Artificial Sequence
  Synthetic
cgacgccggcgaggacgc

SEQ ID NO: 3022 - RNA, 19 nt, Artificial Sequence
  Synthetic
ccgacgccggcgaggacgc

SEQ ID NO: 3023 - RNA, 20 nt, Artificial Sequence
  Synthetic
accgacgccggcgaggacgc

SEQ ID NO: 3024 - RNA, 21 nt, Artificial Sequence
  Synthetic
caccgacgccggcgaggacgc

SEQ ID NO: 3025 - RNA, 22 nt, Artificial Sequence
  Synthetic
gcaccgacgccggcgaggacgc

SEQ ID NO: 3026 - RNA, 23 nt, Artificial Sequence
  Synthetic
ggcaccgacgccggcgaggacgc

SEQ ID NO: 3027 - RNA, 24 nt, Artificial Sequence
  Synthetic
gggcaccgacgccggcgaggacgc

SEQ ID NO: 3028 - RNA, 18 nt, Artificial Sequence
  Synthetic
cggcgaccgggccccggc

SEQ ID NO: 3029 - RNA, 19 nt, Artificial Sequence
  Synthetic
ccggcgaccgggccccggc

SEQ ID NO: 3030 - RNA, 20 nt, Artificial Sequence
  Synthetic
gccggcgaccgggccccggc

SEQ ID NO: 3031 - RNA, 21 nt, Artificial Sequence
  Synthetic
cgccggcgaccgggccccggc

SEQ ID NO: 3032 - RNA, 22 nt, Artificial Sequence
  Synthetic
ccgccggcgaccgggccccggc

SEQ ID NO: 3033 - RNA, 23 nt, Artificial Sequence
  Synthetic
gccgccggcgaccgggccccggc

SEQ ID NO: 3034 - RNA, 24 nt, Artificial Sequence
  Synthetic
cgccgccggcgaccgggccccggc

SEQ ID NO: 3035 - RNA, 18 nt, Artificial Sequence
  Synthetic
gcgggcaccgacgccggc

SEQ ID NO: 3036 - RNA, 19 nt, Artificial Sequence
  Synthetic
ggcgggcaccgacgccggc

SEQ ID NO: 3037 - RNA, 20 nt, Artificial Sequence
  Synthetic
cggcgggcaccgacgccggc

SEQ ID NO: 3038 - RNA, 21 nt, Artificial Sequence
  Synthetic
gcggcgggcaccgacgccggc

SEQ ID NO: 3039 - RNA, 22 nt, Artificial Sequence
  Synthetic
cgcggcgggcaccgacgccggc

SEQ ID NO: 3040 - RNA, 23 nt, Artificial Sequence
  Synthetic
ccgcggcgggcaccgacgccggc

SEQ ID NO: 3041 - RNA, 24 nt, Artificial Sequence
  Synthetic
cccgcggcgggcaccgacgccggc

SEQ ID NO: 3042 - RNA, 18 nt, Artificial Sequence
  Synthetic
gcggagacggaggagggc

SEQ ID NO: 3043 - RNA, 19 nt, Artificial Sequence
  Synthetic
cgcggagacggaggagggc

SEQ ID NO: 3044 - RNA, 20 nt, Artificial Sequence
  Synthetic
gcgcggagacggaggagggc

SEQ ID NO: 3045 - RNA, 21 nt, Artificial Sequence
  Synthetic
ggcgcggagacggaggagggc

SEQ ID NO: 3046 - RNA, 22 nt, Artificial Sequence
  Synthetic
gggcgcggagacggaggagggc

SEQ ID NO: 3047 - RNA, 23 nt, Artificial Sequence
  Synthetic
ggggcgcggagacggaggagggc

SEQ ID NO: 3048 - RNA, 24 nt, Artificial Sequence
  Synthetic
uggggcgcggagacggaggagggc

SEQ ID NO: 3049 - RNA, 18 nt, Artificial Sequence
  Synthetic
ggggcccucggguggggc

SEQ ID NO: 3050 - RNA, 19 nt, Artificial Sequence
  Synthetic
gggggcccucggguggggc

SEQ ID NO: 3051 - RNA, 20 nt, Artificial Sequence
  Synthetic
ggggggcccucggguggggc

SEQ ID NO: 3052 - RNA, 21 nt, Artificial Sequence
  Synthetic
cggggggcccucggguggggc

SEQ ID NO: 3053 - RNA, 22 nt, Artificial Sequence
  Synthetic
gcggggggcccucggguggggc

SEQ ID NO: 3054 - RNA, 23 nt, Artificial Sequence
  Synthetic
agcggggggcccucggguggggc

SEQ ID NO: 3055 - RNA, 24 nt, Artificial Sequence
  Synthetic
gagcggggggcccucggguggggc

SEQ ID NO: 3056 - RNA, 18 nt, Artificial Sequence
  Synthetic
agcccagaccgcgacgag

SEQ ID NO: 3057 - RNA, 19 nt, Artificial Sequence
  Synthetic
gagcccagaccgcgacgag

SEQ ID NO: 3058 - RNA, 20 nt, Artificial Sequence
  Synthetic
cgagcccagaccgcgacgag

SEQ ID NO: 3059 - RNA, 21 nt, Artificial Sequence
  Synthetic
ccgagcccagaccgcgacgag

SEQ ID NO: 3060 - RNA, 22 nt, Artificial Sequence
  Synthetic
cccgagcccagaccgcgacgag

SEQ ID NO: 3061 - RNA, 23 nt, Artificial Sequence
  Synthetic
ccccgagcccagaccgcgacgag

SEQ ID NO: 3062 - RNA, 24 nt, Artificial Sequence
  Synthetic
accccgagcccagaccgcgacgag

SEQ ID NO: 3063 - RNA, 18 nt, Artificial Sequence
  Synthetic
uggggcgcggagacggag

SEQ ID NO: 3064 - RNA, 19 nt, Artificial Sequence
  Synthetic
guggggcgcggagacggag

SEQ ID NO: 3065 - RNA, 20 nt, Artificial Sequence
  Synthetic
gguggggcgcggagacggag

SEQ ID NO: 3066 - RNA, 21 nt, Artificial Sequence
  Synthetic
ggguggggcgcggagacggag

SEQ ID NO: 3067 - RNA, 22 nt, Artificial Sequence
  Synthetic
cggguggggcgcggagacggag

SEQ ID NO: 3068 - RNA, 23 nt, Artificial Sequence
  Synthetic
ucggguggggcgcggagacggag

SEQ ID NO: 3069 - RNA, 24 nt, Artificial Sequence
  Synthetic
cucggguggggcgcggagacggag

SEQ ID NO: 3070 - RNA, 18 nt, Artificial Sequence
  Synthetic
cucggguggggcgcggag

SEQ ID NO: 3071 - RNA, 19 nt, Artificial Sequence
  Synthetic
ccucggguggggcgcggag

SEQ ID NO: 3072 - RNA, 20 nt, Artificial Sequence
  Synthetic
cccucggguggggcgcggag

SEQ ID NO: 3073 - RNA, 21 nt, Artificial Sequence
  Synthetic
gcccucggguggggcgcggag

SEQ ID NO: 3074 - RNA, 22 nt, Artificial Sequence
  Synthetic
ggcccucggguggggcgcggag

SEQ ID NO: 3075 - RNA, 23 nt, Artificial Sequence
  Synthetic
gggcccucggguggggcgcggag

SEQ ID NO: 3076 - RNA, 24 nt, Artificial Sequence
  Synthetic
ggggcccucggguggggcgcggag

SEQ ID NO: 3077 - RNA, 18 nt, Artificial Sequence
  Synthetic
ugcuggccuccaugguag

SEQ ID NO: 3078 - RNA, 19 nt, Artificial Sequence
  Synthetic
cugcuggccuccaugguag

SEQ ID NO: 3079 - RNA, 20 nt, Artificial Sequence
  Synthetic
ucugcuggccuccaugguag

SEQ ID NO: 3080 - RNA, 21 nt, Artificial Sequence
  Synthetic
cucugcuggccuccaugguag

SEQ ID NO: 3081 - RNA, 22 nt, Artificial Sequence
  Synthetic
gcucugcuggccuccaugguag

SEQ ID NO: 3082 - RNA, 23 nt, Artificial Sequence
  Synthetic
ggcucugcuggccuccaugguag

SEQ ID NO: 3083 - RNA, 24 nt, Artificial Sequence
  Synthetic
uggcucugcuggccuccaugguag

SEQ ID NO: 3084 - RNA, 18 nt, Artificial Sequence
  Synthetic
ggguggggcgcggagacg

SEQ ID NO: 3085 - RNA, 19 nt, Artificial Sequence
  Synthetic
cggguggggcgcggagacg

SEQ ID NO: 3086 - RNA, 20 nt, Artificial Sequence
  Synthetic
ucggguggggcgcggagacg

SEQ ID NO: 3087 - RNA, 21 nt, Artificial Sequence
  Synthetic
cucggguggggcgcggagacg

SEQ ID NO: 3088 - RNA, 22 nt, Artificial Sequence
  Synthetic
ccucggguggggcgcggagacg

SEQ ID NO: 3089 - RNA, 23 nt, Artificial Sequence
  Synthetic
cccucggguggggcgcggagacg

SEQ ID NO: 3090 - RNA, 24 nt, Artificial Sequence
  Synthetic
gcccucggguggggcgcggagacg

SEQ ID NO: 3091 - RNA, 18 nt, Artificial Sequence
  Synthetic
ccgacgccggcgaggacg

SEQ ID NO: 3092 - RNA, 19 nt, Artificial Sequence
  Synthetic
accgacgccggcgaggacg

SEQ ID NO: 3093 - RNA, 20 nt, Artificial Sequence
  Synthetic
caccgacgccggcgaggacg

SEQ ID NO: 3094 - RNA, 21 nt, Artificial Sequence
  Synthetic
gcaccgacgccggcgaggacg

SEQ ID NO: 3095 - RNA, 22 nt, Artificial Sequence
  Synthetic
ggcaccgacgccggcgaggacg

SEQ ID NO: 3096 - RNA, 23 nt, Artificial Sequence
  Synthetic
gggcaccgacgccggcgaggacg

SEQ ID NO: 3097 - RNA, 24 nt, Artificial Sequence
  Synthetic
cgggcaccgacgccggcgaggacg

SEQ ID NO: 3098 - RNA, 18 nt, Artificial Sequence
  Synthetic
gcuccccgggccccaccg

SEQ ID NO: 3099 - RNA, 19 nt, Artificial Sequence
  Synthetic
ggcuccccgggccccaccg

SEQ ID NO: 3100 - RNA, 20 nt, Artificial Sequence
  Synthetic
cggcuccccgggccccaccg

SEQ ID NO: 3101 - RNA, 21 nt, Artificial Sequence
  Synthetic
ccggcuccccgggccccaccg

SEQ ID NO: 3102 - RNA, 22 nt, Artificial Sequence
  Synthetic
cccggcuccccgggccccaccg

SEQ ID NO: 3103 - RNA, 23 nt, Artificial Sequence
  Synthetic
ccccggcuccccgggccccaccg

SEQ ID NO: 3104 - RNA, 24 nt, Artificial Sequence
  Synthetic
gccccggcuccccgggccccaccg

SEQ ID NO: 3105 - RNA, 18 nt, Artificial Sequence
  Synthetic
cgaccucgacgacgcccg

SEQ ID NO: 3106 - RNA, 19 nt, Artificial Sequence
  Synthetic
acgaccucgacgacgcccg

SEQ ID NO: 3107 - RNA, 20 nt, Artificial Sequence
  Synthetic
cacgaccucgacgacgcccg

SEQ ID NO: 3108 - RNA, 21 nt, Artificial Sequence
  Synthetic
ccacgaccucgacgacgcccg

SEQ ID NO: 3109 - RNA, 22 nt, Artificial Sequence
  Synthetic
cccacgaccucgacgacgcccg

SEQ ID NO: 3110 - RNA, 23 nt, Artificial Sequence
  Synthetic
ccccacgaccucgacgacgcccg

SEQ ID NO: 3111 - RNA, 24 nt, Artificial Sequence
  Synthetic
cccccacgaccucgacgacgcccg

SEQ ID NO: 3112 - RNA, 18 nt, Artificial Sequence
  Synthetic
cggcgggcaccgacgccg

SEQ ID NO: 3113 - RNA, 19 nt, Artificial Sequence
  Synthetic
gcggcgggcaccgacgccg

SEQ ID NO: 3114 - RNA, 20 nt, Artificial Sequence
  Synthetic
cgcggcgggcaccgacgccg

SEQ ID NO: 3115 - RNA, 21 nt, Artificial Sequence
  Synthetic
ccgcggcgggcaccgacgccg

SEQ ID NO: 3116 - RNA, 22 nt, Artificial Sequence
  Synthetic
cccgcggcgggcaccgacgccg

SEQ ID NO: 3117 - RNA, 23 nt, Artificial Sequence
  Synthetic
ccccgcggcgggcaccgacgccg

SEQ ID NO: 3118 - RNA, 24 nt, Artificial Sequence
  Synthetic
cccccgcggcgggcaccgacgccg

SEQ ID NO: 3119 - RNA, 18 nt, Artificial Sequence
  Synthetic
ccgccggcccagccgccg

SEQ ID NO: 3120 - RNA, 19 nt, Artificial Sequence
  Synthetic
cccgccggcccagccgccg

SEQ ID NO: 3121 - RNA, 20 nt, Artificial Sequence
  Synthetic
gcccgccggcccagccgccg

SEQ ID NO: 3122 - RNA, 21 nt, Artificial Sequence
  Synthetic
cgcccgccggcccagccgccg

SEQ ID NO: 3123 - RNA, 22 nt, Artificial Sequence
  Synthetic
gcgcccgccggcccagccgccg

SEQ ID NO: 3124 - RNA, 23 nt, Artificial Sequence
  Synthetic
cgcgcccgccggcccagccgccg

SEQ ID NO: 3125 - RNA, 24 nt, Artificial Sequence
  Synthetic
ccgcgcccgccggcccagccgccg

SEQ ID NO: 3126 - RNA, 18 nt, Artificial Sequence
  Synthetic
cccagaccgcgacgagcg

SEQ ID NO: 3127 - RNA, 19 nt, Artificial Sequence
  Synthetic
gcccagaccgcgacgagcg

SEQ ID NO: 3128 - RNA, 20 nt, Artificial Sequence
  Synthetic
agcccagaccgcgacgagcg

SEQ ID NO: 3129 - RNA, 21 nt, Artificial Sequence
  Synthetic
gagcccagaccgcgacgagcg

SEQ ID NO: 3130 - RNA, 22 nt, Artificial Sequence
  Synthetic
cgagcccagaccgcgacgagcg

SEQ ID NO: 3131 - RNA, 23 nt, Artificial Sequence
  Synthetic
ccgagcccagaccgcgacgagcg

SEQ ID NO: 3132 - RNA, 24 nt, Artificial Sequence
  Synthetic
cccgagcccagaccgcgacgagcg

SEQ ID NO: 3133 - RNA, 18 nt, Artificial Sequence
  Synthetic
ccccgagcccagaccgcg

SEQ ID NO: 3134 - RNA, 19 nt, Artificial Sequence
  Synthetic
accccgagcccagaccgcg

SEQ ID NO: 3135 - RNA, 20 nt, Artificial Sequence
  Synthetic
caccccgagcccagaccgcg

SEQ ID NO: 3136 - RNA, 21 nt, Artificial Sequence
  Synthetic
ccaccccgagcccagaccgcg

SEQ ID NO: 3137 - RNA, 22 nt, Artificial Sequence
  Synthetic
cccaccccgagcccagaccgcg

SEQ ID NO: 3138 - RNA, 23 nt, Artificial Sequence
  Synthetic
gcccaccccgagcccagaccgcg

SEQ ID NO: 3139 - RNA, 24 nt, Artificial Sequence
  Synthetic
cgcccaccccgagcccagaccgcg

SEQ ID NO: 3140 - RNA, 18 nt, Artificial Sequence
  Synthetic
gacgggagggcccccgcg

SEQ ID NO: 3141 - RNA, 19 nt, Artificial Sequence
  Synthetic
ggacgggagggcccccgcg

SEQ ID NO: 3142 - RNA, 20 nt, Artificial Sequence
  Synthetic
gggacgggagggcccccgcg

SEQ ID NO: 3143 - RNA, 21 nt, Artificial Sequence
  Synthetic
cgggacgggagggcccccgcg

SEQ ID NO: 3144 - RNA, 22 nt, Artificial Sequence
  Synthetic
gcgggacgggagggcccccgcg

SEQ ID NO: 3145 - RNA, 23 nt, Artificial Sequence
  Synthetic
ggcgggacgggagggcccccgcg

SEQ ID NO: 3146 - RNA, 24 nt, Artificial Sequence
  Synthetic
cggcgggacgggagggcccccgcg

SEQ ID NO: 3147 - RNA, 18 nt, Artificial Sequence
  Synthetic
gggcccucggguggggcg

SEQ ID NO: 3148 - RNA, 19 nt, Artificial Sequence
  Synthetic
ggggcccucggguggggcg

SEQ ID NO: 3149 - RNA, 20 nt, Artificial Sequence
  Synthetic
gggggcccucggguggggcg

SEQ ID NO: 3150 - RNA, 21 nt, Artificial Sequence
  Synthetic
ggggggcccucggguggggcg

SEQ ID NO: 3151 - RNA, 22 nt, Artificial Sequence
  Synthetic
cggggggcccucggguggggcg

SEQ ID NO: 3152 - RNA, 23 nt, Artificial Sequence
  Synthetic
gcggggggcccucggguggggcg

SEQ ID NO: 3153 - RNA, 24 nt, Artificial Sequence
  Synthetic
agcggggggcccucggguggggcg

SEQ ID NO: 3154 - RNA, 18 nt, Artificial Sequence
  Synthetic
gcgcggagacggaggagg

SEQ ID NO: 3155 - RNA, 19 nt, Artificial Sequence
  Synthetic
ggcgcggagacggaggagg

SEQ ID NO: 3156 - RNA, 20 nt, Artificial Sequence
  Synthetic
gggcgcggagacggaggagg

SEQ ID NO: 3157 - RNA, 21 nt, Artificial Sequence
  Synthetic
ggggcgcggagacggaggagg

SEQ ID NO: 3158 - RNA, 22 nt, Artificial Sequence
  Synthetic
uggggcgcggagacggaggagg

SEQ ID NO: 3159 - RNA, 23 nt, Artificial Sequence
  Synthetic
guggggcgcggagacggaggagg

SEQ ID NO: 3160 - RNA, 24 nt, Artificial Sequence
  Synthetic
gguggggcgcggagacggaggagg

SEQ ID NO: 3161 - RNA, 18 nt, Artificial Sequence
  Synthetic
gguggggcgcggagacgg

SEQ ID NO: 3162 - RNA, 19 nt, Artificial Sequence
  Synthetic
ggguggggcgcggagacgg

SEQ ID NO: 3163 - RNA, 20 nt, Artificial Sequence
  Synthetic
cggguggggcgcggagacgg

SEQ ID NO: 3164 - RNA, 21 nt, Artificial Sequence
  Synthetic
ucggguggggcgcggagacgg

SEQ ID NO: 3165 - RNA, 22 nt, Artificial Sequence
  Synthetic
cucggguggggcgcggagacgg

SEQ ID NO: 3166 - RNA, 23 nt, Artificial Sequence
  Synthetic
ccucggguggggcgcggagacgg

SEQ ID NO: 3167 - RNA, 24 nt, Artificial Sequence
  Synthetic
cccucggguggggcgcggagacgg

SEQ ID NO: 3168 - RNA, 18 nt, Artificial Sequence
  Synthetic
cgacgcccggcgggacgg

SEQ ID NO: 3169 - RNA, 19 nt, Artificial Sequence
  Synthetic
acgacgcccggcgggacgg

SEQ ID NO: 3170 - RNA, 20 nt, Artificial Sequence
  Synthetic
gacgacgcccggcgggacgg

SEQ ID NO: 3171 - RNA, 21 nt, Artificial Sequence
  Synthetic
cgacgacgcccggcgggacgg

SEQ ID NO: 3172 - RNA, 22 nt, Artificial Sequence
  Synthetic
ucgacgacgcccggcgggacgg

SEQ ID NO: 3173 - RNA, 23 nt, Artificial Sequence
  Synthetic
cucgacgacgcccggcgggacgg

SEQ ID NO: 3174 - RNA, 24 nt, Artificial Sequence
  Synthetic
ccucgacgacgcccggcgggacgg

SEQ ID NO: 3175 - RNA, 18 nt, Artificial Sequence
  Synthetic
gaccucgacgacgcccgg

SEQ ID NO: 3176 - RNA, 19 nt, Artificial Sequence
  Synthetic
cgaccucgacgacgcccgg

SEQ ID NO: 3177 - RNA, 20 nt, Artificial Sequence
  Synthetic
acgaccucgacgacgcccgg

SEQ ID NO: 3178 - RNA, 21 nt, Artificial Sequence
  Synthetic
cacgaccucgacgacgcccgg

SEQ ID NO: 3179 - RNA, 22 nt, Artificial Sequence
  Synthetic
ccacgaccucgacgacgcccgg

SEQ ID NO: 3180 - RNA, 23 nt, Artificial Sequence
  Synthetic
cccacgaccucgacgacgcccgg

SEQ ID NO: 3181 - RNA, 24 nt, Artificial Sequence
  Synthetic
ccccacgaccucgacgacgcccgg

SEQ ID NO: 3182 - RNA, 18 nt, Artificial Sequence
  Synthetic
cgagcggggggcccucgg

SEQ ID NO: 3183 - RNA, 19 nt, Artificial Sequence
  Synthetic
acgagcggggggcccucgg

SEQ ID NO: 3184 - RNA, 20 nt, Artificial Sequence
  Synthetic
gacgagcggggggcccucgg

SEQ ID NO: 3185 - RNA, 21 nt, Artificial Sequence
  Synthetic
cgacgagcggggggcccucgg

SEQ ID NO: 3186 - RNA, 22 nt, Artificial Sequence
  Synthetic
gcgacgagcggggggcccucgg

SEQ ID NO: 3187 - RNA, 23 nt, Artificial Sequence
  Synthetic
cgcgacgagcggggggcccucgg

SEQ ID NO: 3188 - RNA, 24 nt, Artificial Sequence
  Synthetic
ccgcgacgagcggggggcccucgg

SEQ ID NO: 3189 - RNA, 18 nt, Artificial Sequence
  Synthetic
cgcggagacggaggaggg

SEQ ID NO: 3190 - RNA, 19 nt, Artificial Sequence
  Synthetic
gcgcggagacggaggaggg

SEQ ID NO: 3191 - RNA, 20 nt, Artificial Sequence
  Synthetic
ggcgcggagacggaggaggg

SEQ ID NO: 3192 - RNA, 21 nt, Artificial Sequence
  Synthetic
gggcgcggagacggaggaggg

SEQ ID NO: 3193 - RNA, 22 nt, Artificial Sequence
  Synthetic
ggggcgcggagacggaggaggg

SEQ ID NO: 3194 - RNA, 23 nt, Artificial Sequence
  Synthetic
uggggcgcggagacggaggaggg

SEQ ID NO: 3195 - RNA, 24 nt, Artificial Sequence
  Synthetic
guggggcgcggagacggaggaggg

SEQ ID NO: 3196 - RNA, 18 nt, Artificial Sequence
  Synthetic
ucgacgacgcccggcggg

SEQ ID NO: 3197 - RNA, 19 nt, Artificial Sequence
  Synthetic
cucgacgacgcccggcggg

SEQ ID NO: 3198 - RNA, 20 nt, Artificial Sequence
  Synthetic
ccucgacgacgcccggcggg

SEQ ID NO: 3199 - RNA, 21 nt, Artificial Sequence
  Synthetic
accucgacgacgcccggcggg

SEQ ID NO: 3200 - RNA, 22 nt, Artificial Sequence
  Synthetic
gaccucgacgacgcccggcggg

SEQ ID NO: 3201 - RNA, 23 nt, Artificial Sequence
  Synthetic
cgaccucgacgacgcccggcggg

SEQ ID NO: 3202 - RNA, 24 nt, Artificial Sequence
  Synthetic
acgaccucgacgacgcccggcggg

SEQ ID NO: 3203 - RNA, 18 nt, Artificial Sequence
  Synthetic
gagcggggggcccucggg

SEQ ID NO: 3204 - RNA, 19 nt, Artificial Sequence
  Synthetic
cgagcggggggcccucggg

SEQ ID NO: 3205 - RNA, 20 nt, Artificial Sequence
  Synthetic
acgagcggggggcccucggg

SEQ ID NO: 3206 - RNA, 21 nt, Artificial Sequence
  Synthetic
gacgagcggggggcccucggg

SEQ ID NO: 3207 - RNA, 22 nt, Artificial Sequence
  Synthetic
cgacgagcggggggcccucggg

SEQ ID NO: 3208 - RNA, 23 nt, Artificial Sequence
  Synthetic
gcgacgagcggggggcccucggg

SEQ ID NO: 3209 - RNA, 24 nt, Artificial Sequence
  Synthetic
cgcgacgagcggggggcccucggg

SEQ ID NO: 3210 - RNA, 18 nt, Artificial Sequence
  Synthetic
cucugcuggccuccaugg

SEQ ID NO: 3211 - RNA, 19 nt, Artificial Sequence
  Synthetic
gcucugcuggccuccaugg

SEQ ID NO: 3212 - RNA, 20 nt, Artificial Sequence
  Synthetic
ggcucugcuggccuccaugg

SEQ ID NO: 3213 - RNA, 21 nt, Artificial Sequence
  Synthetic
uggcucugcuggccuccaugg

SEQ ID NO: 3214 - RNA, 22 nt, Artificial Sequence
  Synthetic
cuggcucugcuggccuccaugg

SEQ ID NO: 3215 - RNA, 23 nt, Artificial Sequence
  Synthetic
gcuggcucugcuggccuccaugg

SEQ ID NO: 3216 - RNA, 24 nt, Artificial Sequence
  Synthetic
agcuggcucugcuggccuccaugg

SEQ ID NO: 3217 - RNA, 18 nt, Artificial Sequence
  Synthetic
uucgagccgacgacgaug

SEQ ID NO: 3218 - RNA, 19 nt, Artificial Sequence
  Synthetic
uuucgagccgacgacgaug

SEQ ID NO: 3219 - RNA, 20 nt, Artificial Sequence
  Synthetic
cuuucgagccgacgacgaug

SEQ ID NO: 3220 - RNA, 21 nt, Artificial Sequence
  Synthetic
ccuuucgagccgacgacgaug

SEQ ID NO: 3221 - RNA, 22 nt, Artificial Sequence
  Synthetic
gccuuucgagccgacgacgaug

SEQ ID NO: 3222 - RNA, 23 nt, Artificial Sequence
  Synthetic
cgccuuucgagccgacgacgaug

SEQ ID NO: 3223 - RNA, 24 nt, Artificial Sequence
  Synthetic
ccgccuuucgagccgacgacgaug

SEQ ID NO: 3224 - RNA, 18 nt, Artificial Sequence
  Synthetic
ccgcuacgcggcgcguau

SEQ ID NO: 3225 - RNA, 19 nt, Artificial Sequence
  Synthetic
cccgcuacgcggcgcguau

SEQ ID NO: 3226 - RNA, 20 nt, Artificial Sequence
  Synthetic
ccccgcuacgcggcgcguau

SEQ ID NO: 3227 - RNA, 21 nt, Artificial Sequence
  Synthetic
gccccgcuacgcggcgcguau

SEQ ID NO: 3228 - RNA, 22 nt, Artificial Sequence
  Synthetic
ggccccgcuacgcggcgcguau

SEQ ID NO: 3229 - RNA, 23 nt, Artificial Sequence
  Synthetic
aggccccgcuacgcggcgcguau

SEQ ID NO: 3230 - RNA, 24 nt, Artificial Sequence
  Synthetic
gaggccccgcuacgcggcgcguau

SEQ ID NO: 3231 - RNA, 18 nt, Artificial Sequence
  Synthetic
caugguagaggaggccgu

SEQ ID NO: 3232 - RNA, 19 nt, Artificial Sequence
  Synthetic
ccaugguagaggaggccgu

SEQ ID NO: 3233 - RNA, 20 nt, Artificial Sequence
  Synthetic
uccaugguagaggaggccgu

SEQ ID NO: 3234 - RNA, 21 nt, Artificial Sequence
  Synthetic
cuccaugguagaggaggccgu

SEQ ID NO: 3235 - RNA, 22 nt, Artificial Sequence
  Synthetic
ccuccaugguagaggaggccgu

SEQ ID NO: 3236 - RNA, 23 nt, Artificial Sequence
  Synthetic
gccuccaugguagaggaggccgu

SEQ ID NO: 3237 - RNA, 24 nt, Artificial Sequence
  Synthetic
ggccuccaugguagaggaggccgu

SEQ ID NO: 3238 - RNA, 18 nt, Artificial Sequence
  Synthetic
gccccggacccccgccuu

SEQ ID NO: 3239 - RNA, 19 nt, Artificial Sequence
  Synthetic
cgccccggacccccgccuu

SEQ ID NO: 3240 - RNA, 20 nt, Artificial Sequence
  Synthetic
ccgccccggacccccgccuu

SEQ ID NO: 3241 - RNA, 21 nt, Artificial Sequence
  Synthetic
gccgccccggacccccgccuu

SEQ ID NO: 3242 - RNA, 22 nt, Artificial Sequence
  Synthetic
cgccgccccggacccccgccuu

SEQ ID NO: 3243 - RNA, 23 nt, Artificial Sequence
  Synthetic
ucgccgccccggacccccgccuu

SEQ ID NO: 3244 - RNA, 24 nt, Artificial Sequence
  Synthetic
cucgccgccccggacccccgccuu

SEQ ID NO: 3245 - RNA, 19 nt, Artificial Sequence
  Synthetic
gucggacgacgaggacgaa

SEQ ID NO: 3246 - RNA, 18 nt, Artificial Sequence
  Synthetic
gccaggggacggggaaca

SEQ ID NO: 3247 - RNA, 21 nt, Artificial Sequence
  Synthetic
gucgccaggggacggggaaca

SEQ ID NO: 3248 - RNA, 22 nt, Artificial Sequence
  Synthetic
ggucgccaggggacggggaaca

SEQ ID NO: 3249 - RNA, 18 nt, Artificial Sequence
  Synthetic
gccgccgccagccgccca

SEQ ID NO: 3250 - RNA, 21 nt, Artificial Sequence
  Synthetic
gcugccgccgccagccgccca

SEQ ID NO: 3251 - RNA, 22 nt, Artificial Sequence
  Synthetic
ggcugccgccgccagccgccca

SEQ ID NO: 3252 - RNA, 23 nt, Artificial Sequence
  Synthetic
gggcugccgccgccagccgccca

SEQ ID NO: 3253 - RNA, 24 nt, Artificial Sequence
  Synthetic
ggggcugccgccgccagccgccca

SEQ ID NO: 3254 - RNA, 18 nt, Artificial Sequence
  Synthetic
gcccguggccgaggccca

SEQ ID NO: 3255 - RNA, 19 nt, Artificial Sequence
  Synthetic
ggcccguggccgaggccca

SEQ ID NO: 3256 - RNA, 21 nt, Artificial Sequence
  Synthetic
gcggcccguggccgaggccca

SEQ ID NO: 3257 - RNA, 24 nt, Artificial Sequence
  Synthetic
gcugcggcccguggccgaggccca

SEQ ID NO: 3258 - RNA, 19 nt, Artificial Sequence
  Synthetic
gacgacgaggacgaggacc

SEQ ID NO: 3259 - RNA, 20 nt, Artificial Sequence
  Synthetic
ggacgacgaggacgaggacc

SEQ ID NO: 3260 - RNA, 22 nt, Artificial Sequence
  Synthetic
gcggacgacgaggacgaggacc

SEQ ID NO: 3261 - RNA, 19 nt, Artificial Sequence
  Synthetic
gcgaucgaggccagggccc

SEQ ID NO: 3262 - RNA, 20 nt, Artificial Sequence
  Synthetic
ggcgaucgaggccagggccc

SEQ ID NO: 3263 - RNA, 22 nt, Artificial Sequence
  Synthetic
gcggcgaucgaggccagggccc

SEQ ID NO: 3264 - RNA, 24 nt, Artificial Sequence
  Synthetic
gcgcggcgaucgaggccagggccc

SEQ ID NO: 3265 - RNA, 18 nt, Artificial Sequence
  Synthetic
ggcggggaagcggggccc

SEQ ID NO: 3266 - RNA, 20 nt, Artificial Sequence
  Synthetic
gcggcggggaagcggggccc

SEQ ID NO: 3267 - RNA, 21 nt, Artificial Sequence
  Synthetic
ggcggcggggaagcggggccc

SEQ ID NO: 3268 - RNA, 23 nt, Artificial Sequence
  Synthetic
gcggcggcggggaagcggggccc

SEQ ID NO: 3269 - RNA, 24 nt, Artificial Sequence
  Synthetic
ggcggcggcggggaagcggggccc

SEQ ID NO: 3270 - RNA, 22 nt, Artificial Sequence
  Synthetic
gccacguccccggggaccacgc

SEQ ID NO: 3271 - RNA, 24 nt, Artificial Sequence
  Synthetic
gcgccacguccccggggaccacgc

SEQ ID NO: 3272 - RNA, 18 nt, Artificial Sequence
  Synthetic
gcggcccgcggaggccgc

SEQ ID NO: 3273 - RNA, 21 nt, Artificial Sequence
  Synthetic
gaugcggcccgcggaggccgc

SEQ ID NO: 3274 - RNA, 19 nt, Artificial Sequence
  Synthetic
gccgcggagcucggcaggc

SEQ ID NO: 3275 - RNA, 20 nt, Artificial Sequence
  Synthetic
ggccgcggagcucggcaggc

SEQ ID NO: 3276 - RNA, 22 nt, Artificial Sequence
  Synthetic
gcggccgcggagcucggcaggc

SEQ ID NO: 3277 - RNA, 23 nt, Artificial Sequence
  Synthetic
ggcggccgcggagcucggcaggc

SEQ ID NO: 3278 - RNA, 20 nt, Artificial Sequence
  Synthetic
gacagccgccccagggcggc

SEQ ID NO: 3279 - RNA, 21 nt, Artificial Sequence
  Synthetic
ggacagccgccccagggcggc

SEQ ID NO: 3280 - RNA, 23 nt, Artificial Sequence
  Synthetic
gcggacagccgccccagggcggc

SEQ ID NO: 3281 - RNA, 24 nt, Artificial Sequence
  Synthetic
ggcggacagccgccccagggcggc

SEQ ID NO: 3282 - RNA, 18 nt, Artificial Sequence
  Synthetic
gcccucggccagcgccuc

SEQ ID NO: 3283 - RNA, 21 nt, Artificial Sequence
  Synthetic
gaagcccucggccagcgccuc

SEQ ID NO: 3284 - RNA, 24 nt, Artificial Sequence
  Synthetic
gucgaagcccucggccagcgccuc

SEQ ID NO: 3285 - RNA, 22 nt, Artificial Sequence
  Synthetic
gccaccccauggccuccgcguc

SEQ ID NO: 3286 - RNA, 24 nt, Artificial Sequence
  Synthetic
gagccaccccauggccuccgcguc

SEQ ID NO: 3287 - RNA, 18 nt, Artificial Sequence
  Synthetic
gcgcacguccucgggguc

SEQ ID NO: 3288 - RNA, 19 nt, Artificial Sequence
  Synthetic
gccgcucuucuucgucuuc

SEQ ID NO: 3289 - RNA, 21 nt, Artificial Sequence
  Synthetic
gcgccgcucuucuucgucuuc

SEQ ID NO: 3290 - RNA, 18 nt, Artificial Sequence
  Synthetic
gguccucgcccggcagcg

SEQ ID NO: 3291 - RNA, 22 nt, Artificial Sequence
  Synthetic
gccagguccucgcccggcagcg

SEQ ID NO: 3292 - RNA, 23 nt, Artificial Sequence
  Synthetic
ggccagguccucgcccggcagcg

SEQ ID NO: 3293 - RNA, 18 nt, Artificial Sequence
  Synthetic
ggcgcggccucggagagg

SEQ ID NO: 3294 - RNA, 19 nt, Artificial Sequence
  Synthetic
gggcgcggccucggagagg

SEQ ID NO: 3295 - RNA, 23 nt, Artificial Sequence
  Synthetic
gcuugggcgcggccucggagagg

SEQ ID NO: 3296 - RNA, 24 nt, Artificial Sequence
  Synthetic
ggcuugggcgcggccucggagagg

SEQ ID NO: 3297 - RNA, 21 nt, Artificial Sequence
  Synthetic
gcaccaccacgcgcacguccu

SEQ ID NO: 3298 - RNA, 18 nt, Artificial Sequence
  Synthetic
ggcccccggcggccccgu

SEQ ID NO: 3299 - RNA, 20 nt, Artificial Sequence
  Synthetic
gcggcccccggcggccccgu

SEQ ID NO: 3300 - RNA, 21 nt, Artificial Sequence
  Synthetic
ggcggcccccggcggccccgu

SEQ ID NO: 3301 - RNA, 23 nt, Artificial Sequence
  Synthetic
gaggcggcccccggcggccccgu

SEQ ID NO: 3302 - RNA, 18 nt, Artificial Sequence
  Synthetic
ggcgcagcggcggcgcgu

SEQ ID NO: 3303 - RNA, 23 nt, Artificial Sequence
  Synthetic
gcacaggcgcagcggcggcgcgu

SEQ ID NO: 3304 - RNA, 24 nt, Artificial Sequence
  Synthetic
ggcacaggcgcagcggcggcgcgu

SEQ ID NO: 3305 - RNA, 23 nt, Artificial Sequence
  Synthetic
gccccagcgcgcgcaggcggcgu

SEQ ID NO: 3306 - RNA, 24 nt, Artificial Sequence
  Synthetic
ggccccagcgcgcgcaggcggcgu

SEQ ID NO: 3307 - RNA, 20 nt, Artificial Sequence
  Synthetic
gucggcguggcgggcggcgu

SEQ ID NO: 3308 - RNA, 22 nt, Artificial Sequence
  Synthetic
gcgucggcguggcgggcggcgu

SEQ ID NO: 3309 - RNA, 23 nt, Artificial Sequence
  Synthetic
ggcgucggcguggcgggcggcgu

SEQ ID NO: 3310 - RNA, 23 nt, Artificial Sequence
  Synthetic
gcccccggcggccccgugggggu

SEQ ID NO: 3311 - RNA, 24 nt, Artificial Sequence
  Synthetic
ggcccccggcggccccgugggggu

SEQ ID NO: 3312 - RNA, 23 nt, Artificial Sequence
  Synthetic
guacaccccggacgcggaggcca

SEQ ID NO: 3313 - RNA, 19 nt, Artificial Sequence
  Synthetic
gcgccggcgcagaugacga

SEQ ID NO: 3314 - RNA, 20 nt, Artificial Sequence
  Synthetic
ggcgccggcgcagaugacga

SEQ ID NO: 3315 - RNA, 19 nt, Artificial Sequence
  Synthetic
gcggcgcguucgaggggga

SEQ ID NO: 3316 - RNA, 20 nt, Artificial Sequence
  Synthetic
ggcggcgcguucgaggggga

SEQ ID NO: 3317 - RNA, 23 nt, Artificial Sequence
  Synthetic
gacggcggcgcguucgaggggga

SEQ ID NO: 3318 - RNA, 18 nt, Artificial Sequence
  Synthetic
gggccgcguguucggccc

SEQ ID NO: 3319 - RNA, 23 nt, Artificial Sequence
  Synthetic
gccucgggccgcguguucggccc

SEQ ID NO: 3320 - RNA, 24 nt, Artificial Sequence
  Synthetic
ggccucgggccgcguguucggccc

SEQ ID NO: 3321 - RNA, 20 nt, Artificial Sequence
  Synthetic
gcccugccgccggcgccgcc

SEQ ID NO: 3322 - RNA, 21 nt, Artificial Sequence
  Synthetic
ggcccugccgccggcgccgcc

SEQ ID NO: 3323 - RNA, 22 nt, Artificial Sequence
  Synthetic
gggcccugccgccggcgccgcc

SEQ ID NO: 3324 - RNA, 23 nt, Artificial Sequence
  Synthetic
ggggcccugccgccggcgccgcc

SEQ ID NO: 3325 - RNA, 24 nt, Artificial Sequence
  Synthetic
gggggcccugccgccggcgccgcc

SEQ ID NO: 3326 - RNA, 20 nt, Artificial Sequence
  Synthetic
gccggugcccauguccccgc

SEQ ID NO: 3327 - RNA, 21 nt, Artificial Sequence
  Synthetic
gcccgccggguacggcgccgc

SEQ ID NO: 3328 - RNA, 23 nt, Artificial Sequence
  Synthetic
gugcccgccggguacggcgccgc

SEQ ID NO: 3329 - RNA, 24 nt, Artificial Sequence
  Synthetic
ggugcccgccggguacggcgccgc

SEQ ID NO: 3330 - RNA, 18 nt, Artificial Sequence
  Synthetic
gggccucgggggggccgc

SEQ ID NO: 3331 - RNA, 19 nt, Artificial Sequence
  Synthetic
ggggccucgggggggccgc

SEQ ID NO: 3332 - RNA, 21 nt, Artificial Sequence
  Synthetic
gcggggccucgggggggccgc

SEQ ID NO: 3333 - RNA, 22 nt, Artificial Sequence
  Synthetic
ggcggggccucgggggggccgc

SEQ ID NO: 3334 - RNA, 24 nt, Artificial Sequence
  Synthetic
gcggcggggccucgggggggccgc

SEQ ID NO: 3335 - RNA, 19 nt, Artificial Sequence
  Synthetic
gcgggaggggcgcaagcgc

SEQ ID NO: 3336 - RNA, 22 nt, Artificial Sequence
  Synthetic
gccgcgggaggggcgcaagcgc

SEQ ID NO: 3337 - RNA, 24 nt, Artificial Sequence
  Synthetic
gcgccgcgggaggggcgcaagcgc

SEQ ID NO: 3338 - RNA, 18 nt, Artificial Sequence
  Synthetic
gcugcgccgcauggcggc

SEQ ID NO: 3339 - RNA, 22 nt, Artificial Sequence
  Synthetic
gcccgcugcgccgcauggcggc

SEQ ID NO: 3340 - RNA, 23 nt, Artificial Sequence
  Synthetic
ggcccgcugcgccgcauggcggc

SEQ ID NO: 3341 - RNA, 24 nt, Artificial Sequence
  Synthetic
gggcccgcugcgccgcauggcggc

SEQ ID NO: 3342 - RNA, 22 nt, Artificial Sequence
  Synthetic
gcuucacggccgggcagccccg

SEQ ID NO: 3343 - RNA, 18 nt, Artificial Sequence
  Synthetic
gcgagcgcgcggugcccg

SEQ ID NO: 3344 - RNA, 19 nt, Artificial Sequence
  Synthetic
ggcgagcgcgcggugcccg

SEQ ID NO: 3345 - RNA, 20 nt, Artificial Sequence
  Synthetic
gggcgagcgcgcggugcccg

SEQ ID NO: 3346 - RNA, 22 nt, Artificial Sequence
  Synthetic
gaccuggccuucgccggggccg

SEQ ID NO: 3347 - RNA, 23 nt, Artificial Sequence
  Synthetic
ggaccuggccuucgccggggccg

SEQ ID NO: 3348 - RNA, 24 nt, Artificial Sequence
  Synthetic
gggaccuggccuucgccggggccg

SEQ ID NO: 3349 - RNA, 22 nt, Artificial Sequence
  Synthetic
gcccaggccggccgcguggccg

SEQ ID NO: 3350 - RNA, 24 nt, Artificial Sequence
  Synthetic
gcgcccaggccggccgcguggccg

SEQ ID NO: 3351 - RNA, 18 nt, Artificial Sequence
  Synthetic
gugccuggccgccugccg

SEQ ID NO: 3352 - RNA, 20 nt, Artificial Sequence
  Synthetic
gagugccuggccgccugccg

SEQ ID NO: 3353 - RNA, 23 nt, Artificial Sequence
  Synthetic
gucgagugccuggccgccugccg

SEQ ID NO: 3354 - RNA, 22 nt, Artificial Sequence
  Synthetic
gccuucuacgcgcgcuaucgcg

SEQ ID NO: 3355 - RNA, 24 nt, Artificial Sequence
  Synthetic
gcgccuucuacgcgcgcuaucgcg

SEQ ID NO: 3356 - RNA, 20 nt, Artificial Sequence
  Synthetic
gccgggcccccgcccccggg

SEQ ID NO: 3357 - RNA, 22 nt, Artificial Sequence
  Synthetic
gcgccgggcccccgcccccggg

SEQ ID NO: 3358 - RNA, 23 nt, Artificial Sequence
  Synthetic
ggcgccgggcccccgcccccggg

SEQ ID NO: 3359 - RNA, 18 nt, Artificial Sequence
  Synthetic
gaggcgcgggccgucggg

SEQ ID NO: 3360 - RNA, 20 nt, Artificial Sequence
  Synthetic
gcgaggcgcgggccgucggg

SEQ ID NO: 3361 - RNA, 24 nt, Artificial Sequence
  Synthetic
gcacgcgaggcgcgggccgucggg

SEQ ID NO: 3362 - RNA, 20 nt, Artificial Sequence
  Synthetic
gucaucgaccucgucggacu

SEQ ID NO: 3363 - RNA, 22 nt, Artificial Sequence
  Synthetic
gcgucaucgaccucgucggacu

SEQ ID NO: 3364 - RNA, 23 nt, Artificial Sequence
  Synthetic
ggcgucaucgaccucgucggacu

SEQ ID NO: 3365 - RNA, 18 nt, Artificial Sequence
  Synthetic
gcuggaccaggccugcuu

SEQ ID NO: 3366 - RNA, 20 nt, Artificial Sequence
  Synthetic
gcgcuggaccaggccugcuu

SEQ ID NO: 3367 - RNA, 21 nt, Artificial Sequence
  Synthetic
ggcgcuggaccaggccugcuu

SEQ ID NO: 3368 - RNA, 23 nt, Artificial Sequence
  Synthetic
guggcgcuggaccaggccugcuu

SEQ ID NO: 3369 - RNA, 18 nt, Artificial Sequence
  Synthetic
ucggacgacgaggacgaa

SEQ ID NO: 3370 - RNA, 20 nt, Artificial Sequence
  Synthetic
cgucggacgacgaggacgaa

SEQ ID NO: 3371 - RNA, 21 nt, Artificial Sequence
  Synthetic
ucgucggacgacgaggacgaa

SEQ ID NO: 3372 - RNA, 22 nt, Artificial Sequence
  Synthetic
cucgucggacgacgaggacgaa

SEQ ID NO: 3373 - RNA, 23 nt, Artificial Sequence
  Synthetic
ccucgucggacgacgaggacgaa

SEQ ID NO: 3374 - RNA, 24 nt, Artificial Sequence
  Synthetic
uccucgucggacgacgaggacgaa

SEQ ID NO: 3375 - RNA, 19 nt, Artificial Sequence
  Synthetic
cgccaggggacggggaaca

SEQ ID NO: 3376 - RNA, 20 nt, Artificial Sequence
  Synthetic
ucgccaggggacggggaaca

SEQ ID NO: 3377 - RNA, 23 nt, Artificial Sequence
  Synthetic
cggucgccaggggacggggaaca

SEQ ID NO: 3378 - RNA, 24 nt, Artificial Sequence
  Synthetic
ccggucgccaggggacggggaaca

SEQ ID NO: 3379 - RNA, 19 nt, Artificial Sequence
  Synthetic
ugccgccgccagccgccca

SEQ ID NO: 3380 - RNA, 20 nt, Artificial Sequence
  Synthetic
cugccgccgccagccgccca

SEQ ID NO: 3381 - RNA, 20 nt, Artificial Sequence
  Synthetic
cggcccguggccgaggccca

SEQ ID NO: 3382 - RNA, 22 nt, Artificial Sequence
  Synthetic
ugcggcccguggccgaggccca

SEQ ID NO: 3383 - RNA, 23 nt, Artificial Sequence
  Synthetic
cugcggcccguggccgaggccca

SEQ ID NO: 3384 - RNA, 18 nt, Artificial Sequence
  Synthetic
acgacgaggacgaggacc

SEQ ID NO: 3385 - RNA, 21 nt, Artificial Sequence
  Synthetic
cggacgacgaggacgaggacc

SEQ ID NO: 3386 - RNA, 23 nt, Artificial Sequence
  Synthetic
ugcggacgacgaggacgaggacc

SEQ ID NO: 3387 - RNA, 24 nt, Artificial Sequence
  Synthetic
augcggacgacgaggacgaggacc

SEQ ID NO: 3388 - RNA, 18 nt, Artificial Sequence
  Synthetic
cgaucgaggccagggccc

SEQ ID NO: 3389 - RNA, 21 nt, Artificial Sequence
  Synthetic
cggcgaucgaggccagggccc

SEQ ID NO: 3390 - RNA, 23 nt, Artificial Sequence
  Synthetic
cgcggcgaucgaggccagggccc

SEQ ID NO: 3391 - RNA, 19 nt, Artificial Sequence
  Synthetic
cggcggggaagcggggccc

SEQ ID NO: 3392 - RNA, 22 nt, Artificial Sequence
  Synthetic
cggcggcggggaagcggggccc

SEQ ID NO: 3393 - RNA, 18 nt, Artificial Sequence
  Synthetic
cguccccggggaccacgc

SEQ ID NO: 3394 - RNA, 19 nt, Artificial Sequence
  Synthetic
acguccccggggaccacgc

SEQ ID NO: 3395 - RNA, 20 nt, Artificial Sequence
  Synthetic
cacguccccggggaccacgc

SEQ ID NO: 3396 - RNA, 21 nt, Artificial Sequence
  Synthetic
ccacguccccggggaccacgc

SEQ ID NO: 3397 - RNA, 23 nt, Artificial Sequence
  Synthetic
cgccacguccccggggaccacgc

SEQ ID NO: 3398 - RNA, 19 nt, Artificial Sequence
  Synthetic
ugcggcccgcggaggccgc

SEQ ID NO: 3399 - RNA, 20 nt, Artificial Sequence
  Synthetic
augcggcccgcggaggccgc

SEQ ID NO: 3400 - RNA, 22 nt, Artificial Sequence
  Synthetic
cgaugcggcccgcggaggccgc

SEQ ID NO: 3401 - RNA, 23 nt, Artificial Sequence
  Synthetic
ucgaugcggcccgcggaggccgc

SEQ ID NO: 3402 - RNA, 24 nt, Artificial Sequence
  Synthetic
cucgaugcggcccgcggaggccgc

SEQ ID NO: 3403 - RNA, 18 nt, Artificial Sequence
  Synthetic
ccgcggagcucggcaggc

SEQ ID NO: 3404 - RNA, 21 nt, Artificial Sequence
  Synthetic
cggccgcggagcucggcaggc

SEQ ID NO: 3405 - RNA, 24 nt, Artificial Sequence
  Synthetic
cggcggccgcggagcucggcaggc

SEQ ID NO: 3406 - RNA, 18 nt, Artificial Sequence
  Synthetic
cagccgccccagggcggc

SEQ ID NO: 3407 - RNA, 19 nt, Artificial Sequence
  Synthetic
acagccgccccagggcggc

SEQ ID NO: 3408 - RNA, 22 nt, Artificial Sequence
  Synthetic
cggacagccgccccagggcggc

SEQ ID NO: 3409 - RNA, 19 nt, Artificial Sequence
  Synthetic
agcccucggccagcgccuc

SEQ ID NO: 3410 - RNA, 20 nt, Artificial Sequence
  Synthetic
aagcccucggccagcgccuc

SEQ ID NO: 3411 - RNA, 22 nt, Artificial Sequence
  Synthetic
cgaagcccucggccagcgccuc

SEQ ID NO: 3412 - RNA, 23 nt, Artificial Sequence
  Synthetic
ucgaagcccucggccagcgccuc

SEQ ID NO: 3413 - RNA, 18 nt, Artificial Sequence
  Synthetic
ccccauggccuccgcguc

SEQ ID NO: 3414 - RNA, 19 nt, Artificial Sequence
  Synthetic
accccauggccuccgcguc

SEQ ID NO: 3415 - RNA, 20 nt, Artificial Sequence
  Synthetic
caccccauggccuccgcguc

SEQ ID NO: 3416 - RNA, 21 nt, Artificial Sequence
  Synthetic
ccaccccauggccuccgcguc

SEQ ID NO: 3417 - RNA, 23 nt, Artificial Sequence
  Synthetic
agccaccccauggccuccgcguc

SEQ ID NO: 3418 - RNA, 19 nt, Artificial Sequence
  Synthetic
cgcgcacguccucgggguc

SEQ ID NO: 3419 - RNA, 20 nt, Artificial Sequence
  Synthetic
acgcgcacguccucgggguc

SEQ ID NO: 3420 - RNA, 21 nt, Artificial Sequence
  Synthetic
cacgcgcacguccucgggguc

SEQ ID NO: 3421 - RNA, 22 nt, Artificial Sequence
  Synthetic
ccacgcgcacguccucgggguc

SEQ ID NO: 3422 - RNA, 23 nt, Artificial Sequence
  Synthetic
accacgcgcacguccucgggguc

SEQ ID NO: 3423 - RNA, 24 nt, Artificial Sequence
  Synthetic
caccacgcgcacguccucgggguc

SEQ ID NO: 3424 - RNA, 18 nt, Artificial Sequence
  Synthetic
ccgcucuucuucgucuuc

SEQ ID NO: 3425 - RNA, 20 nt, Artificial Sequence
  Synthetic
cgccgcucuucuucgucuuc

SEQ ID NO: 3426 - RNA, 22 nt, Artificial Sequence
  Synthetic
cgcgccgcucuucuucgucuuc

SEQ ID NO: 3427 - RNA, 23 nt, Artificial Sequence
  Synthetic
ccgcgccgcucuucuucgucuuc

SEQ ID NO: 3428 - RNA, 24 nt, Artificial Sequence
  Synthetic
uccgcgccgcucuucuucgucuuc

SEQ ID NO: 3429 - RNA, 19 nt, Artificial Sequence
  Synthetic
agguccucgcccggcagcg

SEQ ID NO: 3430 - RNA, 20 nt, Artificial Sequence
  Synthetic
cagguccucgcccggcagcg

SEQ ID NO: 3431 - RNA, 21 nt, Artificial Sequence
  Synthetic
ccagguccucgcccggcagcg

SEQ ID NO: 3432 - RNA, 24 nt, Artificial Sequence
  Synthetic
cggccagguccucgcccggcagcg

SEQ ID NO: 3433 - RNA, 20 nt, Artificial Sequence
  Synthetic
ugggcgcggccucggagagg

SEQ ID NO: 3434 - RNA, 21 nt, Artificial Sequence
  Synthetic
uugggcgcggccucggagagg

SEQ ID NO: 3435 - RNA, 22 nt, Artificial Sequence
  Synthetic
cuugggcgcggccucggagagg

SEQ ID NO: 3436 - RNA, 18 nt, Artificial Sequence
  Synthetic
ccaccacgcgcacguccu

SEQ ID NO: 3437 - RNA, 19 nt, Artificial Sequence
  Synthetic
accaccacgcgcacguccu

SEQ ID NO: 3438 - RNA, 20 nt, Artificial Sequence
  Synthetic
caccaccacgcgcacguccu

SEQ ID NO: 3439 - RNA, 22 nt, Artificial Sequence
  Synthetic
agcaccaccacgcgcacguccu

SEQ ID NO: 3440 - RNA, 23 nt, Artificial Sequence
  Synthetic
cagcaccaccacgcgcacguccu

SEQ ID NO: 3441 - RNA, 24 nt, Artificial Sequence
  Synthetic
acagcaccaccacgcgcacguccu

SEQ ID NO: 3442 - RNA, 19 nt, Artificial Sequence
  Synthetic
cggcccccggcggccccgu

SEQ ID NO: 3443 - RNA, 22 nt, Artificial Sequence
  Synthetic
aggcggcccccggcggccccgu

SEQ ID NO: 3444 - RNA, 24 nt, Artificial Sequence
  Synthetic
agaggcggcccccggcggccccgu

SEQ ID NO: 3445 - RNA, 19 nt, Artificial Sequence
  Synthetic
aggcgcagcggcggcgcgu

SEQ ID NO: 3446 - RNA, 20 nt, Artificial Sequence
  Synthetic
caggcgcagcggcggcgcgu

SEQ ID NO: 3447 - RNA, 21 nt, Artificial Sequence
  Synthetic
acaggcgcagcggcggcgcgu

SEQ ID NO: 3448 - RNA, 22 nt, Artificial Sequence
  Synthetic
cacaggcgcagcggcggcgcgu

SEQ ID NO: 3449 - RNA, 18 nt, Artificial Sequence
  Synthetic
agcgcgcgcaggcggcgu

SEQ ID NO: 3450 - RNA, 19 nt, Artificial Sequence
  Synthetic
cagcgcgcgcaggcggcgu

SEQ ID NO: 3451 - RNA, 20 nt, Artificial Sequence
  Synthetic
ccagcgcgcgcaggcggcgu

SEQ ID NO: 3452 - RNA, 21 nt, Artificial Sequence
  Synthetic
cccagcgcgcgcaggcggcgu

SEQ ID NO: 3453 - RNA, 22 nt, Artificial Sequence
  Synthetic
ccccagcgcgcgcaggcggcgu

SEQ ID NO: 3454 - RNA, 18 nt, Artificial Sequence
  Synthetic
cggcguggcgggcggcgu

SEQ ID NO: 3455 - RNA, 19 nt, Artificial Sequence
  Synthetic
ucggcguggcgggcggcgu

SEQ ID NO: 3456 - RNA, 21 nt, Artificial Sequence
  Synthetic
cgucggcguggcgggcggcgu

SEQ ID NO: 3457 - RNA, 24 nt, Artificial Sequence
  Synthetic
cggcgucggcguggcgggcggcgu

SEQ ID NO: 3458 - RNA, 18 nt, Artificial Sequence
  Synthetic
cggcggccccgugggggu

SEQ ID NO: 3459 - RNA, 19 nt, Artificial Sequence
  Synthetic
ccggcggccccgugggggu

SEQ ID NO: 3460 - RNA, 20 nt, Artificial Sequence
  Synthetic
cccggcggccccgugggggu

SEQ ID NO: 3461 - RNA, 21 nt, Artificial Sequence
  Synthetic
ccccggcggccccgugggggu

SEQ ID NO: 3462 - RNA, 22 nt, Artificial Sequence
  Synthetic
cccccggcggccccgugggggu

SEQ ID NO: 3463 - RNA, 18 nt, Artificial Sequence
  Synthetic
ccccggacgcggaggcca

SEQ ID NO: 3464 - RNA, 19 nt, Artificial Sequence
  Synthetic
accccggacgcggaggcca

SEQ ID NO: 3465 - RNA, 20 nt, Artificial Sequence
  Synthetic
caccccggacgcggaggcca

SEQ ID NO: 3466 - RNA, 21 nt, Artificial Sequence
  Synthetic
acaccccggacgcggaggcca

SEQ ID NO: 3467 - RNA, 22 nt, Artificial Sequence
  Synthetic
uacaccccggacgcggaggcca

SEQ ID NO: 3468 - RNA, 24 nt, Artificial Sequence
  Synthetic
uguacaccccggacgcggaggcca

SEQ ID NO: 3469 - RNA, 18 nt, Artificial Sequence
  Synthetic
cgccggcgcagaugacga

SEQ ID NO: 3470 - RNA, 21 nt, Artificial Sequence
  Synthetic
cggcgccggcgcagaugacga

SEQ ID NO: 3471 - RNA, 22 nt, Artificial Sequence
  Synthetic
ccggcgccggcgcagaugacga

SEQ ID NO: 3472 - RNA, 23 nt, Artificial Sequence
  Synthetic
cccggcgccggcgcagaugacga

SEQ ID NO: 3473 - RNA, 24 nt, Artificial Sequence
  Synthetic
ccccggcgccggcgcagaugacga

SEQ ID NO: 3474 - RNA, 18 nt, Artificial Sequence
  Synthetic
cggcgcguucgaggggga

SEQ ID NO: 3475 - RNA, 21 nt, Artificial Sequence
  Synthetic
cggcggcgcguucgaggggga

SEQ ID NO: 3476 - RNA, 22 nt, Artificial Sequence
  Synthetic
acggcggcgcguucgaggggga

SEQ ID NO: 3477 - RNA, 24 nt, Artificial Sequence
  Synthetic
cgacggcggcgcguucgaggggga

SEQ ID NO: 3478 - RNA, 19 nt, Artificial Sequence
  Synthetic
cgggccgcguguucggccc

SEQ ID NO: 3479 - RNA, 20 nt, Artificial Sequence
  Synthetic
ucgggccgcguguucggccc

SEQ ID NO: 3480 - RNA, 21 nt, Artificial Sequence
  Synthetic
cucgggccgcguguucggccc

SEQ ID NO: 3481 - RNA, 22 nt, Artificial Sequence
  Synthetic
ccucgggccgcguguucggccc

SEQ ID NO: 3482 - RNA, 18 nt, Artificial Sequence
  Synthetic
ccugccgccggcgccgcc

SEQ ID NO: 3483 - RNA, 19 nt, Artificial Sequence
  Synthetic
cccugccgccggcgccgcc

SEQ ID NO: 3484 - RNA, 18 nt, Artificial Sequence
  Synthetic
cggugcccauguccccgc

SEQ ID NO: 3485 - RNA, 19 nt, Artificial Sequence
  Synthetic
ccggugcccauguccccgc

SEQ ID NO: 3486 - RNA, 21 nt, Artificial Sequence
  Synthetic
cgccggugcccauguccccgc

SEQ ID NO: 3487 - RNA, 22 nt, Artificial Sequence
  Synthetic
acgccggugcccauguccccgc

SEQ ID NO: 3488 - RNA, 23 nt, Artificial Sequence
  Synthetic
cacgccggugcccauguccccgc

SEQ ID NO: 3489 - RNA, 24 nt, Artificial Sequence
  Synthetic
acacgccggugcccauguccccgc

SEQ ID NO: 3490 - RNA, 18 nt, Artificial Sequence
  Synthetic
cgccggguacggcgccgc

SEQ ID NO: 3491 - RNA, 19 nt, Artificial Sequence
  Synthetic
ccgccggguacggcgccgc

SEQ ID NO: 3492 - RNA, 20 nt, Artificial Sequence
  Synthetic
cccgccggguacggcgccgc

SEQ ID NO: 3493 - RNA, 22 nt, Artificial Sequence
  Synthetic
ugcccgccggguacggcgccgc

SEQ ID NO: 3494 - RNA, 20 nt, Artificial Sequence
  Synthetic
cggggccucgggggggccgc

SEQ ID NO: 3495 - RNA, 23 nt, Artificial Sequence
  Synthetic
cggcggggccucgggggggccgc

SEQ ID NO: 3496 - RNA, 18 nt, Artificial Sequence
  Synthetic
cgggaggggcgcaagcgc

SEQ ID NO: 3497 - RNA, 20 nt, Artificial Sequence
  Synthetic
cgcgggaggggcgcaagcgc

SEQ ID NO: 3498 - RNA, 21 nt, Artificial Sequence
  Synthetic
ccgcgggaggggcgcaagcgc

SEQ ID NO: 3499 - RNA, 23 nt, Artificial Sequence
  Synthetic
cgccgcgggaggggcgcaagcgc

SEQ ID NO: 3500 - RNA, 19 nt, Artificial Sequence
  Synthetic
cgcugcgccgcauggcggc

SEQ ID NO: 3501 - RNA, 20 nt, Artificial Sequence
  Synthetic
ccgcugcgccgcauggcggc

SEQ ID NO: 3502 - RNA, 21 nt, Artificial Sequence
  Synthetic
cccgcugcgccgcauggcggc

SEQ ID NO: 3503 - RNA, 18 nt, Artificial Sequence
  Synthetic
cacggccgggcagccccg

SEQ ID NO: 3504 - RNA, 19 nt, Artificial Sequence
  Synthetic
ucacggccgggcagccccg

SEQ ID NO: 3505 - RNA, 20 nt, Artificial Sequence
  Synthetic
uucacggccgggcagccccg

SEQ ID NO: 3506 - RNA, 21 nt, Artificial Sequence
  Synthetic
cuucacggccgggcagccccg

SEQ ID NO: 3507 - RNA, 23 nt, Artificial Sequence
  Synthetic
cgcuucacggccgggcagccccg

SEQ ID NO: 3508 - RNA, 24 nt, Artificial Sequence
  Synthetic
ccgcuucacggccgggcagccccg

SEQ ID NO: 3509 - RNA, 21 nt, Artificial Sequence
  Synthetic
cgggcgagcgcgcggugcccg

SEQ ID NO: 3510 - RNA, 22 nt, Artificial Sequence
  Synthetic
ccgggcgagcgcgcggugcccg

SEQ ID NO: 3511 - RNA, 23 nt, Artificial Sequence
  Synthetic
accgggcgagcgcgcggugcccg

SEQ ID NO: 3512 - RNA, 24 nt, Artificial Sequence
  Synthetic
caccgggcgagcgcgcggugcccg

SEQ ID NO: 3513 - RNA, 18 nt, Artificial Sequence
  Synthetic
uggccuucgccggggccg

SEQ ID NO: 3514 - RNA, 19 nt, Artificial Sequence
  Synthetic
cuggccuucgccggggccg

SEQ ID NO: 3515 - RNA, 20 nt, Artificial Sequence
  Synthetic
ccuggccuucgccggggccg

SEQ ID NO: 3516 - RNA, 21 nt, Artificial Sequence
  Synthetic
accuggccuucgccggggccg

SEQ ID NO: 3517 - RNA, 18 nt, Artificial Sequence
  Synthetic
aggccggccgcguggccg

SEQ ID NO: 3518 - RNA, 19 nt, Artificial Sequence
  Synthetic
caggccggccgcguggccg

SEQ ID NO: 3519 - RNA, 20 nt, Artificial Sequence
  Synthetic
ccaggccggccgcguggccg

SEQ ID NO: 3520 - RNA, 21 nt, Artificial Sequence
  Synthetic
cccaggccggccgcguggccg

SEQ ID NO: 3521 - RNA, 23 nt, Artificial Sequence
  Synthetic
cgcccaggccggccgcguggccg

SEQ ID NO: 3522 - RNA, 19 nt, Artificial Sequence
  Synthetic
agugccuggccgccugccg

SEQ ID NO: 3523 - RNA, 21 nt, Artificial Sequence
  Synthetic
cgagugccuggccgccugccg

SEQ ID NO: 3524 - RNA, 22 nt, Artificial Sequence
  Synthetic
ucgagugccuggccgccugccg

SEQ ID NO: 3525 - RNA, 24 nt, Artificial Sequence
  Synthetic
cgucgagugccuggccgccugccg

SEQ ID NO: 3526 - RNA, 18 nt, Artificial Sequence
  Synthetic
ucuacgcgcgcuaucgcg

SEQ ID NO: 3527 - RNA, 19 nt, Artificial Sequence
  Synthetic
uucuacgcgcgcuaucgcg

SEQ ID NO: 3528 - RNA, 20 nt, Artificial Sequence
  Synthetic
cuucuacgcgcgcuaucgcg

SEQ ID NO: 3529 - RNA, 21 nt, Artificial Sequence
  Synthetic
ccuucuacgcgcgcuaucgcg

SEQ ID NO: 3530 - RNA, 23 nt, Artificial Sequence
  Synthetic
cgccuucuacgcgcgcuaucgcg

SEQ ID NO: 3531 - RNA, 18 nt, Artificial Sequence
  Synthetic
cgggcccccgcccccggg

SEQ ID NO: 3532 - RNA, 19 nt, Artificial Sequence
  Synthetic
ccgggcccccgcccccggg

SEQ ID NO: 3533 - RNA, 21 nt, Artificial Sequence
  Synthetic
cgccgggcccccgcccccggg

SEQ ID NO: 3534 - RNA, 24 nt, Artificial Sequence
  Synthetic
cggcgccgggcccccgcccccggg

SEQ ID NO: 3535 - RNA, 19 nt, Artificial Sequence
  Synthetic
cgaggcgcgggccgucggg

SEQ ID NO: 3536 - RNA, 21 nt, Artificial Sequence
  Synthetic
cgcgaggcgcgggccgucggg

SEQ ID NO: 3537 - RNA, 22 nt, Artificial Sequence
  Synthetic
acgcgaggcgcgggccgucggg

SEQ ID NO: 3538 - RNA, 23 nt, Artificial Sequence
  Synthetic
cacgcgaggcgcgggccgucggg

SEQ ID NO: 3539 - RNA, 18 nt, Artificial Sequence
  Synthetic
caucgaccucgucggacu

SEQ ID NO: 3540 - RNA, 19 nt, Artificial Sequence
  Synthetic
ucaucgaccucgucggacu

SEQ ID NO: 3541 - RNA, 21 nt, Artificial Sequence
  Synthetic
cgucaucgaccucgucggacu

SEQ ID NO: 3542 - RNA, 24 nt, Artificial Sequence
  Synthetic
cggcgucaucgaccucgucggacu

SEQ ID NO: 3543 - RNA, 19 nt, Artificial Sequence
  Synthetic
cgcuggaccaggccugcuu

SEQ ID NO: 3544 - RNA, 22 nt, Artificial Sequence
  Synthetic
uggcgcuggaccaggccugcuu

SEQ ID NO: 3545 - RNA, 24 nt, Artificial Sequence
  Synthetic
cguggcgcuggaccaggccugcuu

SEQ ID NO: 3546 - RNA, 18 nt, Artificial Sequence
  Synthetic
cgcguucucgcgcgccaa

SEQ ID NO: 3547 - RNA, 19 nt, Artificial Sequence
  Synthetic
ccgcguucucgcgcgccaa

SEQ ID NO: 3548 - RNA, 20 nt, Artificial Sequence
  Synthetic
gccgcguucucgcgcgccaa

SEQ ID NO: 3549 - RNA, 21 nt, Artificial Sequence
  Synthetic
cgccgcguucucgcgcgccaa

SEQ ID NO: 3550 - RNA, 22 nt, Artificial Sequence
  Synthetic
gcgccgcguucucgcgcgccaa

SEQ ID NO: 3551 - RNA, 23 nt, Artificial Sequence
  Synthetic
agcgccgcguucucgcgcgccaa

SEQ ID NO: 3552 - RNA, 24 nt, Artificial Sequence
  Synthetic
cagcgccgcguucucgcgcgccaa

SEQ ID NO: 3553 - RNA, 18 nt, Artificial Sequence
  Synthetic
ugcggcggcggcggggaa

SEQ ID NO: 3554 - RNA, 19 nt, Artificial Sequence
  Synthetic
gugcggcggcggcggggaa

SEQ ID NO: 3555 - RNA, 20 nt, Artificial Sequence
  Synthetic
cgugcggcggcggcggggaa

SEQ ID NO: 3556 - RNA, 21 nt, Artificial Sequence
  Synthetic
gcgugcggcggcggcggggaa

SEQ ID NO: 3557 - RNA, 22 nt, Artificial Sequence
  Synthetic
ggcgugcggcggcggcggggaa

SEQ ID NO: 3558 - RNA, 23 nt, Artificial Sequence
  Synthetic
cggcgugcggcggcggcggggaa

SEQ ID NO: 3559 - RNA, 24 nt, Artificial Sequence
  Synthetic
ucggcgugcggcggcggcggggaa

SEQ ID NO: 3560 - RNA, 18 nt, Artificial Sequence
  Synthetic
cgucgccgcgcagcacca

SEQ ID NO: 3561 - RNA, 19 nt, Artificial Sequence
  Synthetic
ucgucgccgcgcagcacca

SEQ ID NO: 3562 - RNA, 20 nt, Artificial Sequence
  Synthetic
gucgucgccgcgcagcacca

SEQ ID NO: 3563 - RNA, 21 nt, Artificial Sequence
  Synthetic
cgucgucgccgcgcagcacca

SEQ ID NO: 3564 - RNA, 22 nt, Artificial Sequence
  Synthetic
ucgucgucgccgcgcagcacca

SEQ ID NO: 3565 - RNA, 23 nt, Artificial Sequence
  Synthetic
gucgucgucgccgcgcagcacca

SEQ ID NO: 3566 - RNA, 24 nt, Artificial Sequence
  Synthetic
cgucgucgucgccgcgcagcacca

SEQ ID NO: 3567 - RNA, 18 nt, Artificial Sequence
  Synthetic
ccuccgcggcccgcgcca

SEQ ID NO: 3568 - RNA, 19 nt, Artificial Sequence
  Synthetic
cccuccgcggcccgcgcca

SEQ ID NO: 3569 - RNA, 20 nt, Artificial Sequence
  Synthetic
ucccuccgcggcccgcgcca

SEQ ID NO: 3570 - RNA, 21 nt, Artificial Sequence
  Synthetic
gucccuccgcggcccgcgcca

SEQ ID NO: 3571 - RNA, 22 nt, Artificial Sequence
  Synthetic
agucccuccgcggcccgcgcca

SEQ ID NO: 3572 - RNA, 23 nt, Artificial Sequence
  Synthetic
aagucccuccgcggcccgcgcca

SEQ ID NO: 3573 - RNA, 24 nt, Artificial Sequence
  Synthetic
aaagucccuccgcggcccgcgcca

SEQ ID NO: 3574 - RNA, 18 nt, Artificial Sequence
  Synthetic
caugagggccggucgcca

SEQ ID NO: 3575 - RNA, 19 nt, Artificial Sequence
  Synthetic
acaugagggccggucgcca

SEQ ID NO: 3576 - RNA, 20 nt, Artificial Sequence
  Synthetic
aacaugagggccggucgcca

SEQ ID NO: 3577 - RNA, 21 nt, Artificial Sequence
  Synthetic
aaacaugagggccggucgcca

SEQ ID NO: 3578 - RNA, 22 nt, Artificial Sequence
  Synthetic
caaacaugagggccggucgcca

SEQ ID NO: 3579 - RNA, 23 nt, Artificial Sequence
  Synthetic
ucaaacaugagggccggucgcca

SEQ ID NO: 3580 - RNA, 24 nt, Artificial Sequence
  Synthetic
gucaaacaugagggccggucgcca

SEQ ID NO: 3581 - RNA, 18 nt, Artificial Sequence
  Synthetic
gccggcgcgacacggcca

SEQ ID NO: 3582 - RNA, 19 nt, Artificial Sequence
  Synthetic
ggccggcgcgacacggcca

SEQ ID NO: 3583 - RNA, 20 nt, Artificial Sequence
  Synthetic
gggccggcgcgacacggcca

SEQ ID NO: 3584 - RNA, 21 nt, Artificial Sequence
  Synthetic
cgggccggcgcgacacggcca

SEQ ID NO: 3585 - RNA, 22 nt, Artificial Sequence
  Synthetic
gcgggccggcgcgacacggcca

SEQ ID NO: 3586 - RNA, 23 nt, Artificial Sequence
  Synthetic
ggcgggccggcgcgacacggcca

SEQ ID NO: 3587 - RNA, 24 nt, Artificial Sequence
  Synthetic
cggcgggccggcgcgacacggcca

SEQ ID NO: 3588 - RNA, 18 nt, Artificial Sequence
  Synthetic
gaggcgcgcagggggcca

SEQ ID NO: 3589 - RNA, 19 nt, Artificial Sequence
  Synthetic
cgaggcgcgcagggggcca

SEQ ID NO: 3590 - RNA, 20 nt, Artificial Sequence
  Synthetic
ccgaggcgcgcagggggcca

SEQ ID NO: 3591 - RNA, 21 nt, Artificial Sequence
  Synthetic
cccgaggcgcgcagggggcca

SEQ ID NO: 3592 - RNA, 22 nt, Artificial Sequence
  Synthetic
gcccgaggcgcgcagggggcca

SEQ ID NO: 3593 - RNA, 23 nt, Artificial Sequence
  Synthetic
ggcccgaggcgcgcagggggcca

SEQ ID NO: 3594 - RNA, 24 nt, Artificial Sequence
  Synthetic
gggcccgaggcgcgcagggggcca

SEQ ID NO: 3595 - RNA, 18 nt, Artificial Sequence
  Synthetic
uggccgccgccgccagca

SEQ ID NO: 3596 - RNA, 19 nt, Artificial Sequence
  Synthetic
cuggccgccgccgccagca

SEQ ID NO: 3597 - RNA, 20 nt, Artificial Sequence
  Synthetic
gcuggccgccgccgccagca

SEQ ID NO: 3598 - RNA, 21 nt, Artificial Sequence
  Synthetic
cgcuggccgccgccgccagca

SEQ ID NO: 3599 - RNA, 22 nt, Artificial Sequence
  Synthetic
gcgcuggccgccgccgccagca

SEQ ID NO: 3600 - RNA, 23 nt, Artificial Sequence
  Synthetic
ugcgcuggccgccgccgccagca

SEQ ID NO: 3601 - RNA, 24 nt, Artificial Sequence
  Synthetic
gugcgcuggccgccgccgccagca

SEQ ID NO: 3602 - RNA, 18 nt, Artificial Sequence
  Synthetic
gcgggcccgaggcgcgca

SEQ ID NO: 3603 - RNA, 19 nt, Artificial Sequence
  Synthetic
agcgggcccgaggcgcgca

SEQ ID NO: 3604 - RNA, 20 nt, Artificial Sequence
  Synthetic
cagcgggcccgaggcgcgca

SEQ ID NO: 3605 - RNA, 21 nt, Artificial Sequence
  Synthetic
gcagcgggcccgaggcgcgca

SEQ ID NO: 3606 - RNA, 22 nt, Artificial Sequence
  Synthetic
cgcagcgggcccgaggcgcgca

SEQ ID NO: 3607 - RNA, 23 nt, Artificial Sequence
  Synthetic
gcgcagcgggcccgaggcgcgca

SEQ ID NO: 3608 - RNA, 24 nt, Artificial Sequence
  Synthetic
ggcgcagcgggcccgaggcgcgca

SEQ ID NO: 3609 - RNA, 18 nt, Artificial Sequence
  Synthetic
aggccgccaugcggcgca

SEQ ID NO: 3610 - RNA, 19 nt, Artificial Sequence
  Synthetic
caggccgccaugcggcgca

SEQ ID NO: 3611 - RNA, 20 nt, Artificial Sequence
  Synthetic
ccaggccgccaugcggcgca

SEQ ID NO: 3612 - RNA, 21 nt, Artificial Sequence
  Synthetic
uccaggccgccaugcggcgca

SEQ ID NO: 3613 - RNA, 22 nt, Artificial Sequence
  Synthetic
auccaggccgccaugcggcgca

SEQ ID NO: 3614 - RNA, 23 nt, Artificial Sequence
  Synthetic
cauccaggccgccaugcggcgca

SEQ ID NO: 3615 - RNA, 24 nt, Artificial Sequence
  Synthetic
gcauccaggccgccaugcggcgca

SEQ ID NO: 3616 - RNA, 18 nt, Artificial Sequence
  Synthetic
ugggcgcggccucggaga

SEQ ID NO: 3617 - RNA, 19 nt, Artificial Sequence
  Synthetic
uugggcgcggccucggaga

SEQ ID NO: 3618 - RNA, 20 nt, Artificial Sequence
  Synthetic
cuugggcgcggccucggaga

SEQ ID NO: 3619 - RNA, 21 nt, Artificial Sequence
  Synthetic
gcuugggcgcggccucggaga

SEQ ID NO: 3620 - RNA, 22 nt, Artificial Sequence
  Synthetic
ggcuugggcgcggccucggaga

SEQ ID NO: 3621 - RNA, 23 nt, Artificial Sequence
  Synthetic
gggcuugggcgcggccucggaga

SEQ ID NO: 3622 - RNA, 24 nt, Artificial Sequence
  Synthetic
ggggcuugggcgcggccucggaga

SEQ ID NO: 3623 - RNA, 18 nt, Artificial Sequence
  Synthetic
cggcgcaccgcgcggcga

SEQ ID NO: 3624 - RNA, 19 nt, Artificial Sequence
  Synthetic
ccggcgcaccgcgcggcga

SEQ ID NO: 3625 - RNA, 20 nt, Artificial Sequence
  Synthetic
cccggcgcaccgcgcggcga

SEQ ID NO: 3626 - RNA, 21 nt, Artificial Sequence
  Synthetic
gcccggcgcaccgcgcggcga

SEQ ID NO: 3627 - RNA, 22 nt, Artificial Sequence
  Synthetic
ggcccggcgcaccgcgcggcga

SEQ ID NO: 3628 - RNA, 23 nt, Artificial Sequence
  Synthetic
gggcccggcgcaccgcgcggcga

SEQ ID NO: 3629 - RNA, 24 nt, Artificial Sequence
  Synthetic
cgggcccggcgcaccgcgcggcga

SEQ ID NO: 3630 - RNA, 18 nt, Artificial Sequence
  Synthetic
cgcgcaggcggcgugcga

SEQ ID NO: 3631 - RNA, 19 nt, Artificial Sequence
  Synthetic
gcgcgcaggcggcgugcga

SEQ ID NO: 3632 - RNA, 20 nt, Artificial Sequence
  Synthetic
cgcgcgcaggcggcgugcga

SEQ ID NO: 3633 - RNA, 21 nt, Artificial Sequence
  Synthetic
gcgcgcgcaggcggcgugcga

SEQ ID NO: 3634 - RNA, 22 nt, Artificial Sequence
  Synthetic
agcgcgcgcaggcggcgugcga

SEQ ID NO: 3635 - RNA, 23 nt, Artificial Sequence
  Synthetic
cagcgcgcgcaggcggcgugcga

SEQ ID NO: 3636 - RNA, 24 nt, Artificial Sequence
  Synthetic
ccagcgcgcgcaggcggcgugcga

SEQ ID NO: 3637 - RNA, 18 nt, Artificial Sequence
  Synthetic
cuugggcgcggccucgga

SEQ ID NO: 3638 - RNA, 19 nt, Artificial Sequence
  Synthetic
gcuugggcgcggccucgga

SEQ ID NO: 3639 - RNA, 20 nt, Artificial Sequence
  Synthetic
ggcuugggcgcggccucgga

SEQ ID NO: 3640 - RNA, 21 nt, Artificial Sequence
  Synthetic
gggcuugggcgcggccucgga

SEQ ID NO: 3641 - RNA, 22 nt, Artificial Sequence
  Synthetic
ggggcuugggcgcggccucgga

SEQ ID NO: 3642 - RNA, 23 nt, Artificial Sequence
  Synthetic
cggggcuugggcgcggccucgga

SEQ ID NO: 3643 - RNA, 24 nt, Artificial Sequence
  Synthetic
ccggggcuugggcgcggccucgga

SEQ ID NO: 3644 - RNA, 18 nt, Artificial Sequence
  Synthetic
gggccggucgccagggga

SEQ ID NO: 3645 - RNA, 19 nt, Artificial Sequence
  Synthetic
agggccggucgccagggga

SEQ ID NO: 3646 - RNA, 20 nt, Artificial Sequence
  Synthetic
gagggccggucgccagggga

SEQ ID NO: 3647 - RNA, 21 nt, Artificial Sequence
  Synthetic
ugagggccggucgccagggga

SEQ ID NO: 3648 - RNA, 22 nt, Artificial Sequence
  Synthetic
augagggccggucgccagggga

SEQ ID NO: 3649 - RNA, 23 nt, Artificial Sequence
  Synthetic
caugagggccggucgccagggga

SEQ ID NO: 3650 - RNA, 24 nt, Artificial Sequence
  Synthetic
acaugagggccggucgccagggga

SEQ ID NO: 3651 - RNA, 18 nt, Artificial Sequence
  Synthetic
ggggcgcgggcgcgggga

SEQ ID NO: 3652 - RNA, 19 nt, Artificial Sequence
  Synthetic
gggggcgcgggcgcgggga

SEQ ID NO: 3653 - RNA, 20 nt, Artificial Sequence
  Synthetic
ggggggcgcgggcgcgggga

SEQ ID NO: 3654 - RNA, 21 nt, Artificial Sequence
  Synthetic
aggggggcgcgggcgcgggga

SEQ ID NO: 3655 - RNA, 22 nt, Artificial Sequence
  Synthetic
gaggggggcgcgggcgcgggga

SEQ ID NO: 3656 - RNA, 23 nt, Artificial Sequence
  Synthetic
ggaggggggcgcgggcgcgggga

SEQ ID NO: 3657 - RNA, 24 nt, Artificial Sequence
  Synthetic
uggaggggggcgcgggcgcgggga

SEQ ID NO: 3658 - RNA, 18 nt, Artificial Sequence
  Synthetic
gggccccgggggcgugga

SEQ ID NO: 3659 - RNA, 19 nt, Artificial Sequence
  Synthetic
cgggccccgggggcgugga

SEQ ID NO: 3660 - RNA, 20 nt, Artificial Sequence
  Synthetic
ucgggccccgggggcgugga

SEQ ID NO: 3661 - RNA, 21 nt, Artificial Sequence
  Synthetic
cucgggccccgggggcgugga

SEQ ID NO: 3662 - RNA, 22 nt, Artificial Sequence
  Synthetic
gcucgggccccgggggcgugga

SEQ ID NO: 3663 - RNA, 23 nt, Artificial Sequence
  Synthetic
ggcucgggccccgggggcgugga

SEQ ID NO: 3664 - RNA, 24 nt, Artificial Sequence
  Synthetic
gggcucgggccccgggggcgugga

SEQ ID NO: 3665 - RNA, 18 nt, Artificial Sequence
  Synthetic
ccacgcugccggugauga

SEQ ID NO: 3666 - RNA, 19 nt, Artificial Sequence
  Synthetic
gccacgcugccggugauga

SEQ ID NO: 3667 - RNA, 20 nt, Artificial Sequence
  Synthetic
cgccacgcugccggugauga

SEQ ID NO: 3668 - RNA, 21 nt, Artificial Sequence
  Synthetic
gcgccacgcugccggugauga

SEQ ID NO: 3669 - RNA, 22 nt, Artificial Sequence
  Synthetic
cgcgccacgcugccggugauga

SEQ ID NO: 3670 - RNA, 23 nt, Artificial Sequence
  Synthetic
ccgcgccacgcugccggugauga

SEQ ID NO: 3671 - RNA, 24 nt, Artificial Sequence
  Synthetic
cccgcgccacgcugccggugauga

SEQ ID NO: 3672 - RNA, 18 nt, Artificial Sequence
  Synthetic
agggcccgcgggucaaac

SEQ ID NO: 3673 - RNA, 19 nt, Artificial Sequence
  Synthetic
cagggcccgcgggucaaac

SEQ ID NO: 3674 - RNA, 20 nt, Artificial Sequence
  Synthetic
ccagggcccgcgggucaaac

SEQ ID NO: 3675 - RNA, 21 nt, Artificial Sequence
  Synthetic
gccagggcccgcgggucaaac

SEQ ID NO: 3676 - RNA, 22 nt, Artificial Sequence
  Synthetic
ggccagggcccgcgggucaaac

SEQ ID NO: 3677 - RNA, 23 nt, Artificial Sequence
  Synthetic
aggccagggcccgcgggucaaac

SEQ ID NO: 3678 - RNA, 24 nt, Artificial Sequence
  Synthetic
gaggccagggcccgcgggucaaac

SEQ ID NO: 3679 - RNA, 18 nt, Artificial Sequence
  Synthetic
gcguucucgcgcgccaac

SEQ ID NO: 3680 - RNA, 19 nt, Artificial Sequence
  Synthetic
cgcguucucgcgcgccaac

SEQ ID NO: 3681 - RNA, 20 nt, Artificial Sequence
  Synthetic
ccgcguucucgcgcgccaac

SEQ ID NO: 3682 - RNA, 21 nt, Artificial Sequence
  Synthetic
gccgcguucucgcgcgccaac

SEQ ID NO: 3683 - RNA, 22 nt, Artificial Sequence
  Synthetic
cgccgcguucucgcgcgccaac

SEQ ID NO: 3684 - RNA, 23 nt, Artificial Sequence
  Synthetic
gcgccgcguucucgcgcgccaac

SEQ ID NO: 3685 - RNA, 24 nt, Artificial Sequence
  Synthetic
agcgccgcguucucgcgcgccaac

SEQ ID NO: 3686 - RNA, 18 nt, Artificial Sequence
  Synthetic
gaagaggaugcggacgac

SEQ ID NO: 3687 - RNA, 19 nt, Artificial Sequence
  Synthetic
cgaagaggaugcggacgac

SEQ ID NO: 3688 - RNA, 20 nt, Artificial Sequence
  Synthetic
acgaagaggaugcggacgac

SEQ ID NO: 3689 - RNA, 21 nt, Artificial Sequence
  Synthetic
gacgaagaggaugcggacgac

SEQ ID NO: 3690 - RNA, 22 nt, Artificial Sequence
  Synthetic
ggacgaagaggaugcggacgac

SEQ ID NO: 3691 - RNA, 23 nt, Artificial Sequence
  Synthetic
aggacgaagaggaugcggacgac

SEQ ID NO: 3692 - RNA, 24 nt, Artificial Sequence
  Synthetic
gaggacgaagaggaugcggacgac

SEQ ID NO: 3693 - RNA, 18 nt, Artificial Sequence
  Synthetic
ucguccucgucggacgac

SEQ ID NO: 3694 - RNA, 19 nt, Artificial Sequence
  Synthetic
cucguccucgucggacgac

SEQ ID NO: 3695 - RNA, 20 nt, Artificial Sequence
  Synthetic
ccucguccucgucggacgac

SEQ ID NO: 3696 - RNA, 21 nt, Artificial Sequence
  Synthetic
uccucguccucgucggacgac

SEQ ID NO: 3697 - RNA, 22 nt, Artificial Sequence
  Synthetic
guccucguccucgucggacgac

SEQ ID NO: 3698 - RNA, 23 nt, Artificial Sequence
  Synthetic
cguccucguccucgucggacgac

SEQ ID NO: 3699 - RNA, 24 nt, Artificial Sequence
  Synthetic
ucguccucguccucgucggacgac

SEQ ID NO: 3700 - RNA, 18 nt, Artificial Sequence
  Synthetic
gaugcggacgacgaggac

SEQ ID NO: 3701 - RNA, 19 nt, Artificial Sequence
  Synthetic
ggaugcggacgacgaggac

SEQ ID NO: 3702 - RNA, 20 nt, Artificial Sequence
  Synthetic
aggaugcggacgacgaggac

SEQ ID NO: 3703 - RNA, 21 nt, Artificial Sequence
  Synthetic
gaggaugcggacgacgaggac

SEQ ID NO: 3704 - RNA, 22 nt, Artificial Sequence
  Synthetic
agaggaugcggacgacgaggac

SEQ ID NO: 3705 - RNA, 23 nt, Artificial Sequence
  Synthetic
aagaggaugcggacgacgaggac

SEQ ID NO: 3706 - RNA, 24 nt, Artificial Sequence
  Synthetic
gaagaggaugcggacgacgaggac

SEQ ID NO: 3707 - RNA, 18 nt, Artificial Sequence
  Synthetic
gacgacgaggacgaggac

SEQ ID NO: 3708 - RNA, 19 nt, Artificial Sequence
  Synthetic
ggacgacgaggacgaggac

SEQ ID NO: 3709 - RNA, 20 nt, Artificial Sequence
  Synthetic
cggacgacgaggacgaggac

SEQ ID NO: 3710 - RNA, 21 nt, Artificial Sequence
  Synthetic
gcggacgacgaggacgaggac

SEQ ID NO: 3711 - RNA, 22 nt, Artificial Sequence
  Synthetic
ugcggacgacgaggacgaggac

SEQ ID NO: 3712 - RNA, 23 nt, Artificial Sequence
  Synthetic
augcggacgacgaggacgaggac

SEQ ID NO: 3713 - RNA, 24 nt, Artificial Sequence
  Synthetic
gaugcggacgacgaggacgaggac

SEQ ID NO: 3714 - RNA, 18 nt, Artificial Sequence
  Synthetic
ggccggucgccaggggac

SEQ ID NO: 3715 - RNA, 19 nt, Artificial Sequence
  Synthetic
gggccggucgccaggggac

SEQ ID NO: 3716 - RNA, 20 nt, Artificial Sequence
  Synthetic
agggccggucgccaggggac

SEQ ID NO: 3717 - RNA, 21 nt, Artificial Sequence
  Synthetic
gagggccggucgccaggggac

SEQ ID NO: 3718 - RNA, 22 nt, Artificial Sequence
  Synthetic
ugagggccggucgccaggggac

SEQ ID NO: 3719 - RNA, 23 nt, Artificial Sequence
  Synthetic
augagggccggucgccaggggac

SEQ ID NO: 3720 - RNA, 24 nt, Artificial Sequence
  Synthetic
caugagggccggucgccaggggac

SEQ ID NO: 3721 - RNA, 18 nt, Artificial Sequence
  Synthetic
cgguacucgcgcggggac

SEQ ID NO: 3722 - RNA, 19 nt, Artificial Sequence
  Synthetic
gcgguacucgcgcggggac

SEQ ID NO: 3723 - RNA, 20 nt, Artificial Sequence
  Synthetic
ggcgguacucgcgcggggac

SEQ ID NO: 3724 - RNA, 21 nt, Artificial Sequence
  Synthetic
cggcgguacucgcgcggggac

SEQ ID NO: 3725 - RNA, 22 nt, Artificial Sequence
  Synthetic
ccggcgguacucgcgcggggac

SEQ ID NO: 3726 - RNA, 23 nt, Artificial Sequence
  Synthetic
cccggcgguacucgcgcggggac

SEQ ID NO: 3727 - RNA, 24 nt, Artificial Sequence
  Synthetic
gcccggcgguacucgcgcggggac

SEQ ID NO: 3728 - RNA, 18 nt, Artificial Sequence
  Synthetic
cgccccagcgccacguac

SEQ ID NO: 3729 - RNA, 19 nt, Artificial Sequence
  Synthetic
gcgccccagcgccacguac

SEQ ID NO: 3730 - RNA, 20 nt, Artificial Sequence
  Synthetic
cgcgccccagcgccacguac

SEQ ID NO: 3731 - RNA, 21 nt, Artificial Sequence
  Synthetic
ucgcgccccagcgccacguac

SEQ ID NO: 3732 - RNA, 22 nt, Artificial Sequence
  Synthetic
cucgcgccccagcgccacguac

SEQ ID NO: 3733 - RNA, 23 nt, Artificial Sequence
  Synthetic
ccucgcgccccagcgccacguac

SEQ ID NO: 3734 - RNA, 24 nt, Artificial Sequence
  Synthetic
gccucgcgccccagcgccacguac

SEQ ID NO: 3735 - RNA, 18 nt, Artificial Sequence
  Synthetic
gcgugcugccgcgacacc

SEQ ID NO: 3736 - RNA, 19 nt, Artificial Sequence
  Synthetic
ggcgugcugccgcgacacc

SEQ ID NO: 3737 - RNA, 20 nt, Artificial Sequence
  Synthetic
aggcgugcugccgcgacacc

SEQ ID NO: 3738 - RNA, 21 nt, Artificial Sequence
  Synthetic
uaggcgugcugccgcgacacc

SEQ ID NO: 3739 - RNA, 22 nt, Artificial Sequence
  Synthetic
guaggcgugcugccgcgacacc

SEQ ID NO: 3740 - RNA, 23 nt, Artificial Sequence
  Synthetic
gguaggcgugcugccgcgacacc

SEQ ID NO: 3741 - RNA, 24 nt, Artificial Sequence
  Synthetic
agguaggcgugcugccgcgacacc

SEQ ID NO: 3742 - RNA, 18 nt, Artificial Sequence
  Synthetic
ccacgcgcgcgaagaccc

SEQ ID NO: 3743 - RNA, 19 nt, Artificial Sequence
  Synthetic
uccacgcgcgcgaagaccc

SEQ ID NO: 3744 - RNA, 20 nt, Artificial Sequence
  Synthetic
cuccacgcgcgcgaagaccc

SEQ ID NO: 3745 - RNA, 21 nt, Artificial Sequence
  Synthetic
ccuccacgcgcgcgaagaccc

SEQ ID NO: 3746 - RNA, 22 nt, Artificial Sequence
  Synthetic
gccuccacgcgcgcgaagaccc

SEQ ID NO: 3747 - RNA, 23 nt, Artificial Sequence
  Synthetic
ggccuccacgcgcgcgaagaccc

SEQ ID NO: 3748 - RNA, 24 nt, Artificial Sequence
  Synthetic
cggccuccacgcgcgcgaagaccc

SEQ ID NO: 3749 - RNA, 18 nt, Artificial Sequence
  Synthetic
ucggggucgucgcccccc

SEQ ID NO: 3750 - RNA, 19 nt, Artificial Sequence
  Synthetic
gucggggucgucgcccccc

SEQ ID NO: 3751 - RNA, 20 nt, Artificial Sequence
  Synthetic
cgucggggucgucgcccccc

SEQ ID NO: 3752 - RNA, 21 nt, Artificial Sequence
  Synthetic
gcgucggggucgucgcccccc

SEQ ID NO: 3753 - RNA, 22 nt, Artificial Sequence
  Synthetic
ggcgucggggucgucgcccccc

SEQ ID NO: 3754 - RNA, 23 nt, Artificial Sequence
  Synthetic
cggcgucggggucgucgcccccc

SEQ ID NO: 3755 - RNA, 24 nt, Artificial Sequence
  Synthetic
gcggcgucggggucgucgcccccc

SEQ ID NO: 3756 - RNA, 18 nt, Artificial Sequence
  Synthetic
uccgccucgggcgccccc

SEQ ID NO: 3757 - RNA, 19 nt, Artificial Sequence
  Synthetic
cuccgccucgggcgccccc

SEQ ID NO: 3758 - RNA, 20 nt, Artificial Sequence
  Synthetic
ccuccgccucgggcgccccc

SEQ ID NO: 3759 - RNA, 21 nt, Artificial Sequence
  Synthetic
uccuccgccucgggcgccccc

SEQ ID NO: 3760 - RNA, 22 nt, Artificial Sequence
  Synthetic
cuccuccgccucgggcgccccc

SEQ ID NO: 3761 - RNA, 23 nt, Artificial Sequence
  Synthetic
ccuccuccgccucgggcgccccc

SEQ ID NO: 3762 - RNA, 24 nt, Artificial Sequence
  Synthetic
gccuccuccgccucgggcgccccc

SEQ ID NO: 3763 - RNA, 18 nt, Artificial Sequence
  Synthetic
accacuccggcggccccc

SEQ ID NO: 3764 - RNA, 19 nt, Artificial Sequence
  Synthetic
gaccacuccggcggccccc

SEQ ID NO: 3765 - RNA, 20 nt, Artificial Sequence
  Synthetic
ggaccacuccggcggccccc

SEQ ID NO: 3766 - RNA, 21 nt, Artificial Sequence
  Synthetic
cggaccacuccggcggccccc

SEQ ID NO: 3767 - RNA, 22 nt, Artificial Sequence
  Synthetic
gcggaccacuccggcggccccc

SEQ ID NO: 3768 - RNA, 23 nt, Artificial Sequence
  Synthetic
ggcggaccacuccggcggccccc

SEQ ID NO: 3769 - RNA, 24 nt, Artificial Sequence
  Synthetic
cggcggaccacuccggcggccccc

SEQ ID NO: 3770 - RNA, 18 nt, Artificial Sequence
  Synthetic
ccguacagcacccgcccc

SEQ ID NO: 3771 - RNA, 19 nt, Artificial Sequence
  Synthetic
gccguacagcacccgcccc

SEQ ID NO: 3772 - RNA, 20 nt, Artificial Sequence
  Synthetic
cgccguacagcacccgcccc

SEQ ID NO: 3773 - RNA, 21 nt, Artificial Sequence
  Synthetic
ccgccguacagcacccgcccc

SEQ ID NO: 3774 - RNA, 22 nt, Artificial Sequence
  Synthetic
gccgccguacagcacccgcccc

SEQ ID NO: 3775 - RNA, 23 nt, Artificial Sequence
  Synthetic
ggccgccguacagcacccgcccc

SEQ ID NO: 3776 - RNA, 24 nt, Artificial Sequence
  Synthetic
aggccgccguacagcacccgcccc

SEQ ID NO: 3777 - RNA, 18 nt, Artificial Sequence
  Synthetic
gcggcccccggcggcccc

SEQ ID NO: 3778 - RNA, 19 nt, Artificial Sequence
  Synthetic
ggcggcccccggcggcccc

SEQ ID NO: 3779 - RNA, 20 nt, Artificial Sequence
  Synthetic
aggcggcccccggcggcccc

SEQ ID NO: 3780 - RNA, 21 nt, Artificial Sequence
  Synthetic
gaggcggcccccggcggcccc

SEQ ID NO: 3781 - RNA, 22 nt, Artificial Sequence
  Synthetic
agaggcggcccccggcggcccc

SEQ ID NO: 3782 - RNA, 23 nt, Artificial Sequence
  Synthetic
aagaggcggcccccggcggcccc

SEQ ID NO: 3783 - RNA, 24 nt, Artificial Sequence
  Synthetic
aaagaggcggcccccggcggcccc

SEQ ID NO: 3784 - RNA, 18 nt, Artificial Sequence
  Synthetic
ggggcgggcucgggcccc

SEQ ID NO: 3785 - RNA, 19 nt, Artificial Sequence
  Synthetic
gggggcgggcucgggcccc

SEQ ID NO: 3786 - RNA, 20 nt, Artificial Sequence
  Synthetic
cgggggcgggcucgggcccc

SEQ ID NO: 3787 - RNA, 21 nt, Artificial Sequence
  Synthetic
gcgggggcgggcucgggcccc

SEQ ID NO: 3788 - RNA, 22 nt, Artificial Sequence
  Synthetic
ggcgggggcgggcucgggcccc

SEQ ID NO: 3789 - RNA, 23 nt, Artificial Sequence
  Synthetic
gggcgggggcgggcucgggcccc

SEQ ID NO: 3790 - RNA, 24 nt, Artificial Sequence
  Synthetic
ugggcgggggcgggcucgggcccc

SEQ ID NO: 3791 - RNA, 18 nt, Artificial Sequence
  Synthetic
gccguguggcugggcccc

SEQ ID NO: 3792 - RNA, 19 nt, Artificial Sequence
  Synthetic
cgccguguggcugggcccc

SEQ ID NO: 3793 - RNA, 20 nt, Artificial Sequence
  Synthetic
ccgccguguggcugggcccc

SEQ ID NO: 3794 - RNA, 21 nt, Artificial Sequence
  Synthetic
gccgccguguggcugggcccc

SEQ ID NO: 3795 - RNA, 22 nt, Artificial Sequence
  Synthetic
cgccgccguguggcugggcccc

SEQ ID NO: 3796 - RNA, 23 nt, Artificial Sequence
  Synthetic
gcgccgccguguggcugggcccc

SEQ ID NO: 3797 - RNA, 24 nt, Artificial Sequence
  Synthetic
ggcgccgccguguggcugggcccc

SEQ ID NO: 3798 - RNA, 18 nt, Artificial Sequence
  Synthetic
guccagcgccacgucccc

SEQ ID NO: 3799 - RNA, 19 nt, Artificial Sequence
  Synthetic
gguccagcgccacgucccc

SEQ ID NO: 3800 - RNA, 20 nt, Artificial Sequence
  Synthetic
ugguccagcgccacgucccc

SEQ ID NO: 3801 - RNA, 21 nt, Artificial Sequence
  Synthetic
cugguccagcgccacgucccc

SEQ ID NO: 3802 - RNA, 22 nt, Artificial Sequence
  Synthetic
ccugguccagcgccacgucccc

SEQ ID NO: 3803 - RNA, 23 nt, Artificial Sequence
  Synthetic
gccugguccagcgccacgucccc

SEQ ID NO: 3804 - RNA, 24 nt, Artificial Sequence
  Synthetic
ggccugguccagcgccacgucccc

SEQ ID NO: 3805 - RNA, 18 nt, Artificial Sequence
  Synthetic
ccgggccccggccagccc

SEQ ID NO: 3806 - RNA, 19 nt, Artificial Sequence
  Synthetic
gccgggccccggccagccc

SEQ ID NO: 3807 - RNA, 20 nt, Artificial Sequence
  Synthetic
ggccgggccccggccagccc

SEQ ID NO: 3808 - RNA, 21 nt, Artificial Sequence
  Synthetic
gggccgggccccggccagccc

SEQ ID NO: 3809 - RNA, 22 nt, Artificial Sequence
  Synthetic
cgggccgggccccggccagccc

SEQ ID NO: 3810 - RNA, 23 nt, Artificial Sequence
  Synthetic
gcgggccgggccccggccagccc

SEQ ID NO: 3811 - RNA, 24 nt, Artificial Sequence
  Synthetic
ggcgggccgggccccggccagccc

SEQ ID NO: 3812 - RNA, 18 nt, Artificial Sequence
  Synthetic
ggcgcuggcgagcagccc

SEQ ID NO: 3813 - RNA, 19 nt, Artificial Sequence
  Synthetic
cggcgcuggcgagcagccc

SEQ ID NO: 3814 - RNA, 20 nt, Artificial Sequence
  Synthetic
ccggcgcuggcgagcagccc

SEQ ID NO: 3815 - RNA, 21 nt, Artificial Sequence
  Synthetic
gccggcgcuggcgagcagccc

SEQ ID NO: 3816 - RNA, 22 nt, Artificial Sequence
  Synthetic
cgccggcgcuggcgagcagccc

SEQ ID NO: 3817 - RNA, 23 nt, Artificial Sequence
  Synthetic
ucgccggcgcuggcgagcagccc

SEQ ID NO: 3818 - RNA, 24 nt, Artificial Sequence
  Synthetic
gucgccggcgcuggcgagcagccc

SEQ ID NO: 3819 - RNA, 18 nt, Artificial Sequence
  Synthetic
gccguacagcacccgccc

SEQ ID NO: 3820 - RNA, 19 nt, Artificial Sequence
  Synthetic
cgccguacagcacccgccc

SEQ ID NO: 3821 - RNA, 20 nt, Artificial Sequence
  Synthetic
ccgccguacagcacccgccc

SEQ ID NO: 3822 - RNA, 21 nt, Artificial Sequence
  Synthetic
gccgccguacagcacccgccc

SEQ ID NO: 3823 - RNA, 22 nt, Artificial Sequence
  Synthetic
ggccgccguacagcacccgccc

SEQ ID NO: 3824 - RNA, 23 nt, Artificial Sequence
  Synthetic
aggccgccguacagcacccgccc

SEQ ID NO: 3825 - RNA, 24 nt, Artificial Sequence
  Synthetic
caggccgccguacagcacccgccc

SEQ ID NO: 3826 - RNA, 18 nt, Artificial Sequence
  Synthetic
cgcggcggacagccgccc

SEQ ID NO: 3827 - RNA, 19 nt, Artificial Sequence
  Synthetic
gcgcggcggacagccgccc

SEQ ID NO: 3828 - RNA, 20 nt, Artificial Sequence
  Synthetic
ggcgcggcggacagccgccc

SEQ ID NO: 3829 - RNA, 21 nt, Artificial Sequence
  Synthetic
gggcgcggcggacagccgccc

SEQ ID NO: 3830 - RNA, 22 nt, Artificial Sequence
  Synthetic
cgggcgcggcggacagccgccc

SEQ ID NO: 3831 - RNA, 23 nt, Artificial Sequence
  Synthetic
gcgggcgcggcggacagccgccc

SEQ ID NO: 3832 - RNA, 24 nt, Artificial Sequence
  Synthetic
ggcgggcgcggcggacagccgccc

SEQ ID NO: 3833 - RNA, 18 nt, Artificial Sequence
  Synthetic
ugccgccgccagccgccc

SEQ ID NO: 3834 - RNA, 19 nt, Artificial Sequence
  Synthetic
cugccgccgccagccgccc

SEQ ID NO: 3835 - RNA, 20 nt, Artificial Sequence
  Synthetic
gcugccgccgccagccgccc

SEQ ID NO: 3836 - RNA, 21 nt, Artificial Sequence
  Synthetic
ggcugccgccgccagccgccc

SEQ ID NO: 3837 - RNA, 22 nt, Artificial Sequence
  Synthetic
gggcugccgccgccagccgccc

SEQ ID NO: 3838 - RNA, 23 nt, Artificial Sequence
  Synthetic
ggggcugccgccgccagccgccc

SEQ ID NO: 3839 - RNA, 24 nt, Artificial Sequence
  Synthetic
gggggcugccgccgccagccgccc

SEQ ID NO: 3840 - RNA, 18 nt, Artificial Sequence
  Synthetic
cgggggcggcguccgccc

SEQ ID NO: 3841 - RNA, 19 nt, Artificial Sequence
  Synthetic
gcgggggcggcguccgccc

SEQ ID NO: 3842 - RNA, 20 nt, Artificial Sequence
  Synthetic
ggcgggggcggcguccgccc

SEQ ID NO: 3843 - RNA, 21 nt, Artificial Sequence
  Synthetic
gggcgggggcggcguccgccc

SEQ ID NO: 3844 - RNA, 22 nt, Artificial Sequence
  Synthetic
cgggcgggggcggcguccgccc

SEQ ID NO: 3845 - RNA, 23 nt, Artificial Sequence
  Synthetic
ccgggcgggggcggcguccgccc

SEQ ID NO: 3846 - RNA, 24 nt, Artificial Sequence
  Synthetic
cccgggcgggggcggcguccgccc

SEQ ID NO: 3847 - RNA, 18 nt, Artificial Sequence
  Synthetic
cggcgcucgaugcggccc

SEQ ID NO: 3848 - RNA, 19 nt, Artificial Sequence
  Synthetic
gcggcgcucgaugcggccc

SEQ ID NO: 3849 - RNA, 20 nt, Artificial Sequence
  Synthetic
ggcggcgcucgaugcggccc

SEQ ID NO: 3850 - RNA, 21 nt, Artificial Sequence
  Synthetic
cggcggcgcucgaugcggccc

SEQ ID NO: 3851 - RNA, 22 nt, Artificial Sequence
  Synthetic
ccggcggcgcucgaugcggccc

SEQ ID NO: 3852 - RNA, 23 nt, Artificial Sequence
  Synthetic
cccggcggcgcucgaugcggccc

SEQ ID NO: 3853 - RNA, 24 nt, Artificial Sequence
  Synthetic
gcccggcggcgcucgaugcggccc

SEQ ID NO: 3854 - RNA, 18 nt, Artificial Sequence
  Synthetic
gcgccggcggcagggccc

SEQ ID NO: 3855 - RNA, 19 nt, Artificial Sequence
  Synthetic
ggcgccggcggcagggccc

SEQ ID NO: 3856 - RNA, 20 nt, Artificial Sequence
  Synthetic
cggcgccggcggcagggccc

SEQ ID NO: 3857 - RNA, 21 nt, Artificial Sequence
  Synthetic
gcggcgccggcggcagggccc

SEQ ID NO: 3858 - RNA, 22 nt, Artificial Sequence
  Synthetic
ggcggcgccggcggcagggccc

SEQ ID NO: 3859 - RNA, 23 nt, Artificial Sequence
  Synthetic
gggcggcgccggcggcagggccc

SEQ ID NO: 3860 - RNA, 24 nt, Artificial Sequence
  Synthetic
cgggcggcgccggcggcagggccc

SEQ ID NO: 3861 - RNA, 18 nt, Artificial Sequence
  Synthetic
gggggcgggcucgggccc

SEQ ID NO: 3862 - RNA, 19 nt, Artificial Sequence
  Synthetic
cgggggcgggcucgggccc

SEQ ID NO: 3863 - RNA, 20 nt, Artificial Sequence
  Synthetic
gcgggggcgggcucgggccc

SEQ ID NO: 3864 - RNA, 21 nt, Artificial Sequence
  Synthetic
ggcgggggcgggcucgggccc

SEQ ID NO: 3865 - RNA, 22 nt, Artificial Sequence
  Synthetic
gggcgggggcgggcucgggccc

SEQ ID NO: 3866 - RNA, 23 nt, Artificial Sequence
  Synthetic
ugggcgggggcgggcucgggccc

SEQ ID NO: 3867 - RNA, 24 nt, Artificial Sequence
  Synthetic
cugggcgggggcgggcucgggccc

SEQ ID NO: 3868 - RNA, 18 nt, Artificial Sequence
  Synthetic
cgccguguggcugggccc

SEQ ID NO: 3869 - RNA, 19 nt, Artificial Sequence
  Synthetic
ccgccguguggcugggccc

SEQ ID NO: 3870 - RNA, 20 nt, Artificial Sequence
  Synthetic
gccgccguguggcugggccc

SEQ ID NO: 3871 - RNA, 21 nt, Artificial Sequence
  Synthetic
cgccgccguguggcugggccc

SEQ ID NO: 3872 - RNA, 22 nt, Artificial Sequence
  Synthetic
gcgccgccguguggcugggccc

SEQ ID NO: 3873 - RNA, 23 nt, Artificial Sequence
  Synthetic
ggcgccgccguguggcugggccc

SEQ ID NO: 3874 - RNA, 24 nt, Artificial Sequence
  Synthetic
gggcgccgccguguggcugggccc

SEQ ID NO: 3875 - RNA, 18 nt, Artificial Sequence
  Synthetic
gguccagcgccacguccc

SEQ ID NO: 3876 - RNA, 19 nt, Artificial Sequence
  Synthetic
ugguccagcgccacguccc

SEQ ID NO: 3877 - RNA, 20 nt, Artificial Sequence
  Synthetic
cugguccagcgccacguccc

SEQ ID NO: 3878 - RNA, 21 nt, Artificial Sequence
  Synthetic
ccugguccagcgccacguccc

SEQ ID NO: 3879 - RNA, 22 nt, Artificial Sequence
  Synthetic
gccugguccagcgccacguccc

SEQ ID NO: 3880 - RNA, 23 nt, Artificial Sequence
  Synthetic
ggccugguccagcgccacguccc

SEQ ID NO: 3881 - RNA, 24 nt, Artificial Sequence
  Synthetic
aggccugguccagcgccacguccc

SEQ ID NO: 3882 - RNA, 18 nt, Artificial Sequence
  Synthetic
gccgggccccggccagcc

SEQ ID NO: 3883 - RNA, 19 nt, Artificial Sequence
  Synthetic
ggccgggccccggccagcc

SEQ ID NO: 3884 - RNA, 20 nt, Artificial Sequence
  Synthetic
gggccgggccccggccagcc

SEQ ID NO: 3885 - RNA, 21 nt, Artificial Sequence
  Synthetic
cgggccgggccccggccagcc

SEQ ID NO: 3886 - RNA, 22 nt, Artificial Sequence
  Synthetic
gcgggccgggccccggccagcc

SEQ ID NO: 3887 - RNA, 23 nt, Artificial Sequence
  Synthetic
ggcgggccgggccccggccagcc

SEQ ID NO: 3888 - RNA, 24 nt, Artificial Sequence
  Synthetic
uggcgggccgggccccggccagcc

SEQ ID NO: 3889 - RNA, 18 nt, Artificial Sequence
  Synthetic
ggcgcgggcguccgagcc

SEQ ID NO: 3890 - RNA, 19 nt, Artificial Sequence
  Synthetic
gggcgcgggcguccgagcc

SEQ ID NO: 3891 - RNA, 20 nt, Artificial Sequence
  Synthetic
ggggcgcgggcguccgagcc

SEQ ID NO: 3892 - RNA, 21 nt, Artificial Sequence
  Synthetic
gggggcgcgggcguccgagcc

SEQ ID NO: 3893 - RNA, 22 nt, Artificial Sequence
  Synthetic
ggggggcgcgggcguccgagcc

SEQ ID NO: 3894 - RNA, 23 nt, Artificial Sequence
  Synthetic
aggggggcgcgggcguccgagcc

SEQ ID NO: 3895 - RNA, 24 nt, Artificial Sequence
  Synthetic
gaggggggcgcgggcguccgagcc

SEQ ID NO: 3896 - RNA, 18 nt, Artificial Sequence
  Synthetic
cgccguacagcacccgcc

SEQ ID NO: 3897 - RNA, 19 nt, Artificial Sequence
  Synthetic
ccgccguacagcacccgcc

SEQ ID NO: 3898 - RNA, 20 nt, Artificial Sequence
  Synthetic
gccgccguacagcacccgcc

SEQ ID NO: 3899 - RNA, 21 nt, Artificial Sequence
  Synthetic
ggccgccguacagcacccgcc

SEQ ID NO: 3900 - RNA, 22 nt, Artificial Sequence
  Synthetic
aggccgccguacagcacccgcc

SEQ ID NO: 3901 - RNA, 23 nt, Artificial Sequence
  Synthetic
caggccgccguacagcacccgcc

SEQ ID NO: 3902 - RNA, 24 nt, Artificial Sequence
  Synthetic
ccaggccgccguacagcacccgcc

SEQ ID NO: 3903 - RNA, 18 nt, Artificial Sequence
  Synthetic
aguccacaacuucccgcc

SEQ ID NO: 3904 - RNA, 19 nt, Artificial Sequence
  Synthetic
caguccacaacuucccgcc

SEQ ID NO: 3905 - RNA, 20 nt, Artificial Sequence
  Synthetic
ccaguccacaacuucccgcc

SEQ ID NO: 3906 - RNA, 21 nt, Artificial Sequence
  Synthetic
cccaguccacaacuucccgcc

SEQ ID NO: 3907 - RNA, 22 nt, Artificial Sequence
  Synthetic
ucccaguccacaacuucccgcc

SEQ ID NO: 3908 - RNA, 23 nt, Artificial Sequence
  Synthetic
uucccaguccacaacuucccgcc

SEQ ID NO: 3909 - RNA, 24 nt, Artificial Sequence
  Synthetic
cuucccaguccacaacuucccgcc

SEQ ID NO: 3910 - RNA, 18 nt, Artificial Sequence
  Synthetic
cugccgccgccagccgcc

SEQ ID NO: 3911 - RNA, 19 nt, Artificial Sequence
  Synthetic
gcugccgccgccagccgcc

SEQ ID NO: 3912 - RNA, 20 nt, Artificial Sequence
  Synthetic
ggcugccgccgccagccgcc

SEQ ID NO: 3913 - RNA, 21 nt, Artificial Sequence
  Synthetic
gggcugccgccgccagccgcc

SEQ ID NO: 3914 - RNA, 22 nt, Artificial Sequence
  Synthetic
ggggcugccgccgccagccgcc

SEQ ID NO: 3915 - RNA, 23 nt, Artificial Sequence
  Synthetic
gggggcugccgccgccagccgcc

SEQ ID NO: 3916 - RNA, 24 nt, Artificial Sequence
  Synthetic
cgggggcugccgccgccagccgcc

SEQ ID NO: 3917 - RNA, 18 nt, Artificial Sequence
  Synthetic
gggguccucgccgccgcc

SEQ ID NO: 3918 - RNA, 19 nt, Artificial Sequence
  Synthetic
ggggguccucgccgccgcc

SEQ ID NO: 3919 - RNA, 20 nt, Artificial Sequence
  Synthetic
cggggguccucgccgccgcc

SEQ ID NO: 3920 - RNA, 21 nt, Artificial Sequence
  Synthetic
gcggggguccucgccgccgcc

SEQ ID NO: 3921 - RNA, 22 nt, Artificial Sequence
  Synthetic
cgcggggguccucgccgccgcc

SEQ ID NO: 3922 - RNA, 23 nt, Artificial Sequence
  Synthetic
ccgcggggguccucgccgccgcc

SEQ ID NO: 3923 - RNA, 24 nt, Artificial Sequence
  Synthetic
gccgcggggguccucgccgccgcc

SEQ ID NO: 3924 - RNA, 18 nt, Artificial Sequence
  Synthetic
cgucgcgccuccuccgcc

SEQ ID NO: 3925 - RNA, 19 nt, Artificial Sequence
  Synthetic
gcgucgcgccuccuccgcc

SEQ ID NO: 3926 - RNA, 20 nt, Artificial Sequence
  Synthetic
ggcgucgcgccuccuccgcc

SEQ ID NO: 3927 - RNA, 21 nt, Artificial Sequence
  Synthetic
cggcgucgcgccuccuccgcc

SEQ ID NO: 3928 - RNA, 22 nt, Artificial Sequence
  Synthetic
ccggcgucgcgccuccuccgcc

SEQ ID NO: 3929 - RNA, 23 nt, Artificial Sequence
  Synthetic
accggcgucgcgccuccuccgcc

SEQ ID NO: 3930 - RNA, 24 nt, Artificial Sequence
  Synthetic
aaccggcgucgcgccuccuccgcc

SEQ ID NO: 3931 - RNA, 18 nt, Artificial Sequence
  Synthetic
gcgggggcggcguccgcc

SEQ ID NO: 3932 - RNA, 19 nt, Artificial Sequence
  Synthetic
ggcgggggcggcguccgcc

SEQ ID NO: 3933 - RNA, 20 nt, Artificial Sequence
  Synthetic
gggcgggggcggcguccgcc

SEQ ID NO: 3934 - RNA, 21 nt, Artificial Sequence
  Synthetic
cgggcgggggcggcguccgcc

SEQ ID NO: 3935 - RNA, 22 nt, Artificial Sequence
  Synthetic
ccgggcgggggcggcguccgcc

SEQ ID NO: 3936 - RNA, 23 nt, Artificial Sequence
  Synthetic
cccgggcgggggcggcguccgcc

SEQ ID NO: 3937 - RNA, 24 nt, Artificial Sequence
  Synthetic
gcccgggcgggggcggcguccgcc

SEQ ID NO: 3938 - RNA, 18 nt, Artificial Sequence
  Synthetic
gcggcggcccggggcgcc

SEQ ID NO: 3939 - RNA, 19 nt, Artificial Sequence
  Synthetic
cgcggcggcccggggcgcc

SEQ ID NO: 3940 - RNA, 20 nt, Artificial Sequence
  Synthetic
ccgcggcggcccggggcgcc

SEQ ID NO: 3941 - RNA, 21 nt, Artificial Sequence
  Synthetic
gccgcggcggcccggggcgcc

SEQ ID NO: 3942 - RNA, 22 nt, Artificial Sequence
  Synthetic
cgccgcggcggcccggggcgcc

SEQ ID NO: 3943 - RNA, 23 nt, Artificial Sequence
  Synthetic
gcgccgcggcggcccggggcgcc

SEQ ID NO: 3944 - RNA, 24 nt, Artificial Sequence
  Synthetic
ugcgccgcggcggcccggggcgcc

SEQ ID NO: 3945 - RNA, 18 nt, Artificial Sequence
  Synthetic
acaugagggccggucgcc

SEQ ID NO: 3946 - RNA, 19 nt, Artificial Sequence
  Synthetic
aacaugagggccggucgcc

SEQ ID NO: 3947 - RNA, 20 nt, Artificial Sequence
  Synthetic
aaacaugagggccggucgcc

SEQ ID NO: 3948 - RNA, 21 nt, Artificial Sequence
  Synthetic
caaacaugagggccggucgcc

SEQ ID NO: 3949 - RNA, 22 nt, Artificial Sequence
  Synthetic
ucaaacaugagggccggucgcc

SEQ ID NO: 3950 - RNA, 23 nt, Artificial Sequence
  Synthetic
gucaaacaugagggccggucgcc

SEQ ID NO: 3951 - RNA, 24 nt, Artificial Sequence
  Synthetic
ggucaaacaugagggccggucgcc

SEQ ID NO: 3952 - RNA, 18 nt, Artificial Sequence
  Synthetic
gccggggcgcccgaggcc

SEQ ID NO: 3953 - RNA, 19 nt, Artificial Sequence
  Synthetic
cgccggggcgcccgaggcc

SEQ ID NO: 3954 - RNA, 20 nt, Artificial Sequence
  Synthetic
ccgccggggcgcccgaggcc

SEQ ID NO: 3955 - RNA, 21 nt, Artificial Sequence
  Synthetic
gccgccggggcgcccgaggcc

SEQ ID NO: 3956 - RNA, 22 nt, Artificial Sequence
  Synthetic
ggccgccggggcgcccgaggcc

SEQ ID NO: 3957 - RNA, 23 nt, Artificial Sequence
  Synthetic
cggccgccggggcgcccgaggcc

SEQ ID NO: 3958 - RNA, 24 nt, Artificial Sequence
  Synthetic
acggccgccggggcgcccgaggcc

SEQ ID NO: 3959 - RNA, 18 nt, Artificial Sequence
  Synthetic
augcggcccgcggaggcc

SEQ ID NO: 3960 - RNA, 19 nt, Artificial Sequence
  Synthetic
gaugcggcccgcggaggcc

SEQ ID NO: 3961 - RNA, 20 nt, Artificial Sequence
  Synthetic
cgaugcggcccgcggaggcc

SEQ ID NO: 3962 - RNA, 21 nt, Artificial Sequence
  Synthetic
ucgaugcggcccgcggaggcc

SEQ ID NO: 3963 - RNA, 22 nt, Artificial Sequence
  Synthetic
cucgaugcggcccgcggaggcc

SEQ ID NO: 3964 - RNA, 23 nt, Artificial Sequence
  Synthetic
gcucgaugcggcccgcggaggcc

SEQ ID NO: 3965 - RNA, 24 nt, Artificial Sequence
  Synthetic
cgcucgaugcggcccgcggaggcc

SEQ ID NO: 3966 - RNA, 18 nt, Artificial Sequence
  Synthetic
ggccggcgcgacacggcc

SEQ ID NO: 3967 - RNA, 19 nt, Artificial Sequence
  Synthetic
gggccggcgcgacacggcc

SEQ ID NO: 3968 - RNA, 20 nt, Artificial Sequence
  Synthetic
cgggccggcgcgacacggcc

SEQ ID NO: 3969 - RNA, 21 nt, Artificial Sequence
  Synthetic
gcgggccggcgcgacacggcc

SEQ ID NO: 3970 - RNA, 22 nt, Artificial Sequence
  Synthetic
ggcgggccggcgcgacacggcc

SEQ ID NO: 3971 - RNA, 23 nt, Artificial Sequence
  Synthetic
cggcgggccggcgcgacacggcc

SEQ ID NO: 3972 - RNA, 24 nt, Artificial Sequence
  Synthetic
ucggcgggccggcgcgacacggcc

SEQ ID NO: 3973 - RNA, 18 nt, Artificial Sequence
  Synthetic
cgccggggcugcccggcc

SEQ ID NO: 3974 - RNA, 19 nt, Artificial Sequence
  Synthetic
ccgccggggcugcccggcc

SEQ ID NO: 3975 - RNA, 20 nt, Artificial Sequence
  Synthetic
cccgccggggcugcccggcc

SEQ ID NO: 3976 - RNA, 21 nt, Artificial Sequence
  Synthetic
acccgccggggcugcccggcc

SEQ ID NO: 3977 - RNA, 22 nt, Artificial Sequence
  Synthetic
gacccgccggggcugcccggcc

SEQ ID NO: 3978 - RNA, 23 nt, Artificial Sequence
  Synthetic
cgacccgccggggcugcccggcc

SEQ ID NO: 3979 - RNA, 24 nt, Artificial Sequence
  Synthetic
ucgacccgccggggcugcccggcc

SEQ ID NO: 3980 - RNA, 18 nt, Artificial Sequence
  Synthetic
ccgcgggucccuccggcc

SEQ ID NO: 3981 - RNA, 19 nt, Artificial Sequence
  Synthetic
cccgcgggucccuccggcc

SEQ ID NO: 3982 - RNA, 20 nt, Artificial Sequence
  Synthetic
gcccgcgggucccuccggcc

SEQ ID NO: 3983 - RNA, 21 nt, Artificial Sequence
  Synthetic
ggcccgcgggucccuccggcc

SEQ ID NO: 3984 - RNA, 22 nt, Artificial Sequence
  Synthetic
gggcccgcgggucccuccggcc

SEQ ID NO: 3985 - RNA, 23 nt, Artificial Sequence
  Synthetic
ggggcccgcgggucccuccggcc

SEQ ID NO: 3986 - RNA, 24 nt, Artificial Sequence
  Synthetic
cggggcccgcgggucccuccggcc

SEQ ID NO: 3987 - RNA, 18 nt, Artificial Sequence
  Synthetic
cggggcuugggcgcggcc

SEQ ID NO: 3988 - RNA, 19 nt, Artificial Sequence
  Synthetic
ccggggcuugggcgcggcc

SEQ ID NO: 3989 - RNA, 20 nt, Artificial Sequence
  Synthetic
cccggggcuugggcgcggcc

SEQ ID NO: 3990 - RNA, 21 nt, Artificial Sequence
  Synthetic
gcccggggcuugggcgcggcc

SEQ ID NO: 3991 - RNA, 22 nt, Artificial Sequence
  Synthetic
cgcccggggcuugggcgcggcc

SEQ ID NO: 3992 - RNA, 23 nt, Artificial Sequence
  Synthetic
ccgcccggggcuugggcgcggcc

SEQ ID NO: 3993 - RNA, 24 nt, Artificial Sequence
  Synthetic
gccgcccggggcuugggcgcggcc

SEQ ID NO: 3994 - RNA, 18 nt, Artificial Sequence
  Synthetic
gccugcgccgcggcggcc

SEQ ID NO: 3995 - RNA, 19 nt, Artificial Sequence
  Synthetic
ggccugcgccgcggcggcc

SEQ ID NO: 3996 - RNA, 20 nt, Artificial Sequence
  Synthetic
gggccugcgccgcggcggcc

SEQ ID NO: 3997 - RNA, 21 nt, Artificial Sequence
  Synthetic
cgggccugcgccgcggcggcc

SEQ ID NO: 3998 - RNA, 22 nt, Artificial Sequence
  Synthetic
gcgggccugcgccgcggcggcc

SEQ ID NO: 3999 - RNA, 23 nt, Artificial Sequence
  Synthetic
ggcgggccugcgccgcggcggcc

SEQ ID NO: 4000 - RNA, 24 nt, Artificial Sequence
  Synthetic
gggcgggccugcgccgcggcggcc

SEQ ID NO: 4001 - RNA, 18 nt, Artificial Sequence
  Synthetic
uccgcggcggcggcggcc

SEQ ID NO: 4002 - RNA, 19 nt, Artificial Sequence
  Synthetic
guccgcggcggcggcggcc

SEQ ID NO: 4003 - RNA, 20 nt, Artificial Sequence
  Synthetic
gguccgcggcggcggcggcc

SEQ ID NO: 4004 - RNA, 21 nt, Artificial Sequence
  Synthetic
agguccgcggcggcggcggcc

SEQ ID NO: 4005 - RNA, 22 nt, Artificial Sequence
  Synthetic
cagguccgcggcggcggcggcc

SEQ ID NO: 4006 - RNA, 23 nt, Artificial Sequence
  Synthetic
gcagguccgcggcggcggcggcc

SEQ ID NO: 4007 - RNA, 24 nt, Artificial Sequence
  Synthetic
agcagguccgcggcggcggcggcc

SEQ ID NO: 4008 - RNA, 18 nt, Artificial Sequence
  Synthetic
gccuccagggcggcggcc

SEQ ID NO: 4009 - RNA, 19 nt, Artificial Sequence
  Synthetic
ggccuccagggcggcggcc

SEQ ID NO: 4010 - RNA, 20 nt, Artificial Sequence
  Synthetic
aggccuccagggcggcggcc

SEQ ID NO: 4011 - RNA, 21 nt, Artificial Sequence
  Synthetic
uaggccuccagggcggcggcc

SEQ ID NO: 4012 - RNA, 22 nt, Artificial Sequence
  Synthetic
guaggccuccagggcggcggcc

SEQ ID NO: 4013 - RNA, 23 nt, Artificial Sequence
  Synthetic
aguaggccuccagggcggcggcc

SEQ ID NO: 4014 - RNA, 24 nt, Artificial Sequence
  Synthetic
caguaggccuccagggcggcggcc

SEQ ID NO: 4015 - RNA, 18 nt, Artificial Sequence
  Synthetic
cgggggcgggcucgggcc

SEQ ID NO: 4016 - RNA, 19 nt, Artificial Sequence
  Synthetic
gcgggggcgggcucgggcc

SEQ ID NO: 4017 - RNA, 20 nt, Artificial Sequence
  Synthetic
ggcgggggcgggcucgggcc

SEQ ID NO: 4018 - RNA, 21 nt, Artificial Sequence
  Synthetic
gggcgggggcgggcucgggcc

SEQ ID NO: 4019 - RNA, 22 nt, Artificial Sequence
  Synthetic
ugggcgggggcgggcucgggcc

SEQ ID NO: 4020 - RNA, 23 nt, Artificial Sequence
  Synthetic
cugggcgggggcgggcucgggcc

SEQ ID NO: 4021 - RNA, 24 nt, Artificial Sequence
  Synthetic
gcugggcgggggcgggcucgggcc

SEQ ID NO: 4022 - RNA, 18 nt, Artificial Sequence
  Synthetic
ccgcggcagcgcggggcc

SEQ ID NO: 4023 - RNA, 19 nt, Artificial Sequence
  Synthetic
cccgcggcagcgcggggcc

SEQ ID NO: 4024 - RNA, 20 nt, Artificial Sequence
  Synthetic
ucccgcggcagcgcggggcc

SEQ ID NO: 4025 - RNA, 21 nt, Artificial Sequence
  Synthetic
gucccgcggcagcgcggggcc

SEQ ID NO: 4026 - RNA, 22 nt, Artificial Sequence
  Synthetic
ggucccgcggcagcgcggggcc

SEQ ID NO: 4027 - RNA, 23 nt, Artificial Sequence
  Synthetic
gggucccgcggcagcgcggggcc

SEQ ID NO: 4028 - RNA, 24 nt, Artificial Sequence
  Synthetic
cgggucccgcggcagcgcggggcc

SEQ ID NO: 4029 - RNA, 18 nt, Artificial Sequence
  Synthetic
ccgccguguggcugggcc

SEQ ID NO: 4030 - RNA, 19 nt, Artificial Sequence
  Synthetic
gccgccguguggcugggcc

SEQ ID NO: 4031 - RNA, 20 nt, Artificial Sequence
  Synthetic
cgccgccguguggcugggcc

SEQ ID NO: 4032 - RNA, 21 nt, Artificial Sequence
  Synthetic
gcgccgccguguggcugggcc

SEQ ID NO: 4033 - RNA, 22 nt, Artificial Sequence
  Synthetic
ggcgccgccguguggcugggcc

SEQ ID NO: 4034 - RNA, 23 nt, Artificial Sequence
  Synthetic
gggcgccgccguguggcugggcc

SEQ ID NO: 4035 - RNA, 24 nt, Artificial Sequence
  Synthetic
cgggcgccgccguguggcugggcc

SEQ ID NO: 4036 - RNA, 18 nt, Artificial Sequence
  Synthetic
ugguccagcgccacgucc

SEQ ID NO: 4037 - RNA, 19 nt, Artificial Sequence
  Synthetic
cugguccagcgccacgucc

SEQ ID NO: 4038 - RNA, 20 nt, Artificial Sequence
  Synthetic
ccugguccagcgccacgucc

SEQ ID NO: 4039 - RNA, 21 nt, Artificial Sequence
  Synthetic
gccugguccagcgccacgucc

SEQ ID NO: 4040 - RNA, 22 nt, Artificial Sequence
  Synthetic
ggccugguccagcgccacgucc

SEQ ID NO: 4041 - RNA, 23 nt, Artificial Sequence
  Synthetic
aggccugguccagcgccacgucc

SEQ ID NO: 4042 - RNA, 24 nt, Artificial Sequence
  Synthetic
caggccugguccagcgccacgucc

SEQ ID NO: 4043 - RNA, 18 nt, Artificial Sequence
  Synthetic
accaccacgcgcacgucc

SEQ ID NO: 4044 - RNA, 19 nt, Artificial Sequence
  Synthetic
caccaccacgcgcacgucc

SEQ ID NO: 4045 - RNA, 20 nt, Artificial Sequence
  Synthetic
gcaccaccacgcgcacgucc

SEQ ID NO: 4046 - RNA, 21 nt, Artificial Sequence
  Synthetic
agcaccaccacgcgcacgucc

SEQ ID NO: 4047 - RNA, 22 nt, Artificial Sequence
  Synthetic
cagcaccaccacgcgcacgucc

SEQ ID NO: 4048 - RNA, 23 nt, Artificial Sequence
  Synthetic
acagcaccaccacgcgcacgucc

SEQ ID NO: 4049 - RNA, 24 nt, Artificial Sequence
  Synthetic
uacagcaccaccacgcgcacgucc

SEQ ID NO: 4050 - RNA, 18 nt, Artificial Sequence
  Synthetic
ccauggcgucgguggucc

SEQ ID NO: 4051 - RNA, 19 nt, Artificial Sequence
  Synthetic
gccauggcgucgguggucc

SEQ ID NO: 4052 - RNA, 20 nt, Artificial Sequence
  Synthetic
cgccauggcgucgguggucc

SEQ ID NO: 4053 - RNA, 21 nt, Artificial Sequence
  Synthetic
gcgccauggcgucgguggucc

SEQ ID NO: 4054 - RNA, 22 nt, Artificial Sequence
  Synthetic
ggcgccauggcgucgguggucc

SEQ ID NO: 4055 - RNA, 23 nt, Artificial Sequence
  Synthetic
gggcgccauggcgucgguggucc

SEQ ID NO: 4056 - RNA, 24 nt, Artificial Sequence
  Synthetic
cgggcgccauggcgucgguggucc

SEQ ID NO: 4057 - RNA, 18 nt, Artificial Sequence
  Synthetic
gggaacagcggguggucc

SEQ ID NO: 4058 - RNA, 19 nt, Artificial Sequence
  Synthetic
ggggaacagcggguggucc

SEQ ID NO: 4059 - RNA, 20 nt, Artificial Sequence
  Synthetic
cggggaacagcggguggucc

SEQ ID NO: 4060 - RNA, 21 nt, Artificial Sequence
  Synthetic
acggggaacagcggguggucc

SEQ ID NO: 4061 - RNA, 22 nt, Artificial Sequence
  Synthetic
gacggggaacagcggguggucc

SEQ ID NO: 4062 - RNA, 23 nt, Artificial Sequence
  Synthetic
ggacggggaacagcggguggucc

SEQ ID NO: 4063 - RNA, 24 nt, Artificial Sequence
  Synthetic
gggacggggaacagcggguggucc

SEQ ID NO: 4064 - RNA, 18 nt, Artificial Sequence
  Synthetic
ucgccgcgcagcaccagc

SEQ ID NO: 4065 - RNA, 19 nt, Artificial Sequence
  Synthetic
gucgccgcgcagcaccagc

SEQ ID NO: 4066 - RNA, 20 nt, Artificial Sequence
  Synthetic
cgucgccgcgcagcaccagc

SEQ ID NO: 4067 - RNA, 21 nt, Artificial Sequence
  Synthetic
ucgucgccgcgcagcaccagc

SEQ ID NO: 4068 - RNA, 22 nt, Artificial Sequence
  Synthetic
gucgucgccgcgcagcaccagc

SEQ ID NO: 4069 - RNA, 23 nt, Artificial Sequence
  Synthetic
cgucgucgccgcgcagcaccagc

SEQ ID NO: 4070 - RNA, 24 nt, Artificial Sequence
  Synthetic
ucgucgucgccgcgcagcaccagc

SEQ ID NO: 4071 - RNA, 18 nt, Artificial Sequence
  Synthetic
ugcgcggcgucgcccagc

SEQ ID NO: 4072 - RNA, 19 nt, Artificial Sequence
  Synthetic
cugcgcggcgucgcccagc

SEQ ID NO: 4073 - RNA, 20 nt, Artificial Sequence
  Synthetic
gcugcgcggcgucgcccagc

SEQ ID NO: 4074 - RNA, 21 nt, Artificial Sequence
  Synthetic
ugcugcgcggcgucgcccagc

SEQ ID NO: 4075 - RNA, 22 nt, Artificial Sequence
  Synthetic
cugcugcgcggcgucgcccagc

SEQ ID NO: 4076 - RNA, 23 nt, Artificial Sequence
  Synthetic
acugcugcgcggcgucgcccagc

SEQ ID NO: 4077 - RNA, 24 nt, Artificial Sequence
  Synthetic
uacugcugcgcggcgucgcccagc

SEQ ID NO: 4078 - RNA, 18 nt, Artificial Sequence
  Synthetic
cuggccgccgccgccagc

SEQ ID NO: 4079 - RNA, 19 nt, Artificial Sequence
  Synthetic
gcuggccgccgccgccagc

SEQ ID NO: 4080 - RNA, 20 nt, Artificial Sequence
  Synthetic
cgcuggccgccgccgccagc

SEQ ID NO: 4081 - RNA, 21 nt, Artificial Sequence
  Synthetic
gcgcuggccgccgccgccagc

SEQ ID NO: 4082 - RNA, 22 nt, Artificial Sequence
  Synthetic
ugcgcuggccgccgccgccagc

SEQ ID NO: 4083 - RNA, 23 nt, Artificial Sequence
  Synthetic
gugcgcuggccgccgccgccagc

SEQ ID NO: 4084 - RNA, 24 nt, Artificial Sequence
  Synthetic
ggugcgcuggccgccgccgccagc

SEQ ID NO: 4085 - RNA, 18 nt, Artificial Sequence
  Synthetic
cgcgggucccgcggcagc

SEQ ID NO: 4086 - RNA, 19 nt, Artificial Sequence
  Synthetic
gcgcgggucccgcggcagc

SEQ ID NO: 4087 - RNA, 20 nt, Artificial Sequence
  Synthetic
ggcgcgggucccgcggcagc

SEQ ID NO: 4088 - RNA, 21 nt, Artificial Sequence
  Synthetic
aggcgcgggucccgcggcagc

SEQ ID NO: 4089 - RNA, 22 nt, Artificial Sequence
  Synthetic
caggcgcgggucccgcggcagc

SEQ ID NO: 4090 - RNA, 23 nt, Artificial Sequence
  Synthetic
gcaggcgcgggucccgcggcagc

SEQ ID NO: 4091 - RNA, 24 nt, Artificial Sequence
  Synthetic
ggcaggcgcgggucccgcggcagc

SEQ ID NO: 4092 - RNA, 18 nt, Artificial Sequence
  Synthetic
cggcgcaggcuggucagc

SEQ ID NO: 4093 - RNA, 19 nt, Artificial Sequence
  Synthetic
gcggcgcaggcuggucagc

SEQ ID NO: 4094 - RNA, 20 nt, Artificial Sequence
  Synthetic
cgcggcgcaggcuggucagc

SEQ ID NO: 4095 - RNA, 21 nt, Artificial Sequence
  Synthetic
gcgcggcgcaggcuggucagc

SEQ ID NO: 4096 - RNA, 22 nt, Artificial Sequence
  Synthetic
ggcgcggcgcaggcuggucagc

SEQ ID NO: 4097 - RNA, 23 nt, Artificial Sequence
  Synthetic
aggcgcggcgcaggcuggucagc

SEQ ID NO: 4098 - RNA, 24 nt, Artificial Sequence
  Synthetic
uaggcgcggcgcaggcuggucagc

SEQ ID NO: 4099 - RNA, 18 nt, Artificial Sequence
  Synthetic
gggcgcgggcguccgagc

SEQ ID NO: 4100 - RNA, 19 nt, Artificial Sequence
  Synthetic
ggggcgcgggcguccgagc

SEQ ID NO: 4101 - RNA, 20 nt, Artificial Sequence
  Synthetic
gggggcgcgggcguccgagc

SEQ ID NO: 4102 - RNA, 21 nt, Artificial Sequence
  Synthetic
ggggggcgcgggcguccgagc

SEQ ID NO: 4103 - RNA, 22 nt, Artificial Sequence
  Synthetic
aggggggcgcgggcguccgagc

SEQ ID NO: 4104 - RNA, 23 nt, Artificial Sequence
  Synthetic
gaggggggcgcgggcguccgagc

SEQ ID NO: 4105 - RNA, 24 nt, Artificial Sequence
  Synthetic
ggaggggggcgcgggcguccgagc

SEQ ID NO: 4106 - RNA, 18 nt, Artificial Sequence
  Synthetic
gcguccagcucgacccgc

SEQ ID NO: 4107 - RNA, 19 nt, Artificial Sequence
  Synthetic
ggcguccagcucgacccgc

SEQ ID NO: 4108 - RNA, 20 nt, Artificial Sequence
  Synthetic
cggcguccagcucgacccgc

SEQ ID NO: 4109 - RNA, 21 nt, Artificial Sequence
  Synthetic
ucggcguccagcucgacccgc

SEQ ID NO: 4110 - RNA, 22 nt, Artificial Sequence
  Synthetic
gucggcguccagcucgacccgc

SEQ ID NO: 4111 - RNA, 23 nt, Artificial Sequence
  Synthetic
cgucggcguccagcucgacccgc

SEQ ID NO: 4112 - RNA, 24 nt, Artificial Sequence
  Synthetic
gcgucggcguccagcucgacccgc

SEQ ID NO: 4113 - RNA, 18 nt, Artificial Sequence
  Synthetic
ggggucgucgccccccgc

SEQ ID NO: 4114 - RNA, 19 nt, Artificial Sequence
  Synthetic
cggggucgucgccccccgc

SEQ ID NO: 4115 - RNA, 20 nt, Artificial Sequence
  Synthetic
ucggggucgucgccccccgc

SEQ ID NO: 4116 - RNA, 21 nt, Artificial Sequence
  Synthetic
gucggggucgucgccccccgc

SEQ ID NO: 4117 - RNA, 22 nt, Artificial Sequence
  Synthetic
cgucggggucgucgccccccgc

SEQ ID NO: 4118 - RNA, 23 nt, Artificial Sequence
  Synthetic
gcgucggggucgucgccccccgc

SEQ ID NO: 4119 - RNA, 24 nt, Artificial Sequence
  Synthetic
ggcgucggggucgucgccccccgc

SEQ ID NO: 4120 - RNA, 18 nt, Artificial Sequence
  Synthetic
gcgaaggccaggucccgc

SEQ ID NO: 4121 - RNA, 19 nt, Artificial Sequence
  Synthetic
ggcgaaggccaggucccgc

SEQ ID NO: 4122 - RNA, 20 nt, Artificial Sequence
  Synthetic
cggcgaaggccaggucccgc

SEQ ID NO: 4123 - RNA, 21 nt, Artificial Sequence
  Synthetic
ccggcgaaggccaggucccgc

SEQ ID NO: 4124 - RNA, 22 nt, Artificial Sequence
  Synthetic
cccggcgaaggccaggucccgc

SEQ ID NO: 4125 - RNA, 23 nt, Artificial Sequence
  Synthetic
ccccggcgaaggccaggucccgc

SEQ ID NO: 4126 - RNA, 24 nt, Artificial Sequence
  Synthetic
gccccggcgaaggccaggucccgc

SEQ ID NO: 4127 - RNA, 18 nt, Artificial Sequence
  Synthetic
gcggccggccaccgccgc

SEQ ID NO: 4128 - RNA, 19 nt, Artificial Sequence
  Synthetic
cgcggccggccaccgccgc

SEQ ID NO: 4129 - RNA, 20 nt, Artificial Sequence
  Synthetic
ucgcggccggccaccgccgc

SEQ ID NO: 4130 - RNA, 21 nt, Artificial Sequence
  Synthetic
gucgcggccggccaccgccgc

SEQ ID NO: 4131 - RNA, 22 nt, Artificial Sequence
  Synthetic
cgucgcggccggccaccgccgc

SEQ ID NO: 4132 - RNA, 23 nt, Artificial Sequence
  Synthetic
gcgucgcggccggccaccgccgc

SEQ ID NO: 4133 - RNA, 24 nt, Artificial Sequence
  Synthetic
ggcgucgcggccggccaccgccgc

SEQ ID NO: 4134 - RNA, 18 nt, Artificial Sequence
  Synthetic
uccacaacuucccgccgc

SEQ ID NO: 4135 - RNA, 19 nt, Artificial Sequence
  Synthetic
guccacaacuucccgccgc

SEQ ID NO: 4136 - RNA, 20 nt, Artificial Sequence
  Synthetic
aguccacaacuucccgccgc

SEQ ID NO: 4137 - RNA, 21 nt, Artificial Sequence
  Synthetic
caguccacaacuucccgccgc

SEQ ID NO: 4138 - RNA, 22 nt, Artificial Sequence
  Synthetic
ccaguccacaacuucccgccgc

SEQ ID NO: 4139 - RNA, 23 nt, Artificial Sequence
  Synthetic
cccaguccacaacuucccgccgc

SEQ ID NO: 4140 - RNA, 24 nt, Artificial Sequence
  Synthetic
ucccaguccacaacuucccgccgc

SEQ ID NO: 4141 - RNA, 18 nt, Artificial Sequence
  Synthetic
ggggguccucgccgccgc

SEQ ID NO: 4142 - RNA, 19 nt, Artificial Sequence
  Synthetic
cggggguccucgccgccgc

SEQ ID NO: 4143 - RNA, 20 nt, Artificial Sequence
  Synthetic
gcggggguccucgccgccgc

SEQ ID NO: 4144 - RNA, 21 nt, Artificial Sequence
  Synthetic
cgcggggguccucgccgccgc

SEQ ID NO: 4145 - RNA, 22 nt, Artificial Sequence
  Synthetic
ccgcggggguccucgccgccgc

SEQ ID NO: 4146 - RNA, 23 nt, Artificial Sequence
  Synthetic
gccgcggggguccucgccgccgc

SEQ ID NO: 4147 - RNA, 24 nt, Artificial Sequence
  Synthetic
ggccgcggggguccucgccgccgc

SEQ ID NO: 4148 - RNA, 18 nt, Artificial Sequence
  Synthetic
gggcgcccacacggccgc

SEQ ID NO: 4149 - RNA, 19 nt, Artificial Sequence
  Synthetic
cgggcgcccacacggccgc

SEQ ID NO: 4150 - RNA, 20 nt, Artificial Sequence
  Synthetic
ucgggcgcccacacggccgc

SEQ ID NO: 4151 - RNA, 21 nt, Artificial Sequence
  Synthetic
cucgggcgcccacacggccgc

SEQ ID NO: 4152 - RNA, 22 nt, Artificial Sequence
  Synthetic
gcucgggcgcccacacggccgc

SEQ ID NO: 4153 - RNA, 23 nt, Artificial Sequence
  Synthetic
agcucgggcgcccacacggccgc

SEQ ID NO: 4154 - RNA, 24 nt, Artificial Sequence
  Synthetic
cagcucgggcgcccacacggccgc

SEQ ID NO: 4155 - RNA, 18 nt, Artificial Sequence
  Synthetic
gcgggucccuccggccgc

SEQ ID NO: 4156 - RNA, 19 nt, Artificial Sequence
  Synthetic
cgcgggucccuccggccgc

SEQ ID NO: 4157 - RNA, 20 nt, Artificial Sequence
  Synthetic
ccgcgggucccuccggccgc

SEQ ID NO: 4158 - RNA, 21 nt, Artificial Sequence
  Synthetic
cccgcgggucccuccggccgc

SEQ ID NO: 4159 - RNA, 22 nt, Artificial Sequence
  Synthetic
gcccgcgggucccuccggccgc

SEQ ID NO: 4160 - RNA, 23 nt, Artificial Sequence
  Synthetic
ggcccgcgggucccuccggccgc

SEQ ID NO: 4161 - RNA, 24 nt, Artificial Sequence
  Synthetic
gggcccgcgggucccuccggccgc

SEQ ID NO: 4162 - RNA, 18 nt, Artificial Sequence
  Synthetic
ggcgggggcggcguccgc

SEQ ID NO: 4163 - RNA, 19 nt, Artificial Sequence
  Synthetic
gggcgggggcggcguccgc

SEQ ID NO: 4164 - RNA, 20 nt, Artificial Sequence
  Synthetic
cgggcgggggcggcguccgc

SEQ ID NO: 4165 - RNA, 21 nt, Artificial Sequence
  Synthetic
ccgggcgggggcggcguccgc

SEQ ID NO: 4166 - RNA, 22 nt, Artificial Sequence
  Synthetic
cccgggcgggggcggcguccgc

SEQ ID NO: 4167 - RNA, 23 nt, Artificial Sequence
  Synthetic
gcccgggcgggggcggcguccgc

SEQ ID NO: 4168 - RNA, 24 nt, Artificial Sequence
  Synthetic
ggcccgggcgggggcggcguccgc

SEQ ID NO: 4169 - RNA, 18 nt, Artificial Sequence
  Synthetic
ugcgcggccuccacgcgc

SEQ ID NO: 4170 - RNA, 19 nt, Artificial Sequence
  Synthetic
gugcgcggccuccacgcgc

SEQ ID NO: 4171 - RNA, 20 nt, Artificial Sequence
  Synthetic
cgugcgcggccuccacgcgc

SEQ ID NO: 4172 - RNA, 21 nt, Artificial Sequence
  Synthetic
gcgugcgcggccuccacgcgc

SEQ ID NO: 4173 - RNA, 22 nt, Artificial Sequence
  Synthetic
cgcgugcgcggccuccacgcgc

SEQ ID NO: 4174 - RNA, 23 nt, Artificial Sequence
  Synthetic
gcgcgugcgcggccuccacgcgc

SEQ ID NO: 4175 - RNA, 24 nt, Artificial Sequence
  Synthetic
cgcgcgugcgcggccuccacgcgc

SEQ ID NO: 4176 - RNA, 18 nt, Artificial Sequence
  Synthetic
agcgggcccgaggcgcgc

SEQ ID NO: 4177 - RNA, 19 nt, Artificial Sequence
  Synthetic
cagcgggcccgaggcgcgc

SEQ ID NO: 4178 - RNA, 20 nt, Artificial Sequence
  Synthetic
gcagcgggcccgaggcgcgc

SEQ ID NO: 4179 - RNA, 21 nt, Artificial Sequence
  Synthetic
cgcagcgggcccgaggcgcgc

SEQ ID NO: 4180 - RNA, 22 nt, Artificial Sequence
  Synthetic
gcgcagcgggcccgaggcgcgc

SEQ ID NO: 4181 - RNA, 23 nt, Artificial Sequence
  Synthetic
ggcgcagcgggcccgaggcgcgc

SEQ ID NO: 4182 - RNA, 24 nt, Artificial Sequence
  Synthetic
cggcgcagcgggcccgaggcgcgc

SEQ ID NO: 4183 - RNA, 18 nt, Artificial Sequence
  Synthetic
agcucggccacggcgcgc

SEQ ID NO: 4184 - RNA, 19 nt, Artificial Sequence
  Synthetic
gagcucggccacggcgcgc

SEQ ID NO: 4185 - RNA, 20 nt, Artificial Sequence
  Synthetic
ugagcucggccacggcgcgc

SEQ ID NO: 4186 - RNA, 21 nt, Artificial Sequence
  Synthetic
gugagcucggccacggcgcgc

SEQ ID NO: 4187 - RNA, 22 nt, Artificial Sequence
  Synthetic
cgugagcucggccacggcgcgc

SEQ ID NO: 4188 - RNA, 23 nt, Artificial Sequence
  Synthetic
ccgugagcucggccacggcgcgc

SEQ ID NO: 4189 - RNA, 24 nt, Artificial Sequence
  Synthetic
uccgugagcucggccacggcgcgc

SEQ ID NO: 4190 - RNA, 18 nt, Artificial Sequence
  Synthetic
gcccggcgguacucgcgc

SEQ ID NO: 4191 - RNA, 19 nt, Artificial Sequence
  Synthetic
ggcccggcgguacucgcgc

SEQ ID NO: 4192 - RNA, 20 nt, Artificial Sequence
  Synthetic
cggcccggcgguacucgcgc

SEQ ID NO: 4193 - RNA, 21 nt, Artificial Sequence
  Synthetic
acggcccggcgguacucgcgc

SEQ ID NO: 4194 - RNA, 22 nt, Artificial Sequence
  Synthetic
cacggcccggcgguacucgcgc

SEQ ID NO: 4195 - RNA, 23 nt, Artificial Sequence
  Synthetic
gcacggcccggcgguacucgcgc

SEQ ID NO: 4196 - RNA, 24 nt, Artificial Sequence
  Synthetic
agcacggcccggcgguacucgcgc

SEQ ID NO: 4197 - RNA, 18 nt, Artificial Sequence
  Synthetic
agcaccagcgcgucgcgc

SEQ ID NO: 4198 - RNA, 19 nt, Artificial Sequence
  Synthetic
gagcaccagcgcgucgcgc

SEQ ID NO: 4199 - RNA, 20 nt, Artificial Sequence
  Synthetic
ugagcaccagcgcgucgcgc

SEQ ID NO: 4200 - RNA, 21 nt, Artificial Sequence
  Synthetic
augagcaccagcgcgucgcgc

SEQ ID NO: 4201 - RNA, 22 nt, Artificial Sequence
  Synthetic
caugagcaccagcgcgucgcgc

SEQ ID NO: 4202 - RNA, 23 nt, Artificial Sequence
  Synthetic
gcaugagcaccagcgcgucgcgc

SEQ ID NO: 4203 - RNA, 24 nt, Artificial Sequence
  Synthetic
cgcaugagcaccagcgcgucgcgc

SEQ ID NO: 4204 - RNA, 18 nt, Artificial Sequence
  Synthetic
agcgcgcguagaaggcgc

SEQ ID NO: 4205 - RNA, 19 nt, Artificial Sequence
  Synthetic
uagcgcgcguagaaggcgc

SEQ ID NO: 4206 - RNA, 20 nt, Artificial Sequence
  Synthetic
auagcgcgcguagaaggcgc

SEQ ID NO: 4207 - RNA, 21 nt, Artificial Sequence
  Synthetic
gauagcgcgcguagaaggcgc

SEQ ID NO: 4208 - RNA, 22 nt, Artificial Sequence
  Synthetic
cgauagcgcgcguagaaggcgc

SEQ ID NO: 4209 - RNA, 23 nt, Artificial Sequence
  Synthetic
gcgauagcgcgcguagaaggcgc

SEQ ID NO: 4210 - RNA, 24 nt, Artificial Sequence
  Synthetic
cgcgauagcgcgcguagaaggcgc

SEQ ID NO: 4211 - RNA, 18 nt, Artificial Sequence
  Synthetic
agguccccgcgcaggcgc

SEQ ID NO: 4212 - RNA, 19 nt, Artificial Sequence
  Synthetic
cagguccccgcgcaggcgc

SEQ ID NO: 4213 - RNA, 20 nt, Artificial Sequence
  Synthetic
gcagguccccgcgcaggcgc

SEQ ID NO: 4214 - RNA, 21 nt, Artificial Sequence
  Synthetic
cgcagguccccgcgcaggcgc

SEQ ID NO: 4215 - RNA, 22 nt, Artificial Sequence
  Synthetic
gcgcagguccccgcgcaggcgc

SEQ ID NO: 4216 - RNA, 23 nt, Artificial Sequence
  Synthetic
cgcgcagguccccgcgcaggcgc

SEQ ID NO: 4217 - RNA, 24 nt, Artificial Sequence
  Synthetic
acgcgcagguccccgcgcaggcgc

SEQ ID NO: 4218 - RNA, 18 nt, Artificial Sequence
  Synthetic
ugagcucggccacggcgc

SEQ ID NO: 4219 - RNA, 19 nt, Artificial Sequence
  Synthetic
gugagcucggccacggcgc

SEQ ID NO: 4220 - RNA, 20 nt, Artificial Sequence
  Synthetic
cgugagcucggccacggcgc

SEQ ID NO: 4221 - RNA, 21 nt, Artificial Sequence
  Synthetic
ccgugagcucggccacggcgc

SEQ ID NO: 4222 - RNA, 22 nt, Artificial Sequence
  Synthetic
uccgugagcucggccacggcgc

SEQ ID NO: 4223 - RNA, 23 nt, Artificial Sequence
  Synthetic
guccgugagcucggccacggcgc

SEQ ID NO: 4224 - RNA, 24 nt, Artificial Sequence
  Synthetic
gguccgugagcucggccacggcgc

SEQ ID NO: 4225 - RNA, 18 nt, Artificial Sequence
  Synthetic
cgucaucugcgccggcgc

SEQ ID NO: 4226 - RNA, 19 nt, Artificial Sequence
  Synthetic
ucgucaucugcgccggcgc

SEQ ID NO: 4227 - RNA, 20 nt, Artificial Sequence
  Synthetic
cucgucaucugcgccggcgc

SEQ ID NO: 4228 - RNA, 21 nt, Artificial Sequence
  Synthetic
ccucgucaucugcgccggcgc

SEQ ID NO: 4229 - RNA, 22 nt, Artificial Sequence
  Synthetic
cccucgucaucugcgccggcgc

SEQ ID NO: 4230 - RNA, 23 nt, Artificial Sequence
  Synthetic
ccccucgucaucugcgccggcgc

SEQ ID NO: 4231 - RNA, 24 nt, Artificial Sequence
  Synthetic
cccccucgucaucugcgccggcgc

SEQ ID NO: 4232 - RNA, 18 nt, Artificial Sequence
  Synthetic
ugcuguugcgcgcggcgc

SEQ ID NO: 4233 - RNA, 19 nt, Artificial Sequence
  Synthetic
cugcuguugcgcgcggcgc

SEQ ID NO: 4234 - RNA, 20 nt, Artificial Sequence
  Synthetic
gcugcuguugcgcgcggcgc

SEQ ID NO: 4235 - RNA, 21 nt, Artificial Sequence
  Synthetic
agcugcuguugcgcgcggcgc

SEQ ID NO: 4236 - RNA, 22 nt, Artificial Sequence
  Synthetic
gagcugcuguugcgcgcggcgc

SEQ ID NO: 4237 - RNA, 23 nt, Artificial Sequence
  Synthetic
ggagcugcuguugcgcgcggcgc

SEQ ID NO: 4238 - RNA, 24 nt, Artificial Sequence
  Synthetic
aggagcugcuguugcgcgcggcgc

SEQ ID NO: 4239 - RNA, 18 nt, Artificial Sequence
  Synthetic
ggaggggggcgcgggcgc

SEQ ID NO: 4240 - RNA, 19 nt, Artificial Sequence
  Synthetic
uggaggggggcgcgggcgc

SEQ ID NO: 4241 - RNA, 20 nt, Artificial Sequence
  Synthetic
guggaggggggcgcgggcgc

SEQ ID NO: 4242 - RNA, 21 nt, Artificial Sequence
  Synthetic
cguggaggggggcgcgggcgc

SEQ ID NO: 4243 - RNA, 22 nt, Artificial Sequence
  Synthetic
gcguggaggggggcgcgggcgc

SEQ ID NO: 4244 - RNA, 23 nt, Artificial Sequence
  Synthetic
ggcguggaggggggcgcgggcgc

SEQ ID NO: 4245 - RNA, 24 nt, Artificial Sequence
  Synthetic
gggcguggaggggggcgcgggcgc

SEQ ID NO: 4246 - RNA, 18 nt, Artificial Sequence
  Synthetic
acacggccgccggggcgc

SEQ ID NO: 4247 - RNA, 19 nt, Artificial Sequence
  Synthetic
cacacggccgccggggcgc

SEQ ID NO: 4248 - RNA, 20 nt, Artificial Sequence
  Synthetic
ccacacggccgccggggcgc

SEQ ID NO: 4249 - RNA, 21 nt, Artificial Sequence
  Synthetic
cccacacggccgccggggcgc

SEQ ID NO: 4250 - RNA, 22 nt, Artificial Sequence
  Synthetic
gcccacacggccgccggggcgc

SEQ ID NO: 4251 - RNA, 23 nt, Artificial Sequence
  Synthetic
cgcccacacggccgccggggcgc

SEQ ID NO: 4252 - RNA, 24 nt, Artificial Sequence
  Synthetic
gcgcccacacggccgccggggcgc

SEQ ID NO: 4253 - RNA, 18 nt, Artificial Sequence
  Synthetic
cggcccggcgguacucgc

SEQ ID NO: 4254 - RNA, 19 nt, Artificial Sequence
  Synthetic
acggcccggcgguacucgc

SEQ ID NO: 4255 - RNA, 20 nt, Artificial Sequence
  Synthetic
cacggcccggcgguacucgc

SEQ ID NO: 4256 - RNA, 21 nt, Artificial Sequence
  Synthetic
gcacggcccggcgguacucgc

SEQ ID NO: 4257 - RNA, 22 nt, Artificial Sequence
  Synthetic
agcacggcccggcgguacucgc

SEQ ID NO: 4258 - RNA, 23 nt, Artificial Sequence
  Synthetic
cagcacggcccggcgguacucgc

SEQ ID NO: 4259 - RNA, 24 nt, Artificial Sequence
  Synthetic
gcagcacggcccggcgguacucgc

SEQ ID NO: 4260 - RNA, 18 nt, Artificial Sequence
  Synthetic
aacaugagggccggucgc

SEQ ID NO: 4261 - RNA, 19 nt, Artificial Sequence
  Synthetic
aaacaugagggccggucgc

SEQ ID NO: 4262 - RNA, 20 nt, Artificial Sequence
  Synthetic
caaacaugagggccggucgc

SEQ ID NO: 4263 - RNA, 21 nt, Artificial Sequence
  Synthetic
ucaaacaugagggccggucgc

SEQ ID NO: 4264 - RNA, 22 nt, Artificial Sequence
  Synthetic
gucaaacaugagggccggucgc

SEQ ID NO: 4265 - RNA, 23 nt, Artificial Sequence
  Synthetic
ggucaaacaugagggccggucgc

SEQ ID NO: 4266 - RNA, 24 nt, Artificial Sequence
  Synthetic
gggucaaacaugagggccggucgc

SEQ ID NO: 4267 - RNA, 18 nt, Artificial Sequence
  Synthetic
cgggcgccccccagaggc

SEQ ID NO: 4268 - RNA, 19 nt, Artificial Sequence
  Synthetic
ucgggcgccccccagaggc

SEQ ID NO: 4269 - RNA, 20 nt, Artificial Sequence
  Synthetic
cucgggcgccccccagaggc

SEQ ID NO: 4270 - RNA, 21 nt, Artificial Sequence
  Synthetic
ccucgggcgccccccagaggc

SEQ ID NO: 4271 - RNA, 22 nt, Artificial Sequence
  Synthetic
gccucgggcgccccccagaggc

SEQ ID NO: 4272 - RNA, 23 nt, Artificial Sequence
  Synthetic
cgccucgggcgccccccagaggc

SEQ ID NO: 4273 - RNA, 24 nt, Artificial Sequence
  Synthetic
ccgccucgggcgccccccagaggc

SEQ ID NO: 4274 - RNA, 18 nt, Artificial Sequence
  Synthetic
ccgcgcggcgaucgaggc

SEQ ID NO: 4275 - RNA, 19 nt, Artificial Sequence
  Synthetic
accgcgcggcgaucgaggc

SEQ ID NO: 4276 - RNA, 20 nt, Artificial Sequence
  Synthetic
caccgcgcggcgaucgaggc

SEQ ID NO: 4277 - RNA, 21 nt, Artificial Sequence
  Synthetic
gcaccgcgcggcgaucgaggc

SEQ ID NO: 4278 - RNA, 22 nt, Artificial Sequence
  Synthetic
cgcaccgcgcggcgaucgaggc

SEQ ID NO: 4279 - RNA, 23 nt, Artificial Sequence
  Synthetic
gcgcaccgcgcggcgaucgaggc

SEQ ID NO: 4280 - RNA, 24 nt, Artificial Sequence
  Synthetic
ggcgcaccgcgcggcgaucgaggc

SEQ ID NO: 4281 - RNA, 18 nt, Artificial Sequence
  Synthetic
gacggccacgcggccggc

SEQ ID NO: 4282 - RNA, 19 nt, Artificial Sequence
  Synthetic
cgacggccacgcggccggc

SEQ ID NO: 4283 - RNA, 20 nt, Artificial Sequence
  Synthetic
ucgacggccacgcggccggc

SEQ ID NO: 4284 - RNA, 21 nt, Artificial Sequence
  Synthetic
cucgacggccacgcggccggc

SEQ ID NO: 4285 - RNA, 22 nt, Artificial Sequence
  Synthetic
acucgacggccacgcggccggc

SEQ ID NO: 4286 - RNA, 23 nt, Artificial Sequence
  Synthetic
cacucgacggccacgcggccggc

SEQ ID NO: 4287 - RNA, 24 nt, Artificial Sequence
  Synthetic
gcacucgacggccacgcggccggc

SEQ ID NO: 4288 - RNA, 18 nt, Artificial Sequence
  Synthetic
ccgggccgaacacgcggc

SEQ ID NO: 4289 - RNA, 19 nt, Artificial Sequence
  Synthetic
cccgggccgaacacgcggc

SEQ ID NO: 4290 - RNA, 20 nt, Artificial Sequence
  Synthetic
ccccgggccgaacacgcggc

SEQ ID NO: 4291 - RNA, 21 nt, Artificial Sequence
  Synthetic
cccccgggccgaacacgcggc

SEQ ID NO: 4292 - RNA, 22 nt, Artificial Sequence
  Synthetic
acccccgggccgaacacgcggc

SEQ ID NO: 4293 - RNA, 23 nt, Artificial Sequence
  Synthetic
gacccccgggccgaacacgcggc

SEQ ID NO: 4294 - RNA, 24 nt, Artificial Sequence
  Synthetic
agacccccgggccgaacacgcggc

SEQ ID NO: 4295 - RNA, 18 nt, Artificial Sequence
  Synthetic
gccgccgccgcacgcggc

SEQ ID NO: 4296 - RNA, 19 nt, Artificial Sequence
  Synthetic
cgccgccgccgcacgcggc

SEQ ID NO: 4297 - RNA, 20 nt, Artificial Sequence
  Synthetic
ucgccgccgccgcacgcggc

SEQ ID NO: 4298 - RNA, 21 nt, Artificial Sequence
  Synthetic
gucgccgccgccgcacgcggc

SEQ ID NO: 4299 - RNA, 22 nt, Artificial Sequence
  Synthetic
cgucgccgccgccgcacgcggc

SEQ ID NO: 4300 - RNA, 23 nt, Artificial Sequence
  Synthetic
ucgucgccgccgccgcacgcggc

SEQ ID NO: 4301 - RNA, 24 nt, Artificial Sequence
  Synthetic
gucgucgccgccgccgcacgcggc

SEQ ID NO: 4302 - RNA, 18 nt, Artificial Sequence
  Synthetic
ggccugcgccgcggcggc

SEQ ID NO: 4303 - RNA, 19 nt, Artificial Sequence
  Synthetic
gggccugcgccgcggcggc

SEQ ID NO: 4304 - RNA, 20 nt, Artificial Sequence
  Synthetic
cgggccugcgccgcggcggc

SEQ ID NO: 4305 - RNA, 21 nt, Artificial Sequence
  Synthetic
gcgggccugcgccgcggcggc

SEQ ID NO: 4306 - RNA, 22 nt, Artificial Sequence
  Synthetic
ggcgggccugcgccgcggcggc

SEQ ID NO: 4307 - RNA, 23 nt, Artificial Sequence
  Synthetic
gggcgggccugcgccgcggcggc

SEQ ID NO: 4308 - RNA, 24 nt, Artificial Sequence
  Synthetic
cgggcgggccugcgccgcggcggc

SEQ ID NO: 4309 - RNA, 18 nt, Artificial Sequence
  Synthetic
ucggcgugcggcggcggc

SEQ ID NO: 4310 - RNA, 19 nt, Artificial Sequence
  Synthetic
gucggcgugcggcggcggc

SEQ ID NO: 4311 - RNA, 20 nt, Artificial Sequence
  Synthetic
cgucggcgugcggcggcggc

SEQ ID NO: 4312 - RNA, 21 nt, Artificial Sequence
  Synthetic
gcgucggcgugcggcggcggc

SEQ ID NO: 4313 - RNA, 22 nt, Artificial Sequence
  Synthetic
cgcgucggcgugcggcggcggc

SEQ ID NO: 4314 - RNA, 23 nt, Artificial Sequence
  Synthetic
gcgcgucggcgugcggcggcggc

SEQ ID NO: 4315 - RNA, 24 nt, Artificial Sequence
  Synthetic
ggcgcgucggcgugcggcggcggc

SEQ ID NO: 4316 - RNA, 18 nt, Artificial Sequence
  Synthetic
gcacgcggccugggcggc

SEQ ID NO: 4317 - RNA, 19 nt, Artificial Sequence
  Synthetic
cgcacgcggccugggcggc

SEQ ID NO: 4318 - RNA, 20 nt, Artificial Sequence
  Synthetic
ccgcacgcggccugggcggc

SEQ ID NO: 4319 - RNA, 21 nt, Artificial Sequence
  Synthetic
gccgcacgcggccugggcggc

SEQ ID NO: 4320 - RNA, 22 nt, Artificial Sequence
  Synthetic
cgccgcacgcggccugggcggc

SEQ ID NO: 4321 - RNA, 23 nt, Artificial Sequence
  Synthetic
ccgccgcacgcggccugggcggc

SEQ ID NO: 4322 - RNA, 24 nt, Artificial Sequence
  Synthetic
gccgccgcacgcggccugggcggc

SEQ ID NO: 4323 - RNA, 18 nt, Artificial Sequence
  Synthetic
gucgggcuccagcagggc

SEQ ID NO: 4324 - RNA, 19 nt, Artificial Sequence
  Synthetic
cgucgggcuccagcagggc

SEQ ID NO: 4325 - RNA, 20 nt, Artificial Sequence
  Synthetic
ucgucgggcuccagcagggc

SEQ ID NO: 4326 - RNA, 21 nt, Artificial Sequence
  Synthetic
gucgucgggcuccagcagggc

SEQ ID NO: 4327 - RNA, 22 nt, Artificial Sequence
  Synthetic
cgucgucgggcuccagcagggc

SEQ ID NO: 4328 - RNA, 23 nt, Artificial Sequence
  Synthetic
ucgucgucgggcuccagcagggc

SEQ ID NO: 4329 - RNA, 24 nt, Artificial Sequence
  Synthetic
gucgucgucgggcuccagcagggc

SEQ ID NO: 4330 - RNA, 18 nt, Artificial Sequence
  Synthetic
aggggggguggcccgggc

SEQ ID NO: 4331 - RNA, 19 nt, Artificial Sequence
  Synthetic
gaggggggguggcccgggc

SEQ ID NO: 4332 - RNA, 20 nt, Artificial Sequence
  Synthetic
agaggggggguggcccgggc

SEQ ID NO: 4333 - RNA, 21 nt, Artificial Sequence
  Synthetic
gagaggggggguggcccgggc

SEQ ID NO: 4334 - RNA, 22 nt, Artificial Sequence
  Synthetic
ggagaggggggguggcccgggc

SEQ ID NO: 4335 - RNA, 23 nt, Artificial Sequence
  Synthetic
cggagaggggggguggcccgggc

SEQ ID NO: 4336 - RNA, 24 nt, Artificial Sequence
  Synthetic
ucggagaggggggguggcccgggc

SEQ ID NO: 4337 - RNA, 18 nt, Artificial Sequence
  Synthetic
cgggcggccgggccgggc

SEQ ID NO: 4338 - RNA, 19 nt, Artificial Sequence
  Synthetic
ccgggcggccgggccgggc

SEQ ID NO: 4339 - RNA, 20 nt, Artificial Sequence
  Synthetic
uccgggcggccgggccgggc

SEQ ID NO: 4340 - RNA, 21 nt, Artificial Sequence
  Synthetic
cuccgggcggccgggccgggc

SEQ ID NO: 4341 - RNA, 22 nt, Artificial Sequence
  Synthetic
ccuccgggcggccgggccgggc

SEQ ID NO: 4342 - RNA, 23 nt, Artificial Sequence
  Synthetic
gccuccgggcggccgggccgggc

SEQ ID NO: 4343 - RNA, 24 nt, Artificial Sequence
  Synthetic
cgccuccgggcggccgggccgggc

SEQ ID NO: 4344 - RNA, 18 nt, Artificial Sequence
  Synthetic
ccaugcggcgcagcgggc

SEQ ID NO: 4345 - RNA, 19 nt, Artificial Sequence
  Synthetic
gccaugcggcgcagcgggc

SEQ ID NO: 4346 - RNA, 20 nt, Artificial Sequence
  Synthetic
cgccaugcggcgcagcgggc

SEQ ID NO: 4347 - RNA, 21 nt, Artificial Sequence
  Synthetic
ccgccaugcggcgcagcgggc

SEQ ID NO: 4348 - RNA, 22 nt, Artificial Sequence
  Synthetic
gccgccaugcggcgcagcgggc

SEQ ID NO: 4349 - RNA, 23 nt, Artificial Sequence
  Synthetic
ggccgccaugcggcgcagcgggc

SEQ ID NO: 4350 - RNA, 24 nt, Artificial Sequence
  Synthetic
aggccgccaugcggcgcagcgggc

SEQ ID NO: 4351 - RNA, 18 nt, Artificial Sequence
  Synthetic
guggaggggggcgcgggc

SEQ ID NO: 4352 - RNA, 19 nt, Artificial Sequence
  Synthetic
cguggaggggggcgcgggc

SEQ ID NO: 4353 - RNA, 20 nt, Artificial Sequence
  Synthetic
gcguggaggggggcgcgggc

SEQ ID NO: 4354 - RNA, 21 nt, Artificial Sequence
  Synthetic
ggcguggaggggggcgcgggc

SEQ ID NO: 4355 - RNA, 22 nt, Artificial Sequence
  Synthetic
gggcguggaggggggcgcgggc

SEQ ID NO: 4356 - RNA, 23 nt, Artificial Sequence
  Synthetic
ggggcguggaggggggcgcgggc

SEQ ID NO: 4357 - RNA, 24 nt, Artificial Sequence
  Synthetic
gggggcguggaggggggcgcgggc

SEQ ID NO: 4358 - RNA, 18 nt, Artificial Sequence
  Synthetic
ggcugggcgggggcgggc

SEQ ID NO: 4359 - RNA, 19 nt, Artificial Sequence
  Synthetic
gggcugggcgggggcgggc

SEQ ID NO: 4360 - RNA, 20 nt, Artificial Sequence
  Synthetic
cgggcugggcgggggcgggc

SEQ ID NO: 4361 - RNA, 21 nt, Artificial Sequence
  Synthetic
gcgggcugggcgggggcgggc

SEQ ID NO: 4362 - RNA, 22 nt, Artificial Sequence
  Synthetic
cgcgggcugggcgggggcgggc

SEQ ID NO: 4363 - RNA, 23 nt, Artificial Sequence
  Synthetic
ccgcgggcugggcgggggcgggc

SEQ ID NO: 4364 - RNA, 24 nt, Artificial Sequence
  Synthetic
gccgcgggcugggcgggggcgggc

SEQ ID NO: 4365 - RNA, 18 nt, Artificial Sequence
  Synthetic
gcgacacggccacggggc

SEQ ID NO: 4366 - RNA, 19 nt, Artificial Sequence
  Synthetic
cgcgacacggccacggggc

SEQ ID NO: 4367 - RNA, 20 nt, Artificial Sequence
  Synthetic
gcgcgacacggccacggggc

SEQ ID NO: 4368 - RNA, 21 nt, Artificial Sequence
  Synthetic
ggcgcgacacggccacggggc

SEQ ID NO: 4369 - RNA, 22 nt, Artificial Sequence
  Synthetic
cggcgcgacacggccacggggc

SEQ ID NO: 4370 - RNA, 23 nt, Artificial Sequence
  Synthetic
ccggcgcgacacggccacggggc

SEQ ID NO: 4371 - RNA, 24 nt, Artificial Sequence
  Synthetic
gccggcgcgacacggccacggggc

SEQ ID NO: 4372 - RNA, 18 nt, Artificial Sequence
  Synthetic
cucgccgccgcccggggc

SEQ ID NO: 4373 - RNA, 19 nt, Artificial Sequence
  Synthetic
ccucgccgccgcccggggc

SEQ ID NO: 4374 - RNA, 20 nt, Artificial Sequence
  Synthetic
uccucgccgccgcccggggc

SEQ ID NO: 4375 - RNA, 21 nt, Artificial Sequence
  Synthetic
guccucgccgccgcccggggc

SEQ ID NO: 4376 - RNA, 22 nt, Artificial Sequence
  Synthetic
gguccucgccgccgcccggggc

SEQ ID NO: 4377 - RNA, 23 nt, Artificial Sequence
  Synthetic
ggguccucgccgccgcccggggc

SEQ ID NO: 4378 - RNA, 24 nt, Artificial Sequence
  Synthetic
gggguccucgccgccgcccggggc

SEQ ID NO: 4379 - RNA, 18 nt, Artificial Sequence
  Synthetic
agcacccgccccgggggc

SEQ ID NO: 4380 - RNA, 19 nt, Artificial Sequence
  Synthetic
cagcacccgccccgggggc

SEQ ID NO: 4381 - RNA, 20 nt, Artificial Sequence
  Synthetic
acagcacccgccccgggggc

SEQ ID NO: 4382 - RNA, 21 nt, Artificial Sequence
  Synthetic
uacagcacccgccccgggggc

SEQ ID NO: 4383 - RNA, 22 nt, Artificial Sequence
  Synthetic
guacagcacccgccccgggggc

SEQ ID NO: 4384 - RNA, 23 nt, Artificial Sequence
  Synthetic
cguacagcacccgccccgggggc

SEQ ID NO: 4385 - RNA, 24 nt, Artificial Sequence
  Synthetic
ccguacagcacccgccccgggggc

SEQ ID NO: 4386 - RNA, 18 nt, Artificial Sequence
  Synthetic
ggcucgggccccgggggc

SEQ ID NO: 4387 - RNA, 19 nt, Artificial Sequence
  Synthetic
gggcucgggccccgggggc

SEQ ID NO: 4388 - RNA, 20 nt, Artificial Sequence
  Synthetic
cgggcucgggccccgggggc

SEQ ID NO: 4389 - RNA, 21 nt, Artificial Sequence
  Synthetic
gcgggcucgggccccgggggc

SEQ ID NO: 4390 - RNA, 22 nt, Artificial Sequence
  Synthetic
ggcgggcucgggccccgggggc

SEQ ID NO: 4391 - RNA, 23 nt, Artificial Sequence
  Synthetic
gggcgggcucgggccccgggggc

SEQ ID NO: 4392 - RNA, 24 nt, Artificial Sequence
  Synthetic
ggggcgggcucgggccccgggggc

SEQ ID NO: 4393 - RNA, 18 nt, Artificial Sequence
  Synthetic
gggcgcggggaggggggc

SEQ ID NO: 4394 - RNA, 19 nt, Artificial Sequence
  Synthetic
cgggcgcggggaggggggc

SEQ ID NO: 4395 - RNA, 20 nt, Artificial Sequence
  Synthetic
gcgggcgcggggaggggggc

SEQ ID NO: 4396 - RNA, 21 nt, Artificial Sequence
  Synthetic
cgcgggcgcggggaggggggc

SEQ ID NO: 4397 - RNA, 22 nt, Artificial Sequence
  Synthetic
gcgcgggcgcggggaggggggc

SEQ ID NO: 4398 - RNA, 23 nt, Artificial Sequence
  Synthetic
ggcgcgggcgcggggaggggggc

SEQ ID NO: 4399 - RNA, 24 nt, Artificial Sequence
  Synthetic
gggcgcgggcgcggggaggggggc

SEQ ID NO: 4400 - RNA, 18 nt, Artificial Sequence
  Synthetic
gggggcguggaggggggc

SEQ ID NO: 4401 - RNA, 19 nt, Artificial Sequence
  Synthetic
cgggggcguggaggggggc

SEQ ID NO: 4402 - RNA, 20 nt, Artificial Sequence
  Synthetic
ccgggggcguggaggggggc

SEQ ID NO: 4403 - RNA, 21 nt, Artificial Sequence
  Synthetic
cccgggggcguggaggggggc

SEQ ID NO: 4404 - RNA, 22 nt, Artificial Sequence
  Synthetic
ccccgggggcguggaggggggc

SEQ ID NO: 4405 - RNA, 23 nt, Artificial Sequence
  Synthetic
gccccgggggcguggaggggggc

SEQ ID NO: 4406 - RNA, 24 nt, Artificial Sequence
  Synthetic
ggccccgggggcguggaggggggc

SEQ ID NO: 4407 - RNA, 18 nt, Artificial Sequence
  Synthetic
gggcgccgcgggcugggc

SEQ ID NO: 4408 - RNA, 19 nt, Artificial Sequence
  Synthetic
ggggcgccgcgggcugggc

SEQ ID NO: 4409 - RNA, 20 nt, Artificial Sequence
  Synthetic
cggggcgccgcgggcugggc

SEQ ID NO: 4410 - RNA, 21 nt, Artificial Sequence
  Synthetic
ccggggcgccgcgggcugggc

SEQ ID NO: 4411 - RNA, 22 nt, Artificial Sequence
  Synthetic
cccggggcgccgcgggcugggc

SEQ ID NO: 4412 - RNA, 23 nt, Artificial Sequence
  Synthetic
gcccggggcgccgcgggcugggc

SEQ ID NO: 4413 - RNA, 24 nt, Artificial Sequence
  Synthetic
ggcccggggcgccgcgggcugggc

SEQ ID NO: 4414 - RNA, 18 nt, Artificial Sequence
  Synthetic
ucggagaggggggguggc

SEQ ID NO: 4415 - RNA, 19 nt, Artificial Sequence
  Synthetic
cucggagaggggggguggc

SEQ ID NO: 4416 - RNA, 20 nt, Artificial Sequence
  Synthetic
ccucggagaggggggguggc

SEQ ID NO: 4417 - RNA, 21 nt, Artificial Sequence
  Synthetic
gccucggagaggggggguggc

SEQ ID NO: 4418 - RNA, 22 nt, Artificial Sequence
  Synthetic
ggccucggagaggggggguggc

SEQ ID NO: 4419 - RNA, 23 nt, Artificial Sequence
  Synthetic
cggccucggagaggggggguggc

SEQ ID NO: 4420 - RNA, 24 nt, Artificial Sequence
  Synthetic
gcggccucggagaggggggguggc

SEQ ID NO: 4421 - RNA, 18 nt, Artificial Sequence
  Synthetic
cccgcacagccgguuggc

SEQ ID NO: 4422 - RNA, 19 nt, Artificial Sequence
  Synthetic
gcccgcacagccgguuggc

SEQ ID NO: 4423 - RNA, 20 nt, Artificial Sequence
  Synthetic
ggcccgcacagccgguuggc

SEQ ID NO: 4424 - RNA, 21 nt, Artificial Sequence
  Synthetic
cggcccgcacagccgguuggc

SEQ ID NO: 4425 - RNA, 22 nt, Artificial Sequence
  Synthetic
ccggcccgcacagccgguuggc

SEQ ID NO: 4426 - RNA, 23 nt, Artificial Sequence
  Synthetic
uccggcccgcacagccgguuggc

SEQ ID NO: 4427 - RNA, 24 nt, Artificial Sequence
  Synthetic
guccggcccgcacagccgguuggc

SEQ ID NO: 4428 - RNA, 18 nt, Artificial Sequence
  Synthetic
gccgaggcccagcgaauc

SEQ ID NO: 4429 - RNA, 19 nt, Artificial Sequence
  Synthetic
ggccgaggcccagcgaauc

SEQ ID NO: 4430 - RNA, 20 nt, Artificial Sequence
  Synthetic
uggccgaggcccagcgaauc

SEQ ID NO: 4431 - RNA, 21 nt, Artificial Sequence
  Synthetic
guggccgaggcccagcgaauc

SEQ ID NO: 4432 - RNA, 22 nt, Artificial Sequence
  Synthetic
cguggccgaggcccagcgaauc

SEQ ID NO: 4433 - RNA, 23 nt, Artificial Sequence
  Synthetic
ccguggccgaggcccagcgaauc

SEQ ID NO: 4434 - RNA, 24 nt, Artificial Sequence
  Synthetic
cccguggccgaggcccagcgaauc

SEQ ID NO: 4435 - RNA, 18 nt, Artificial Sequence
  Synthetic
cgcgcggcgcccgagauc

SEQ ID NO: 4436 - RNA, 19 nt, Artificial Sequence
  Synthetic
gcgcgcggcgcccgagauc

SEQ ID NO: 4437 - RNA, 20 nt, Artificial Sequence
  Synthetic
ugcgcgcggcgcccgagauc

SEQ ID NO: 4438 - RNA, 21 nt, Artificial Sequence
  Synthetic
uugcgcgcggcgcccgagauc

SEQ ID NO: 4439 - RNA, 22 nt, Artificial Sequence
  Synthetic
guugcgcgcggcgcccgagauc

SEQ ID NO: 4440 - RNA, 23 nt, Artificial Sequence
  Synthetic
uguugcgcgcggcgcccgagauc

SEQ ID NO: 4441 - RNA, 24 nt, Artificial Sequence
  Synthetic
cuguugcgcgcggcgcccgagauc

SEQ ID NO: 4442 - RNA, 18 nt, Artificial Sequence
  Synthetic
cggggagcaguaggccuc

SEQ ID NO: 4443 - RNA, 19 nt, Artificial Sequence
  Synthetic
gcggggagcaguaggccuc

SEQ ID NO: 4444 - RNA, 20 nt, Artificial Sequence
  Synthetic
cgcggggagcaguaggccuc

SEQ ID NO: 4445 - RNA, 21 nt, Artificial Sequence
  Synthetic
gcgcggggagcaguaggccuc

SEQ ID NO: 4446 - RNA, 22 nt, Artificial Sequence
  Synthetic
cgcgcggggagcaguaggccuc

SEQ ID NO: 4447 - RNA, 23 nt, Artificial Sequence
  Synthetic
gcgcgcggggagcaguaggccuc

SEQ ID NO: 4448 - RNA, 24 nt, Artificial Sequence
  Synthetic
ggcgcgcggggagcaguaggccuc

SEQ ID NO: 4449 - RNA, 18 nt, Artificial Sequence
  Synthetic
gcccagcgccgacacguc

SEQ ID NO: 4450 - RNA, 19 nt, Artificial Sequence
  Synthetic
cgcccagcgccgacacguc

SEQ ID NO: 4451 - RNA, 20 nt, Artificial Sequence
  Synthetic
gcgcccagcgccgacacguc

SEQ ID NO: 4452 - RNA, 21 nt, Artificial Sequence
  Synthetic
ugcgcccagcgccgacacguc

SEQ ID NO: 4453 - RNA, 22 nt, Artificial Sequence
  Synthetic
gugcgcccagcgccgacacguc

SEQ ID NO: 4454 - RNA, 23 nt, Artificial Sequence
  Synthetic
ugugcgcccagcgccgacacguc

SEQ ID NO: 4455 - RNA, 24 nt, Artificial Sequence
  Synthetic
cugugcgcccagcgccgacacguc

SEQ ID NO: 4456 - RNA, 18 nt, Artificial Sequence
  Synthetic
ucuucgucuucggggguc

SEQ ID NO: 4457 - RNA, 19 nt, Artificial Sequence
  Synthetic
uucuucgucuucggggguc

SEQ ID NO: 4458 - RNA, 20 nt, Artificial Sequence
  Synthetic
cuucuucgucuucggggguc

SEQ ID NO: 4459 - RNA, 21 nt, Artificial Sequence
  Synthetic
ucuucuucgucuucggggguc

SEQ ID NO: 4460 - RNA, 22 nt, Artificial Sequence
  Synthetic
cucuucuucgucuucggggguc

SEQ ID NO: 4461 - RNA, 23 nt, Artificial Sequence
  Synthetic
gcucuucuucgucuucggggguc

SEQ ID NO: 4462 - RNA, 24 nt, Artificial Sequence
  Synthetic
cgcucuucuucgucuucggggguc

SEQ ID NO: 4463 - RNA, 18 nt, Artificial Sequence
  Synthetic
gggaccacgcgcggguuc

SEQ ID NO: 4464 - RNA, 19 nt, Artificial Sequence
  Synthetic
ggggaccacgcgcggguuc

SEQ ID NO: 4465 - RNA, 20 nt, Artificial Sequence
  Synthetic
cggggaccacgcgcggguuc

SEQ ID NO: 4466 - RNA, 21 nt, Artificial Sequence
  Synthetic
ccggggaccacgcgcggguuc

SEQ ID NO: 4467 - RNA, 22 nt, Artificial Sequence
  Synthetic
cccggggaccacgcgcggguuc

SEQ ID NO: 4468 - RNA, 23 nt, Artificial Sequence
  Synthetic
ccccggggaccacgcgcggguuc

SEQ ID NO: 4469 - RNA, 24 nt, Artificial Sequence
  Synthetic
uccccggggaccacgcgcggguuc

SEQ ID NO: 4470 - RNA, 18 nt, Artificial Sequence
  Synthetic
gcggcggcggcggggaag

SEQ ID NO: 4471 - RNA, 19 nt, Artificial Sequence
  Synthetic
ugcggcggcggcggggaag

SEQ ID NO: 4472 - RNA, 20 nt, Artificial Sequence
  Synthetic
gugcggcggcggcggggaag

SEQ ID NO: 4473 - RNA, 21 nt, Artificial Sequence
  Synthetic
cgugcggcggcggcggggaag

SEQ ID NO: 4474 - RNA, 22 nt, Artificial Sequence
  Synthetic
gcgugcggcggcggcggggaag

SEQ ID NO: 4475 - RNA, 23 nt, Artificial Sequence
  Synthetic
ggcgugcggcggcggcggggaag

SEQ ID NO: 4476 - RNA, 24 nt, Artificial Sequence
  Synthetic
cggcgugcggcggcggcggggaag

SEQ ID NO: 4477 - RNA, 18 nt, Artificial Sequence
  Synthetic
gucgccgcgcagcaccag

SEQ ID NO: 4478 - RNA, 19 nt, Artificial Sequence
  Synthetic
cgucgccgcgcagcaccag

SEQ ID NO: 4479 - RNA, 20 nt, Artificial Sequence
  Synthetic
ucgucgccgcgcagcaccag

SEQ ID NO: 4480 - RNA, 21 nt, Artificial Sequence
  Synthetic
gucgucgccgcgcagcaccag

SEQ ID NO: 4481 - RNA, 22 nt, Artificial Sequence
  Synthetic
cgucgucgccgcgcagcaccag

SEQ ID NO: 4482 - RNA, 23 nt, Artificial Sequence
  Synthetic
ucgucgucgccgcgcagcaccag

SEQ ID NO: 4483 - RNA, 24 nt, Artificial Sequence
  Synthetic
gucgucgucgccgcgcagcaccag

SEQ ID NO: 4484 - RNA, 18 nt, Artificial Sequence
  Synthetic
gcgugcgccaggccccag

SEQ ID NO: 4485 - RNA, 19 nt, Artificial Sequence
  Synthetic
cgcgugcgccaggccccag

SEQ ID NO: 4486 - RNA, 20 nt, Artificial Sequence
  Synthetic
ccgcgugcgccaggccccag

SEQ ID NO: 4487 - RNA, 21 nt, Artificial Sequence
  Synthetic
gccgcgugcgccaggccccag

SEQ ID NO: 4488 - RNA, 22 nt, Artificial Sequence
  Synthetic
cgccgcgugcgccaggccccag

SEQ ID NO: 4489 - RNA, 23 nt, Artificial Sequence
  Synthetic
ccgccgcgugcgccaggccccag

SEQ ID NO: 4490 - RNA, 24 nt, Artificial Sequence
  Synthetic
gccgccgcgugcgccaggccccag

SEQ ID NO: 4491 - RNA, 18 nt, Artificial Sequence
  Synthetic
cgccauggcguagcccag

SEQ ID NO: 4492 - RNA, 19 nt, Artificial Sequence
  Synthetic
ccgccauggcguagcccag

SEQ ID NO: 4493 - RNA, 20 nt, Artificial Sequence
  Synthetic
gccgccauggcguagcccag

SEQ ID NO: 4494 - RNA, 21 nt, Artificial Sequence
  Synthetic
ggccgccauggcguagcccag

SEQ ID NO: 4495 - RNA, 22 nt, Artificial Sequence
  Synthetic
cggccgccauggcguagcccag

SEQ ID NO: 4496 - RNA, 23 nt, Artificial Sequence
  Synthetic
ccggccgccauggcguagcccag

SEQ ID NO: 4497 - RNA, 24 nt, Artificial Sequence
  Synthetic
gccggccgccauggcguagcccag

SEQ ID NO: 4498 - RNA, 18 nt, Artificial Sequence
  Synthetic
gcuggccgccgccgccag

SEQ ID NO: 4499 - RNA, 19 nt, Artificial Sequence
  Synthetic
cgcuggccgccgccgccag

SEQ ID NO: 4500 - RNA, 20 nt, Artificial Sequence
  Synthetic
gcgcuggccgccgccgccag

SEQ ID NO: 4501 - RNA, 21 nt, Artificial Sequence
  Synthetic
ugcgcuggccgccgccgccag

SEQ ID NO: 4502 - RNA, 22 nt, Artificial Sequence
  Synthetic
gugcgcuggccgccgccgccag

SEQ ID NO: 4503 - RNA, 23 nt, Artificial Sequence
  Synthetic
ggugcgcuggccgccgccgccag

SEQ ID NO: 4504 - RNA, 24 nt, Artificial Sequence
  Synthetic
cggugcgcuggccgccgccgccag

SEQ ID NO: 4505 - RNA, 18 nt, Artificial Sequence
  Synthetic
gucgucgucgggcuccag

SEQ ID NO: 4506 - RNA, 19 nt, Artificial Sequence
  Synthetic
cgucgucgucgggcuccag

SEQ ID NO: 4507 - RNA, 20 nt, Artificial Sequence
  Synthetic
gcgucgucgucgggcuccag

SEQ ID NO: 4508 - RNA, 21 nt, Artificial Sequence
  Synthetic
ggcgucgucgucgggcuccag

SEQ ID NO: 4509 - RNA, 22 nt, Artificial Sequence
  Synthetic
gggcgucgucgucgggcuccag

SEQ ID NO: 4510 - RNA, 23 nt, Artificial Sequence
  Synthetic
ggggcgucgucgucgggcuccag

SEQ ID NO: 4511 - RNA, 24 nt, Artificial Sequence
  Synthetic
gggggcgucgucgucgggcuccag

SEQ ID NO: 4512 - RNA, 18 nt, Artificial Sequence
  Synthetic
gcgcagccacgcgcgcag

SEQ ID NO: 4513 - RNA, 19 nt, Artificial Sequence
  Synthetic
cgcgcagccacgcgcgcag

SEQ ID NO: 4514 - RNA, 20 nt, Artificial Sequence
  Synthetic
ucgcgcagccacgcgcgcag

SEQ ID NO: 4515 - RNA, 21 nt, Artificial Sequence
  Synthetic
cucgcgcagccacgcgcgcag

SEQ ID NO: 4516 - RNA, 22 nt, Artificial Sequence
  Synthetic
gcucgcgcagccacgcgcgcag

SEQ ID NO: 4517 - RNA, 23 nt, Artificial Sequence
  Synthetic
agcucgcgcagccacgcgcgcag

SEQ ID NO: 4518 - RNA, 24 nt, Artificial Sequence
  Synthetic
cagcucgcgcagccacgcgcgcag

SEQ ID NO: 4519 - RNA, 18 nt, Artificial Sequence
  Synthetic
gcggcgcaggcuggucag

SEQ ID NO: 4520 - RNA, 19 nt, Artificial Sequence
  Synthetic
cgcggcgcaggcuggucag

SEQ ID NO: 4521 - RNA, 20 nt, Artificial Sequence
  Synthetic
gcgcggcgcaggcuggucag

SEQ ID NO: 4522 - RNA, 21 nt, Artificial Sequence
  Synthetic
ggcgcggcgcaggcuggucag

SEQ ID NO: 4523 - RNA, 22 nt, Artificial Sequence
  Synthetic
aggcgcggcgcaggcuggucag

SEQ ID NO: 4524 - RNA, 23 nt, Artificial Sequence
  Synthetic
uaggcgcggcgcaggcuggucag

SEQ ID NO: 4525 - RNA, 24 nt, Artificial Sequence
  Synthetic
guaggcgcggcgcaggcuggucag

SEQ ID NO: 4526 - RNA, 18 nt, Artificial Sequence
  Synthetic
gggcgcggccucggagag

SEQ ID NO: 4527 - RNA, 19 nt, Artificial Sequence
  Synthetic
ugggcgcggccucggagag

SEQ ID NO: 4528 - RNA, 20 nt, Artificial Sequence
  Synthetic
uugggcgcggccucggagag

SEQ ID NO: 4529 - RNA, 21 nt, Artificial Sequence
  Synthetic
cuugggcgcggccucggagag

SEQ ID NO: 4530 - RNA, 22 nt, Artificial Sequence
  Synthetic
gcuugggcgcggccucggagag

SEQ ID NO: 4531 - RNA, 23 nt, Artificial Sequence
  Synthetic
ggcuugggcgcggccucggagag

SEQ ID NO: 4532 - RNA, 24 nt, Artificial Sequence
  Synthetic
gggcuugggcgcggccucggagag

SEQ ID NO: 4533 - RNA, 18 nt, Artificial Sequence
  Synthetic
ggggcgcgggcguccgag

SEQ ID NO: 4534 - RNA, 19 nt, Artificial Sequence
  Synthetic
gggggcgcgggcguccgag

SEQ ID NO: 4535 - RNA, 20 nt, Artificial Sequence
  Synthetic
ggggggcgcgggcguccgag

SEQ ID NO: 4536 - RNA, 21 nt, Artificial Sequence
  Synthetic
aggggggcgcgggcguccgag

SEQ ID NO: 4537 - RNA, 22 nt, Artificial Sequence
  Synthetic
gaggggggcgcgggcguccgag

SEQ ID NO: 4538 - RNA, 23 nt, Artificial Sequence
  Synthetic
ggaggggggcgcgggcguccgag

SEQ ID NO: 4539 - RNA, 24 nt, Artificial Sequence
  Synthetic
gggaggggggcgcgggcguccgag

SEQ ID NO: 4540 - RNA, 18 nt, Artificial Sequence
  Synthetic
uugggcgcggccucggag

SEQ ID NO: 4541 - RNA, 19 nt, Artificial Sequence
  Synthetic
cuugggcgcggccucggag

SEQ ID NO: 4542 - RNA, 20 nt, Artificial Sequence
  Synthetic
gcuugggcgcggccucggag

SEQ ID NO: 4543 - RNA, 21 nt, Artificial Sequence
  Synthetic
ggcuugggcgcggccucggag

SEQ ID NO: 4544 - RNA, 22 nt, Artificial Sequence
  Synthetic
gggcuugggcgcggccucggag

SEQ ID NO: 4545 - RNA, 23 nt, Artificial Sequence
  Synthetic
ggggcuugggcgcggccucggag

SEQ ID NO: 4546 - RNA, 24 nt, Artificial Sequence
  Synthetic
cggggcuugggcgcggccucggag

SEQ ID NO: 4547 - RNA, 18 nt, Artificial Sequence
  Synthetic
gggcgcgggcgcggggag

SEQ ID NO: 4548 - RNA, 19 nt, Artificial Sequence
  Synthetic
ggggcgcgggcgcggggag

SEQ ID NO: 4549 - RNA, 20 nt, Artificial Sequence
  Synthetic
gggggcgcgggcgcggggag

SEQ ID NO: 4550 - RNA, 21 nt, Artificial Sequence
  Synthetic
ggggggcgcgggcgcggggag

SEQ ID NO: 4551 - RNA, 22 nt, Artificial Sequence
  Synthetic
aggggggcgcgggcgcggggag

SEQ ID NO: 4552 - RNA, 23 nt, Artificial Sequence
  Synthetic
gaggggggcgcgggcgcggggag

SEQ ID NO: 4553 - RNA, 24 nt, Artificial Sequence
  Synthetic
ggaggggggcgcgggcgcggggag

SEQ ID NO: 4554 - RNA, 18 nt, Artificial Sequence
  Synthetic
ucgccccccgcgggggag

SEQ ID NO: 4555 - RNA, 19 nt, Artificial Sequence
  Synthetic
gucgccccccgcgggggag

SEQ ID NO: 4556 - RNA, 20 nt, Artificial Sequence
  Synthetic
cgucgccccccgcgggggag

SEQ ID NO: 4557 - RNA, 21 nt, Artificial Sequence
  Synthetic
ucgucgccccccgcgggggag

SEQ ID NO: 4558 - RNA, 22 nt, Artificial Sequence
  Synthetic
gucgucgccccccgcgggggag

SEQ ID NO: 4559 - RNA, 23 nt, Artificial Sequence
  Synthetic
ggucgucgccccccgcgggggag

SEQ ID NO: 4560 - RNA, 24 nt, Artificial Sequence
  Synthetic
gggucgucgccccccgcgggggag

SEQ ID NO: 4561 - RNA, 18 nt, Artificial Sequence
  Synthetic
ggccccgggggcguggag

SEQ ID NO: 4562 - RNA, 19 nt, Artificial Sequence
  Synthetic
gggccccgggggcguggag

SEQ ID NO: 4563 - RNA, 20 nt, Artificial Sequence
  Synthetic
cgggccccgggggcguggag

SEQ ID NO: 4564 - RNA, 21 nt, Artificial Sequence
  Synthetic
ucgggccccgggggcguggag

SEQ ID NO: 4565 - RNA, 22 nt, Artificial Sequence
  Synthetic
cucgggccccgggggcguggag

SEQ ID NO: 4566 - RNA, 23 nt, Artificial Sequence
  Synthetic
gcucgggccccgggggcguggag

SEQ ID NO: 4567 - RNA, 24 nt, Artificial Sequence
  Synthetic
ggcucgggccccgggggcguggag

SEQ ID NO: 4568 - RNA, 18 nt, Artificial Sequence
  Synthetic
gcgcccagcgccgacacg

SEQ ID NO: 4569 - RNA, 19 nt, Artificial Sequence
  Synthetic
ugcgcccagcgccgacacg

SEQ ID NO: 4570 - RNA, 20 nt, Artificial Sequence
  Synthetic
gugcgcccagcgccgacacg

SEQ ID NO: 4571 - RNA, 21 nt, Artificial Sequence
  Synthetic
ugugcgcccagcgccgacacg

SEQ ID NO: 4572 - RNA, 22 nt, Artificial Sequence
  Synthetic
cugugcgcccagcgccgacacg

SEQ ID NO: 4573 - RNA, 23 nt, Artificial Sequence
  Synthetic
ccugugcgcccagcgccgacacg

SEQ ID NO: 4574 - RNA, 24 nt, Artificial Sequence
  Synthetic
cccugugcgcccagcgccgacacg

SEQ ID NO: 4575 - RNA, 18 nt, Artificial Sequence
  Synthetic
cgcacgguguugaccacg

SEQ ID NO: 4576 - RNA, 19 nt, Artificial Sequence
  Synthetic
gcgcacgguguugaccacg

SEQ ID NO: 4577 - RNA, 20 nt, Artificial Sequence
  Synthetic
cgcgcacgguguugaccacg

SEQ ID NO: 4578 - RNA, 21 nt, Artificial Sequence
  Synthetic
gcgcgcacgguguugaccacg

SEQ ID NO: 4579 - RNA, 22 nt, Artificial Sequence
  Synthetic
ggcgcgcacgguguugaccacg

SEQ ID NO: 4580 - RNA, 23 nt, Artificial Sequence
  Synthetic
aggcgcgcacgguguugaccacg

SEQ ID NO: 4581 - RNA, 24 nt, Artificial Sequence
  Synthetic
caggcgcgcacgguguugaccacg

SEQ ID NO: 4582 - RNA, 18 nt, Artificial Sequence
  Synthetic
cgcacggcgcacugcacg

SEQ ID NO: 4583 - RNA, 19 nt, Artificial Sequence
  Synthetic
gcgcacggcgcacugcacg

SEQ ID NO: 4584 - RNA, 20 nt, Artificial Sequence
  Synthetic
agcgcacggcgcacugcacg

SEQ ID NO: 4585 - RNA, 21 nt, Artificial Sequence
  Synthetic
cagcgcacggcgcacugcacg

SEQ ID NO: 4586 - RNA, 22 nt, Artificial Sequence
  Synthetic
ccagcgcacggcgcacugcacg

SEQ ID NO: 4587 - RNA, 23 nt, Artificial Sequence
  Synthetic
gccagcgcacggcgcacugcacg

SEQ ID NO: 4588 - RNA, 24 nt, Artificial Sequence
  Synthetic
ggccagcgcacggcgcacugcacg

SEQ ID NO: 4589 - RNA, 18 nt, Artificial Sequence
  Synthetic
cgucggacgacgaggacg

SEQ ID NO: 4590 - RNA, 19 nt, Artificial Sequence
  Synthetic
ucgucggacgacgaggacg

SEQ ID NO: 4591 - RNA, 20 nt, Artificial Sequence
  Synthetic
cucgucggacgacgaggacg

SEQ ID NO: 4592 - RNA, 21 nt, Artificial Sequence
  Synthetic
ccucgucggacgacgaggacg

SEQ ID NO: 4593 - RNA, 22 nt, Artificial Sequence
  Synthetic
uccucgucggacgacgaggacg

SEQ ID NO: 4594 - RNA, 23 nt, Artificial Sequence
  Synthetic
guccucgucggacgacgaggacg

SEQ ID NO: 4595 - RNA, 24 nt, Artificial Sequence
  Synthetic
cguccucgucggacgacgaggacg

SEQ ID NO: 4596 - RNA, 18 nt, Artificial Sequence
  Synthetic
acgaagaggaugcggacg

SEQ ID NO: 4597 - RNA, 19 nt, Artificial Sequence
  Synthetic
gacgaagaggaugcggacg

SEQ ID NO: 4598 - RNA, 20 nt, Artificial Sequence
  Synthetic
ggacgaagaggaugcggacg

SEQ ID NO: 4599 - RNA, 21 nt, Artificial Sequence
  Synthetic
aggacgaagaggaugcggacg

SEQ ID NO: 4600 - RNA, 22 nt, Artificial Sequence
  Synthetic
gaggacgaagaggaugcggacg

SEQ ID NO: 4601 - RNA, 23 nt, Artificial Sequence
  Synthetic
cgaggacgaagaggaugcggacg

SEQ ID NO: 4602 - RNA, 24 nt, Artificial Sequence
  Synthetic
acgaggacgaagaggaugcggacg

SEQ ID NO: 4603 - RNA, 18 nt, Artificial Sequence
  Synthetic
ccucguccucgucggacg

SEQ ID NO: 4604 - RNA, 19 nt, Artificial Sequence
  Synthetic
uccucguccucgucggacg

SEQ ID NO: 4605 - RNA, 20 nt, Artificial Sequence
  Synthetic
guccucguccucgucggacg

SEQ ID NO: 4606 - RNA, 21 nt, Artificial Sequence
  Synthetic
cguccucguccucgucggacg

SEQ ID NO: 4607 - RNA, 22 nt, Artificial Sequence
  Synthetic
ucguccucguccucgucggacg

SEQ ID NO: 4608 - RNA, 23 nt, Artificial Sequence
  Synthetic
gucguccucguccucgucggacg

SEQ ID NO: 4609 - RNA, 24 nt, Artificial Sequence
  Synthetic
cgucguccucguccucgucggacg

SEQ ID NO: 4610 - RNA, 18 nt, Artificial Sequence
  Synthetic
gccggucgccaggggacg

SEQ ID NO: 4611 - RNA, 19 nt, Artificial Sequence
  Synthetic
ggccggucgccaggggacg

SEQ ID NO: 4612 - RNA, 20 nt, Artificial Sequence
  Synthetic
gggccggucgccaggggacg

SEQ ID NO: 4613 - RNA, 21 nt, Artificial Sequence
  Synthetic
agggccggucgccaggggacg

SEQ ID NO: 4614 - RNA, 22 nt, Artificial Sequence
  Synthetic
gagggccggucgccaggggacg

SEQ ID NO: 4615 - RNA, 23 nt, Artificial Sequence
  Synthetic
ugagggccggucgccaggggacg

SEQ ID NO: 4616 - RNA, 24 nt, Artificial Sequence
  Synthetic
augagggccggucgccaggggacg

SEQ ID NO: 4617 - RNA, 18 nt, Artificial Sequence
  Synthetic
ggcguccagcucgacccg

SEQ ID NO: 4618 - RNA, 19 nt, Artificial Sequence
  Synthetic
cggcguccagcucgacccg

SEQ ID NO: 4619 - RNA, 20 nt, Artificial Sequence
  Synthetic
ucggcguccagcucgacccg

SEQ ID NO: 4620 - RNA, 21 nt, Artificial Sequence
  Synthetic
gucggcguccagcucgacccg

SEQ ID NO: 4621 - RNA, 22 nt, Artificial Sequence
  Synthetic
cgucggcguccagcucgacccg

SEQ ID NO: 4622 - RNA, 23 nt, Artificial Sequence
  Synthetic
gcgucggcguccagcucgacccg

SEQ ID NO: 4623 - RNA, 24 nt, Artificial Sequence
  Synthetic
cgcgucggcguccagcucgacccg

SEQ ID NO: 4624 - RNA, 18 nt, Artificial Sequence
  Synthetic
cccgcggcgccguacccg

SEQ ID NO: 4625 - RNA, 19 nt, Artificial Sequence
  Synthetic
ccccgcggcgccguacccg

SEQ ID NO: 4626 - RNA, 20 nt, Artificial Sequence
  Synthetic
uccccgcggcgccguacccg

SEQ ID NO: 4627 - RNA, 21 nt, Artificial Sequence
  Synthetic
auccccgcggcgccguacccg

SEQ ID NO: 4628 - RNA, 22 nt, Artificial Sequence
  Synthetic
gauccccgcggcgccguacccg

SEQ ID NO: 4629 - RNA, 23 nt, Artificial Sequence
  Synthetic
ggauccccgcggcgccguacccg

SEQ ID NO: 4630 - RNA, 24 nt, Artificial Sequence
  Synthetic
aggauccccgcggcgccguacccg

SEQ ID NO: 4631 - RNA, 18 nt, Artificial Sequence
  Synthetic
cggggucgucgccccccg

SEQ ID NO: 4632 - RNA, 19 nt, Artificial Sequence
  Synthetic
ucggggucgucgccccccg

SEQ ID NO: 4633 - RNA, 20 nt, Artificial Sequence
  Synthetic
gucggggucgucgccccccg

SEQ ID NO: 4634 - RNA, 21 nt, Artificial Sequence
  Synthetic
cgucggggucgucgccccccg

SEQ ID NO: 4635 - RNA, 22 nt, Artificial Sequence
  Synthetic
gcgucggggucgucgccccccg

SEQ ID NO: 4636 - RNA, 23 nt, Artificial Sequence
  Synthetic
ggcgucggggucgucgccccccg

SEQ ID NO: 4637 - RNA, 24 nt, Artificial Sequence
  Synthetic
cggcgucggggucgucgccccccg

SEQ ID NO: 4638 - RNA, 18 nt, Artificial Sequence
  Synthetic
agaaacuccacggccccg

SEQ ID NO: 4639 - RNA, 19 nt, Artificial Sequence
  Synthetic
cagaaacuccacggccccg

SEQ ID NO: 4640 - RNA, 20 nt, Artificial Sequence
  Synthetic
ccagaaacuccacggccccg

SEQ ID NO: 4641 - RNA, 21 nt, Artificial Sequence
  Synthetic
cccagaaacuccacggccccg

SEQ ID NO: 4642 - RNA, 22 nt, Artificial Sequence
  Synthetic
ccccagaaacuccacggccccg

SEQ ID NO: 4643 - RNA, 23 nt, Artificial Sequence
  Synthetic
gccccagaaacuccacggccccg

SEQ ID NO: 4644 - RNA, 24 nt, Artificial Sequence
  Synthetic
agccccagaaacuccacggccccg

SEQ ID NO: 4645 - RNA, 18 nt, Artificial Sequence
  Synthetic
cggcccccggcggccccg

SEQ ID NO: 4646 - RNA, 19 nt, Artificial Sequence
  Synthetic
gcggcccccggcggccccg

SEQ ID NO: 4647 - RNA, 20 nt, Artificial Sequence
  Synthetic
ggcggcccccggcggccccg

SEQ ID NO: 4648 - RNA, 21 nt, Artificial Sequence
  Synthetic
aggcggcccccggcggccccg

SEQ ID NO: 4649 - RNA, 22 nt, Artificial Sequence
  Synthetic
gaggcggcccccggcggccccg

SEQ ID NO: 4650 - RNA, 23 nt, Artificial Sequence
  Synthetic
agaggcggcccccggcggccccg

SEQ ID NO: 4651 - RNA, 24 nt, Artificial Sequence
  Synthetic
aagaggcggcccccggcggccccg

SEQ ID NO: 4652 - RNA, 18 nt, Artificial Sequence
  Synthetic
ggcgcucgaugcggcccg

SEQ ID NO: 4653 - RNA, 19 nt, Artificial Sequence
  Synthetic
cggcgcucgaugcggcccg

SEQ ID NO: 4654 - RNA, 20 nt, Artificial Sequence
  Synthetic
gcggcgcucgaugcggcccg

SEQ ID NO: 4655 - RNA, 21 nt, Artificial Sequence
  Synthetic
ggcggcgcucgaugcggcccg

SEQ ID NO: 4656 - RNA, 22 nt, Artificial Sequence
  Synthetic
cggcggcgcucgaugcggcccg

SEQ ID NO: 4657 - RNA, 23 nt, Artificial Sequence
  Synthetic
ccggcggcgcucgaugcggcccg

SEQ ID NO: 4658 - RNA, 24 nt, Artificial Sequence
  Synthetic
cccggcggcgcucgaugcggcccg

SEQ ID NO: 4659 - RNA, 18 nt, Artificial Sequence
  Synthetic
guccacaacuucccgccg

SEQ ID NO: 4660 - RNA, 19 nt, Artificial Sequence
  Synthetic
aguccacaacuucccgccg

SEQ ID NO: 4661 - RNA, 20 nt, Artificial Sequence
  Synthetic
caguccacaacuucccgccg

SEQ ID NO: 4662 - RNA, 21 nt, Artificial Sequence
  Synthetic
ccaguccacaacuucccgccg

SEQ ID NO: 4663 - RNA, 22 nt, Artificial Sequence
  Synthetic
cccaguccacaacuucccgccg

SEQ ID NO: 4664 - RNA, 23 nt, Artificial Sequence
  Synthetic
ucccaguccacaacuucccgccg

SEQ ID NO: 4665 - RNA, 24 nt, Artificial Sequence
  Synthetic
uucccaguccacaacuucccgccg

SEQ ID NO: 4666 - RNA, 18 nt, Artificial Sequence
  Synthetic
acggccgccaggucgccg

SEQ ID NO: 4667 - RNA, 19 nt, Artificial Sequence
  Synthetic
gacggccgccaggucgccg

SEQ ID NO: 4668 - RNA, 20 nt, Artificial Sequence
  Synthetic
ggacggccgccaggucgccg

SEQ ID NO: 4669 - RNA, 21 nt, Artificial Sequence
  Synthetic
gggacggccgccaggucgccg

SEQ ID NO: 4670 - RNA, 22 nt, Artificial Sequence
  Synthetic
cgggacggccgccaggucgccg

SEQ ID NO: 4671 - RNA, 23 nt, Artificial Sequence
  Synthetic
ccgggacggccgccaggucgccg

SEQ ID NO: 4672 - RNA, 24 nt, Artificial Sequence
  Synthetic
cccgggacggccgccaggucgccg

SEQ ID NO: 4673 - RNA, 18 nt, Artificial Sequence
  Synthetic
ugcggcccgcggaggccg

SEQ ID NO: 4674 - RNA, 19 nt, Artificial Sequence
  Synthetic
augcggcccgcggaggccg

SEQ ID NO: 4675 - RNA, 20 nt, Artificial Sequence
  Synthetic
gaugcggcccgcggaggccg

SEQ ID NO: 4676 - RNA, 21 nt, Artificial Sequence
  Synthetic
cgaugcggcccgcggaggccg

SEQ ID NO: 4677 - RNA, 22 nt, Artificial Sequence
  Synthetic
ucgaugcggcccgcggaggccg

SEQ ID NO: 4678 - RNA, 23 nt, Artificial Sequence
  Synthetic
cucgaugcggcccgcggaggccg

SEQ ID NO: 4679 - RNA, 24 nt, Artificial Sequence
  Synthetic
gcucgaugcggcccgcggaggccg

SEQ ID NO: 4680 - RNA, 18 nt, Artificial Sequence
  Synthetic
cgggcgcccacacggccg

SEQ ID NO: 4681 - RNA, 19 nt, Artificial Sequence
  Synthetic
ucgggcgcccacacggccg

SEQ ID NO: 4682 - RNA, 20 nt, Artificial Sequence
  Synthetic
cucgggcgcccacacggccg

SEQ ID NO: 4683 - RNA, 21 nt, Artificial Sequence
  Synthetic
gcucgggcgcccacacggccg

SEQ ID NO: 4684 - RNA, 22 nt, Artificial Sequence
  Synthetic
agcucgggcgcccacacggccg

SEQ ID NO: 4685 - RNA, 23 nt, Artificial Sequence
  Synthetic
cagcucgggcgcccacacggccg

SEQ ID NO: 4686 - RNA, 24 nt, Artificial Sequence
  Synthetic
ccagcucgggcgcccacacggccg

SEQ ID NO: 4687 - RNA, 18 nt, Artificial Sequence
  Synthetic
cgcgggucccuccggccg

SEQ ID NO: 4688 - RNA, 19 nt, Artificial Sequence
  Synthetic
ccgcgggucccuccggccg

SEQ ID NO: 4689 - RNA, 20 nt, Artificial Sequence
  Synthetic
cccgcgggucccuccggccg

SEQ ID NO: 4690 - RNA, 21 nt, Artificial Sequence
  Synthetic
gcccgcgggucccuccggccg

SEQ ID NO: 4691 - RNA, 22 nt, Artificial Sequence
  Synthetic
ggcccgcgggucccuccggccg

SEQ ID NO: 4692 - RNA, 23 nt, Artificial Sequence
  Synthetic
gggcccgcgggucccuccggccg

SEQ ID NO: 4693 - RNA, 24 nt, Artificial Sequence
  Synthetic
ggggcccgcgggucccuccggccg

SEQ ID NO: 4694 - RNA, 18 nt, Artificial Sequence
  Synthetic
ccgcggcggcggcggccg

SEQ ID NO: 4695 - RNA, 19 nt, Artificial Sequence
  Synthetic
uccgcggcggcggcggccg

SEQ ID NO: 4696 - RNA, 20 nt, Artificial Sequence
  Synthetic
guccgcggcggcggcggccg

SEQ ID NO: 4697 - RNA, 21 nt, Artificial Sequence
  Synthetic
gguccgcggcggcggcggccg

SEQ ID NO: 4698 - RNA, 22 nt, Artificial Sequence
  Synthetic
agguccgcggcggcggcggccg

SEQ ID NO: 4699 - RNA, 23 nt, Artificial Sequence
  Synthetic
cagguccgcggcggcggcggccg

SEQ ID NO: 4700 - RNA, 24 nt, Artificial Sequence
  Synthetic
gcagguccgcggcggcggcggccg

SEQ ID NO: 4701 - RNA, 18 nt, Artificial Sequence
  Synthetic
acgaggacccggaguccg

SEQ ID NO: 4702 - RNA, 19 nt, Artificial Sequence
  Synthetic
gacgaggacccggaguccg

SEQ ID NO: 4703 - RNA, 20 nt, Artificial Sequence
  Synthetic
ggacgaggacccggaguccg

SEQ ID NO: 4704 - RNA, 21 nt, Artificial Sequence
  Synthetic
aggacgaggacccggaguccg

SEQ ID NO: 4705 - RNA, 22 nt, Artificial Sequence
  Synthetic
gaggacgaggacccggaguccg

SEQ ID NO: 4706 - RNA, 23 nt, Artificial Sequence
  Synthetic
cgaggacgaggacccggaguccg

SEQ ID NO: 4707 - RNA, 24 nt, Artificial Sequence
  Synthetic
acgaggacgaggacccggaguccg

SEQ ID NO: 4708 - RNA, 18 nt, Artificial Sequence
  Synthetic
cgccgcgcagcaccagcg

SEQ ID NO: 4709 - RNA, 19 nt, Artificial Sequence
  Synthetic
ucgccgcgcagcaccagcg

SEQ ID NO: 4710 - RNA, 20 nt, Artificial Sequence
  Synthetic
gucgccgcgcagcaccagcg

SEQ ID NO: 4711 - RNA, 21 nt, Artificial Sequence
  Synthetic
cgucgccgcgcagcaccagcg

SEQ ID NO: 4712 - RNA, 22 nt, Artificial Sequence
  Synthetic
ucgucgccgcgcagcaccagcg

SEQ ID NO: 4713 - RNA, 23 nt, Artificial Sequence
  Synthetic
gucgucgccgcgcagcaccagcg

SEQ ID NO: 4714 - RNA, 24 nt, Artificial Sequence
  Synthetic
cgucgucgccgcgcagcaccagcg

SEQ ID NO: 4715 - RNA, 18 nt, Artificial Sequence
  Synthetic
gcgggucccgcggcagcg

SEQ ID NO: 4716 - RNA, 19 nt, Artificial Sequence
  Synthetic
cgcgggucccgcggcagcg

SEQ ID NO: 4717 - RNA, 20 nt, Artificial Sequence
  Synthetic
gcgcgggucccgcggcagcg

SEQ ID NO: 4718 - RNA, 21 nt, Artificial Sequence
  Synthetic
ggcgcgggucccgcggcagcg

SEQ ID NO: 4719 - RNA, 22 nt, Artificial Sequence
  Synthetic
aggcgcgggucccgcggcagcg

SEQ ID NO: 4720 - RNA, 23 nt, Artificial Sequence
  Synthetic
caggcgcgggucccgcggcagcg

SEQ ID NO: 4721 - RNA, 24 nt, Artificial Sequence
  Synthetic
gcaggcgcgggucccgcggcagcg

SEQ ID NO: 4722 - RNA, 18 nt, Artificial Sequence
  Synthetic
gggucgucgccccccgcg

SEQ ID NO: 4723 - RNA, 19 nt, Artificial Sequence
  Synthetic
ggggucgucgccccccgcg

SEQ ID NO: 4724 - RNA, 20 nt, Artificial Sequence
  Synthetic
cggggucgucgccccccgcg

SEQ ID NO: 4725 - RNA, 21 nt, Artificial Sequence
  Synthetic
ucggggucgucgccccccgcg

SEQ ID NO: 4726 - RNA, 22 nt, Artificial Sequence
  Synthetic
gucggggucgucgccccccgcg

SEQ ID NO: 4727 - RNA, 23 nt, Artificial Sequence
  Synthetic
cgucggggucgucgccccccgcg

SEQ ID NO: 4728 - RNA, 24 nt, Artificial Sequence
  Synthetic
gcgucggggucgucgccccccgcg

SEQ ID NO: 4729 - RNA, 18 nt, Artificial Sequence
  Synthetic
cgggucccuccggccgcg

SEQ ID NO: 4730 - RNA, 19 nt, Artificial Sequence
  Synthetic
gcgggucccuccggccgcg

SEQ ID NO: 4731 - RNA, 20 nt, Artificial Sequence
  Synthetic
cgcgggucccuccggccgcg

SEQ ID NO: 4732 - RNA, 21 nt, Artificial Sequence
  Synthetic
ccgcgggucccuccggccgcg

SEQ ID NO: 4733 - RNA, 22 nt, Artificial Sequence
  Synthetic
cccgcgggucccuccggccgcg

SEQ ID NO: 4734 - RNA, 23 nt, Artificial Sequence
  Synthetic
gcccgcgggucccuccggccgcg

SEQ ID NO: 4735 - RNA, 24 nt, Artificial Sequence
  Synthetic
ggcccgcgggucccuccggccgcg

SEQ ID NO: 4736 - RNA, 18 nt, Artificial Sequence
  Synthetic
ccgucgcgauagcgcgcg

SEQ ID NO: 4737 - RNA, 19 nt, Artificial Sequence
  Synthetic
cccgucgcgauagcgcgcg

SEQ ID NO: 4738 - RNA, 20 nt, Artificial Sequence
  Synthetic
acccgucgcgauagcgcgcg

SEQ ID NO: 4739 - RNA, 21 nt, Artificial Sequence
  Synthetic
uacccgucgcgauagcgcgcg

SEQ ID NO: 4740 - RNA, 22 nt, Artificial Sequence
  Synthetic
guacccgucgcgauagcgcgcg

SEQ ID NO: 4741 - RNA, 23 nt, Artificial Sequence
  Synthetic
cguacccgucgcgauagcgcgcg

SEQ ID NO: 4742 - RNA, 24 nt, Artificial Sequence
  Synthetic
acguacccgucgcgauagcgcgcg

SEQ ID NO: 4743 - RNA, 18 nt, Artificial Sequence
  Synthetic
gcucggccacggcgcgcg

SEQ ID NO: 4744 - RNA, 19 nt, Artificial Sequence
  Synthetic
agcucggccacggcgcgcg

SEQ ID NO: 4745 - RNA, 20 nt, Artificial Sequence
  Synthetic
gagcucggccacggcgcgcg

SEQ ID NO: 4746 - RNA, 21 nt, Artificial Sequence
  Synthetic
ugagcucggccacggcgcgcg

SEQ ID NO: 4747 - RNA, 22 nt, Artificial Sequence
  Synthetic
gugagcucggccacggcgcgcg

SEQ ID NO: 4748 - RNA, 23 nt, Artificial Sequence
  Synthetic
cgugagcucggccacggcgcgcg

SEQ ID NO: 4749 - RNA, 24 nt, Artificial Sequence
  Synthetic
ccgugagcucggccacggcgcgcg

SEQ ID NO: 4750 - RNA, 18 nt, Artificial Sequence
  Synthetic
cagcgggcccgaggcgcg

SEQ ID NO: 4751 - RNA, 19 nt, Artificial Sequence
  Synthetic
gcagcgggcccgaggcgcg

SEQ ID NO: 4752 - RNA, 20 nt, Artificial Sequence
  Synthetic
cgcagcgggcccgaggcgcg

SEQ ID NO: 4753 - RNA, 21 nt, Artificial Sequence
  Synthetic
gcgcagcgggcccgaggcgcg

SEQ ID NO: 4754 - RNA, 22 nt, Artificial Sequence
  Synthetic
ggcgcagcgggcccgaggcgcg

SEQ ID NO: 4755 - RNA, 23 nt, Artificial Sequence
  Synthetic
cggcgcagcgggcccgaggcgcg

SEQ ID NO: 4756 - RNA, 24 nt, Artificial Sequence
  Synthetic
gcggcgcagcgggcccgaggcgcg

SEQ ID NO: 4757 - RNA, 18 nt, Artificial Sequence
  Synthetic
gagcucggccacggcgcg

SEQ ID NO: 4758 - RNA, 19 nt, Artificial Sequence
  Synthetic
ugagcucggccacggcgcg

SEQ ID NO: 4759 - RNA, 20 nt, Artificial Sequence
  Synthetic
gugagcucggccacggcgcg

SEQ ID NO: 4760 - RNA, 21 nt, Artificial Sequence
  Synthetic
cgugagcucggccacggcgcg

SEQ ID NO: 4761 - RNA, 22 nt, Artificial Sequence
  Synthetic
ccgugagcucggccacggcgcg

SEQ ID NO: 4762 - RNA, 23 nt, Artificial Sequence
  Synthetic
uccgugagcucggccacggcgcg

SEQ ID NO: 4763 - RNA, 24 nt, Artificial Sequence
  Synthetic
guccgugagcucggccacggcgcg

SEQ ID NO: 4764 - RNA, 18 nt, Artificial Sequence
  Synthetic
ucgcagaaguccggcgcg

SEQ ID NO: 4765 - RNA, 19 nt, Artificial Sequence
  Synthetic
cucgcagaaguccggcgcg

SEQ ID NO: 4766 - RNA, 20 nt, Artificial Sequence
  Synthetic
ccucgcagaaguccggcgcg

SEQ ID NO: 4767 - RNA, 21 nt, Artificial Sequence
  Synthetic
uccucgcagaaguccggcgcg

SEQ ID NO: 4768 - RNA, 22 nt, Artificial Sequence
  Synthetic
cuccucgcagaaguccggcgcg

SEQ ID NO: 4769 - RNA, 23 nt, Artificial Sequence
  Synthetic
ccuccucgcagaaguccggcgcg

SEQ ID NO: 4770 - RNA, 24 nt, Artificial Sequence
  Synthetic
uccuccucgcagaaguccggcgcg

SEQ ID NO: 4771 - RNA, 18 nt, Artificial Sequence
  Synthetic
cgccccucccgcggcgcg

SEQ ID NO: 4772 - RNA, 19 nt, Artificial Sequence
  Synthetic
gcgccccucccgcggcgcg

SEQ ID NO: 4773 - RNA, 20 nt, Artificial Sequence
  Synthetic
ugcgccccucccgcggcgcg

SEQ ID NO: 4774 - RNA, 21 nt, Artificial Sequence
  Synthetic
uugcgccccucccgcggcgcg

SEQ ID NO: 4775 - RNA, 22 nt, Artificial Sequence
  Synthetic
cuugcgccccucccgcggcgcg

SEQ ID NO: 4776 - RNA, 23 nt, Artificial Sequence
  Synthetic
gcuugcgccccucccgcggcgcg

SEQ ID NO: 4777 - RNA, 24 nt, Artificial Sequence
  Synthetic
cgcuugcgccccucccgcggcgcg

SEQ ID NO: 4778 - RNA, 18 nt, Artificial Sequence
  Synthetic
aggcgcagcggcggcgcg

SEQ ID NO: 4779 - RNA, 19 nt, Artificial Sequence
  Synthetic
caggcgcagcggcggcgcg

SEQ ID NO: 4780 - RNA, 20 nt, Artificial Sequence
  Synthetic
acaggcgcagcggcggcgcg

SEQ ID NO: 4781 - RNA, 21 nt, Artificial Sequence
  Synthetic
cacaggcgcagcggcggcgcg

SEQ ID NO: 4782 - RNA, 22 nt, Artificial Sequence
  Synthetic
gcacaggcgcagcggcggcgcg

SEQ ID NO: 4783 - RNA, 23 nt, Artificial Sequence
  Synthetic
ggcacaggcgcagcggcggcgcg

SEQ ID NO: 4784 - RNA, 24 nt, Artificial Sequence
  Synthetic
cggcacaggcgcagcggcggcgcg

SEQ ID NO: 4785 - RNA, 18 nt, Artificial Sequence
  Synthetic
gaggggggcgcgggcgcg

SEQ ID NO: 4786 - RNA, 19 nt, Artificial Sequence
  Synthetic
ggaggggggcgcgggcgcg

SEQ ID NO: 4787 - RNA, 20 nt, Artificial Sequence
  Synthetic
uggaggggggcgcgggcgcg

SEQ ID NO: 4788 - RNA, 21 nt, Artificial Sequence
  Synthetic
guggaggggggcgcgggcgcg

SEQ ID NO: 4789 - RNA, 22 nt, Artificial Sequence
  Synthetic
cguggaggggggcgcgggcgcg

SEQ ID NO: 4790 - RNA, 23 nt, Artificial Sequence
  Synthetic
gcguggaggggggcgcgggcgcg

SEQ ID NO: 4791 - RNA, 24 nt, Artificial Sequence
  Synthetic
ggcguggaggggggcgcgggcgcg

SEQ ID NO: 4792 - RNA, 18 nt, Artificial Sequence
  Synthetic
gcgggggaggcgggcgcg

SEQ ID NO: 4793 - RNA, 19 nt, Artificial Sequence
  Synthetic
cgcgggggaggcgggcgcg

SEQ ID NO: 4794 - RNA, 20 nt, Artificial Sequence
  Synthetic
ccgcgggggaggcgggcgcg

SEQ ID NO: 4795 - RNA, 21 nt, Artificial Sequence
  Synthetic
cccgcgggggaggcgggcgcg

SEQ ID NO: 4796 - RNA, 22 nt, Artificial Sequence
  Synthetic
ccccgcgggggaggcgggcgcg

SEQ ID NO: 4797 - RNA, 23 nt, Artificial Sequence
  Synthetic
cccccgcgggggaggcgggcgcg

SEQ ID NO: 4798 - RNA, 24 nt, Artificial Sequence
  Synthetic
ccccccgcgggggaggcgggcgcg

SEQ ID NO: 4799 - RNA, 18 nt, Artificial Sequence
  Synthetic
ggcccggcgguacucgcg

SEQ ID NO: 4800 - RNA, 19 nt, Artificial Sequence
  Synthetic
cggcccggcgguacucgcg

SEQ ID NO: 4801 - RNA, 20 nt, Artificial Sequence
  Synthetic
acggcccggcgguacucgcg

SEQ ID NO: 4802 - RNA, 21 nt, Artificial Sequence
  Synthetic
cacggcccggcgguacucgcg

SEQ ID NO: 4803 - RNA, 22 nt, Artificial Sequence
  Synthetic
gcacggcccggcgguacucgcg

SEQ ID NO: 4804 - RNA, 23 nt, Artificial Sequence
  Synthetic
agcacggcccggcgguacucgcg

SEQ ID NO: 4805 - RNA, 24 nt, Artificial Sequence
  Synthetic
cagcacggcccggcgguacucgcg

SEQ ID NO: 4806 - RNA, 18 nt, Artificial Sequence
  Synthetic
uagcgcgcguagaaggcg

SEQ ID NO: 4807 - RNA, 19 nt, Artificial Sequence
  Synthetic
auagcgcgcguagaaggcg

SEQ ID NO: 4808 - RNA, 20 nt, Artificial Sequence
  Synthetic
gauagcgcgcguagaaggcg

SEQ ID NO: 4809 - RNA, 21 nt, Artificial Sequence
  Synthetic
cgauagcgcgcguagaaggcg

SEQ ID NO: 4810 - RNA, 22 nt, Artificial Sequence
  Synthetic
gcgauagcgcgcguagaaggcg

SEQ ID NO: 4811 - RNA, 23 nt, Artificial Sequence
  Synthetic
cgcgauagcgcgcguagaaggcg

SEQ ID NO: 4812 - RNA, 24 nt, Artificial Sequence
  Synthetic
ucgcgauagcgcgcguagaaggcg

SEQ ID NO: 4813 - RNA, 18 nt, Artificial Sequence
  Synthetic
gggggcgggggcccggcg

SEQ ID NO: 4814 - RNA, 19 nt, Artificial Sequence
  Synthetic
cgggggcgggggcccggcg

SEQ ID NO: 4815 - RNA, 20 nt, Artificial Sequence
  Synthetic
ccgggggcgggggcccggcg

SEQ ID NO: 4816 - RNA, 21 nt, Artificial Sequence
  Synthetic
cccgggggcgggggcccggcg

SEQ ID NO: 4817 - RNA, 22 nt, Artificial Sequence
  Synthetic
ccccgggggcgggggcccggcg

SEQ ID NO: 4818 - RNA, 23 nt, Artificial Sequence
  Synthetic
gccccgggggcgggggcccggcg

SEQ ID NO: 4819 - RNA, 24 nt, Artificial Sequence
  Synthetic
cgccccgggggcgggggcccggcg

SEQ ID NO: 4820 - RNA, 18 nt, Artificial Sequence
  Synthetic
ucgucaucugcgccggcg

SEQ ID NO: 4821 - RNA, 19 nt, Artificial Sequence
  Synthetic
cucgucaucugcgccggcg

SEQ ID NO: 4822 - RNA, 20 nt, Artificial Sequence
  Synthetic
ccucgucaucugcgccggcg

SEQ ID NO: 4823 - RNA, 21 nt, Artificial Sequence
  Synthetic
cccucgucaucugcgccggcg

SEQ ID NO: 4824 - RNA, 22 nt, Artificial Sequence
  Synthetic
ccccucgucaucugcgccggcg

SEQ ID NO: 4825 - RNA, 23 nt, Artificial Sequence
  Synthetic
cccccucgucaucugcgccggcg

SEQ ID NO: 4826 - RNA, 24 nt, Artificial Sequence
  Synthetic
acccccucgucaucugcgccggcg

SEQ ID NO: 4827 - RNA, 18 nt, Artificial Sequence
  Synthetic
cggcgugcggcggcggcg

SEQ ID NO: 4828 - RNA, 19 nt, Artificial Sequence
  Synthetic
ucggcgugcggcggcggcg

SEQ ID NO: 4829 - RNA, 20 nt, Artificial Sequence
  Synthetic
gucggcgugcggcggcggcg

SEQ ID NO: 4830 - RNA, 21 nt, Artificial Sequence
  Synthetic
cgucggcgugcggcggcggcg

SEQ ID NO: 4831 - RNA, 22 nt, Artificial Sequence
  Synthetic
gcgucggcgugcggcggcggcg

SEQ ID NO: 4832 - RNA, 23 nt, Artificial Sequence
  Synthetic
cgcgucggcgugcggcggcggcg

SEQ ID NO: 4833 - RNA, 24 nt, Artificial Sequence
  Synthetic
gcgcgucggcgugcggcggcggcg

SEQ ID NO: 4834 - RNA, 18 nt, Artificial Sequence
  Synthetic
cgucggcgugcggcggcg

SEQ ID NO: 4835 - RNA, 19 nt, Artificial Sequence
  Synthetic
gcgucggcgugcggcggcg

SEQ ID NO: 4836 - RNA, 20 nt, Artificial Sequence
  Synthetic
cgcgucggcgugcggcggcg

SEQ ID NO: 4837 - RNA, 21 nt, Artificial Sequence
  Synthetic
gcgcgucggcgugcggcggcg

SEQ ID NO: 4838 - RNA, 22 nt, Artificial Sequence
  Synthetic
ggcgcgucggcgugcggcggcg

SEQ ID NO: 4839 - RNA, 23 nt, Artificial Sequence
  Synthetic
gggcgcgucggcgugcggcggcg

SEQ ID NO: 4840 - RNA, 24 nt, Artificial Sequence
  Synthetic
ggggcgcgucggcgugcggcggcg

SEQ ID NO: 4841 - RNA, 18 nt, Artificial Sequence
  Synthetic
ucggcguggcgggcggcg

SEQ ID NO: 4842 - RNA, 19 nt, Artificial Sequence
  Synthetic
gucggcguggcgggcggcg

SEQ ID NO: 4843 - RNA, 20 nt, Artificial Sequence
  Synthetic
cgucggcguggcgggcggcg

SEQ ID NO: 4844 - RNA, 21 nt, Artificial Sequence
  Synthetic
gcgucggcguggcgggcggcg

SEQ ID NO: 4845 - RNA, 22 nt, Artificial Sequence
  Synthetic
ggcgucggcguggcgggcggcg

SEQ ID NO: 4846 - RNA, 23 nt, Artificial Sequence
  Synthetic
cggcgucggcguggcgggcggcg

SEQ ID NO: 4847 - RNA, 24 nt, Artificial Sequence
  Synthetic
ucggcgucggcguggcgggcggcg

SEQ ID NO: 4848 - RNA, 18 nt, Artificial Sequence
  Synthetic
gacagccgccccagggcg

SEQ ID NO: 4849 - RNA, 19 nt, Artificial Sequence
  Synthetic
ggacagccgccccagggcg

SEQ ID NO: 4850 - RNA, 20 nt, Artificial Sequence
  Synthetic
cggacagccgccccagggcg

SEQ ID NO: 4851 - RNA, 21 nt, Artificial Sequence
  Synthetic
gcggacagccgccccagggcg

SEQ ID NO: 4852 - RNA, 22 nt, Artificial Sequence
  Synthetic
ggcggacagccgccccagggcg

SEQ ID NO: 4853 - RNA, 23 nt, Artificial Sequence
  Synthetic
cggcggacagccgccccagggcg

SEQ ID NO: 4854 - RNA, 24 nt, Artificial Sequence
  Synthetic
gcggcggacagccgccccagggcg

SEQ ID NO: 4855 - RNA, 18 nt, Artificial Sequence
  Synthetic
uggaggggggcgcgggcg

SEQ ID NO: 4856 - RNA, 19 nt, Artificial Sequence
  Synthetic
guggaggggggcgcgggcg

SEQ ID NO: 4857 - RNA, 20 nt, Artificial Sequence
  Synthetic
cguggaggggggcgcgggcg

SEQ ID NO: 4858 - RNA, 21 nt, Artificial Sequence
  Synthetic
gcguggaggggggcgcgggcg

SEQ ID NO: 4859 - RNA, 22 nt, Artificial Sequence
  Synthetic
ggcguggaggggggcgcgggcg

SEQ ID NO: 4860 - RNA, 23 nt, Artificial Sequence
  Synthetic
gggcguggaggggggcgcgggcg

SEQ ID NO: 4861 - RNA, 24 nt, Artificial Sequence
  Synthetic
ggggcguggaggggggcgcgggcg

SEQ ID NO: 4862 - RNA, 18 nt, Artificial Sequence
  Synthetic
gcucgggccccgggggcg

SEQ ID NO: 4863 - RNA, 19 nt, Artificial Sequence
  Synthetic
ggcucgggccccgggggcg

SEQ ID NO: 4864 - RNA, 20 nt, Artificial Sequence
  Synthetic
gggcucgggccccgggggcg

SEQ ID NO: 4865 - RNA, 21 nt, Artificial Sequence
  Synthetic
cgggcucgggccccgggggcg

SEQ ID NO: 4866 - RNA, 22 nt, Artificial Sequence
  Synthetic
gcgggcucgggccccgggggcg

SEQ ID NO: 4867 - RNA, 23 nt, Artificial Sequence
  Synthetic
ggcgggcucgggccccgggggcg

SEQ ID NO: 4868 - RNA, 24 nt, Artificial Sequence
  Synthetic
gggcgggcucgggccccgggggcg

SEQ ID NO: 4869 - RNA, 18 nt, Artificial Sequence
  Synthetic
ccgcacgcggccugggcg

SEQ ID NO: 4870 - RNA, 19 nt, Artificial Sequence
  Synthetic
gccgcacgcggccugggcg

SEQ ID NO: 4871 - RNA, 20 nt, Artificial Sequence
  Synthetic
cgccgcacgcggccugggcg

SEQ ID NO: 4872 - RNA, 21 nt, Artificial Sequence
  Synthetic
ccgccgcacgcggccugggcg

SEQ ID NO: 4873 - RNA, 22 nt, Artificial Sequence
  Synthetic
gccgccgcacgcggccugggcg

SEQ ID NO: 4874 - RNA, 23 nt, Artificial Sequence
  Synthetic
cgccgccgcacgcggccugggcg

SEQ ID NO: 4875 - RNA, 24 nt, Artificial Sequence
  Synthetic
ccgccgccgcacgcggccugggcg

SEQ ID NO: 4876 - RNA, 18 nt, Artificial Sequence
  Synthetic
agggggucggggcccucg

SEQ ID NO: 4877 - RNA, 19 nt, Artificial Sequence
  Synthetic
cagggggucggggcccucg

SEQ ID NO: 4878 - RNA, 20 nt, Artificial Sequence
  Synthetic
ccagggggucggggcccucg

SEQ ID NO: 4879 - RNA, 21 nt, Artificial Sequence
  Synthetic
cccagggggucggggcccucg

SEQ ID NO: 4880 - RNA, 22 nt, Artificial Sequence
  Synthetic
gcccagggggucggggcccucg

SEQ ID NO: 4881 - RNA, 23 nt, Artificial Sequence
  Synthetic
cgcccagggggucggggcccucg

SEQ ID NO: 4882 - RNA, 24 nt, Artificial Sequence
  Synthetic
ccgcccagggggucggggcccucg

SEQ ID NO: 4883 - RNA, 18 nt, Artificial Sequence
  Synthetic
ggcuugggcgcggccucg

SEQ ID NO: 4884 - RNA, 19 nt, Artificial Sequence
  Synthetic
gggcuugggcgcggccucg

SEQ ID NO: 4885 - RNA, 20 nt, Artificial Sequence
  Synthetic
ggggcuugggcgcggccucg

SEQ ID NO: 4886 - RNA, 21 nt, Artificial Sequence
  Synthetic
cggggcuugggcgcggccucg

SEQ ID NO: 4887 - RNA, 22 nt, Artificial Sequence
  Synthetic
ccggggcuugggcgcggccucg

SEQ ID NO: 4888 - RNA, 23 nt, Artificial Sequence
  Synthetic
cccggggcuugggcgcggccucg

SEQ ID NO: 4889 - RNA, 24 nt, Artificial Sequence
  Synthetic
gcccggggcuugggcgcggccucg

SEQ ID NO: 4890 - RNA, 18 nt, Artificial Sequence
  Synthetic
gagugggccuccuccucg

SEQ ID NO: 4891 - RNA, 19 nt, Artificial Sequence
  Synthetic
cgagugggccuccuccucg

SEQ ID NO: 4892 - RNA, 20 nt, Artificial Sequence
  Synthetic
gcgagugggccuccuccucg

SEQ ID NO: 4893 - RNA, 21 nt, Artificial Sequence
  Synthetic
ugcgagugggccuccuccucg

SEQ ID NO: 4894 - RNA, 22 nt, Artificial Sequence
  Synthetic
gugcgagugggccuccuccucg

SEQ ID NO: 4895 - RNA, 23 nt, Artificial Sequence
  Synthetic
cgugcgagugggccuccuccucg

SEQ ID NO: 4896 - RNA, 24 nt, Artificial Sequence
  Synthetic
gcgugcgagugggccuccuccucg

SEQ ID NO: 4897 - RNA, 18 nt, Artificial Sequence
  Synthetic
ucgucguccucguccucg

SEQ ID NO: 4898 - RNA, 19 nt, Artificial Sequence
  Synthetic
gucgucguccucguccucg

SEQ ID NO: 4899 - RNA, 20 nt, Artificial Sequence
  Synthetic
cgucgucguccucguccucg

SEQ ID NO: 4900 - RNA, 21 nt, Artificial Sequence
  Synthetic
ccgucgucguccucguccucg

SEQ ID NO: 4901 - RNA, 22 nt, Artificial Sequence
  Synthetic
gccgucgucguccucguccucg

SEQ ID NO: 4902 - RNA, 23 nt, Artificial Sequence
  Synthetic
ugccgucgucguccucguccucg

SEQ ID NO: 4903 - RNA, 24 nt, Artificial Sequence
  Synthetic
uugccgucgucguccucguccucg

SEQ ID NO: 4904 - RNA, 18 nt, Artificial Sequence
  Synthetic
gacagcccgccgcgcucg

SEQ ID NO: 4905 - RNA, 19 nt, Artificial Sequence
  Synthetic
ggacagcccgccgcgcucg

SEQ ID NO: 4906 - RNA, 20 nt, Artificial Sequence
  Synthetic
aggacagcccgccgcgcucg

SEQ ID NO: 4907 - RNA, 21 nt, Artificial Sequence
  Synthetic
caggacagcccgccgcgcucg

SEQ ID NO: 4908 - RNA, 22 nt, Artificial Sequence
  Synthetic
gcaggacagcccgccgcgcucg

SEQ ID NO: 4909 - RNA, 23 nt, Artificial Sequence
  Synthetic
ggcaggacagcccgccgcgcucg

SEQ ID NO: 4910 - RNA, 24 nt, Artificial Sequence
  Synthetic
aggcaggacagcccgccgcgcucg

SEQ ID NO: 4911 - RNA, 18 nt, Artificial Sequence
  Synthetic
cugccggcgccgcgcucg

SEQ ID NO: 4912 - RNA, 19 nt, Artificial Sequence
  Synthetic
gcugccggcgccgcgcucg

SEQ ID NO: 4913 - RNA, 20 nt, Artificial Sequence
  Synthetic
ggcugccggcgccgcgcucg

SEQ ID NO: 4914 - RNA, 21 nt, Artificial Sequence
  Synthetic
gggcugccggcgccgcgcucg

SEQ ID NO: 4915 - RNA, 22 nt, Artificial Sequence
  Synthetic
ggggcugccggcgccgcgcucg

SEQ ID NO: 4916 - RNA, 23 nt, Artificial Sequence
  Synthetic
gggggcugccggcgccgcgcucg

SEQ ID NO: 4917 - RNA, 24 nt, Artificial Sequence
  Synthetic
cgggggcugccggcgccgcgcucg

SEQ ID NO: 4918 - RNA, 18 nt, Artificial Sequence
  Synthetic
gacaccgcgggcccgucg

SEQ ID NO: 4919 - RNA, 19 nt, Artificial Sequence
  Synthetic
cgacaccgcgggcccgucg

SEQ ID NO: 4920 - RNA, 20 nt, Artificial Sequence
  Synthetic
gcgacaccgcgggcccgucg

SEQ ID NO: 4921 - RNA, 21 nt, Artificial Sequence
  Synthetic
cgcgacaccgcgggcccgucg

SEQ ID NO: 4922 - RNA, 22 nt, Artificial Sequence
  Synthetic
ccgcgacaccgcgggcccgucg

SEQ ID NO: 4923 - RNA, 23 nt, Artificial Sequence
  Synthetic
gccgcgacaccgcgggcccgucg

SEQ ID NO: 4924 - RNA, 24 nt, Artificial Sequence
  Synthetic
ugccgcgacaccgcgggcccgucg

SEQ ID NO: 4925 - RNA, 18 nt, Artificial Sequence
  Synthetic
agcgggggggcgucgucg

SEQ ID NO: 4926 - RNA, 19 nt, Artificial Sequence
  Synthetic
cagcgggggggcgucgucg

SEQ ID NO: 4927 - RNA, 20 nt, Artificial Sequence
  Synthetic
ccagcgggggggcgucgucg

SEQ ID NO: 4928 - RNA, 21 nt, Artificial Sequence
  Synthetic
accagcgggggggcgucgucg

SEQ ID NO: 4929 - RNA, 22 nt, Artificial Sequence
  Synthetic
caccagcgggggggcgucgucg

SEQ ID NO: 4930 - RNA, 23 nt, Artificial Sequence
  Synthetic
gcaccagcgggggggcgucgucg

SEQ ID NO: 4931 - RNA, 24 nt, Artificial Sequence
  Synthetic
agcaccagcgggggggcgucgucg

SEQ ID NO: 4932 - RNA, 18 nt, Artificial Sequence
  Synthetic
gccauggcguagcccagg

SEQ ID NO: 4933 - RNA, 19 nt, Artificial Sequence
  Synthetic
cgccauggcguagcccagg

SEQ ID NO: 4934 - RNA, 20 nt, Artificial Sequence
  Synthetic
ccgccauggcguagcccagg

SEQ ID NO: 4935 - RNA, 21 nt, Artificial Sequence
  Synthetic
gccgccauggcguagcccagg

SEQ ID NO: 4936 - RNA, 22 nt, Artificial Sequence
  Synthetic
ggccgccauggcguagcccagg

SEQ ID NO: 4937 - RNA, 23 nt, Artificial Sequence
  Synthetic
cggccgccauggcguagcccagg

SEQ ID NO: 4938 - RNA, 24 nt, Artificial Sequence
  Synthetic
ccggccgccauggcguagcccagg

SEQ ID NO: 4939 - RNA, 18 nt, Artificial Sequence
  Synthetic
gccagggccgccagcagg

SEQ ID NO: 4940 - RNA, 19 nt, Artificial Sequence
  Synthetic
ggccagggccgccagcagg

SEQ ID NO: 4941 - RNA, 20 nt, Artificial Sequence
  Synthetic
uggccagggccgccagcagg

SEQ ID NO: 4942 - RNA, 21 nt, Artificial Sequence
  Synthetic
uuggccagggccgccagcagg

SEQ ID NO: 4943 - RNA, 22 nt, Artificial Sequence
  Synthetic
guuggccagggccgccagcagg

SEQ ID NO: 4944 - RNA, 23 nt, Artificial Sequence
  Synthetic
gguuggccagggccgccagcagg

SEQ ID NO: 4945 - RNA, 24 nt, Artificial Sequence
  Synthetic
cgguuggccagggccgccagcagg

SEQ ID NO: 4946 - RNA, 18 nt, Artificial Sequence
  Synthetic
cgcagccacgcgcgcagg

SEQ ID NO: 4947 - RNA, 19 nt, Artificial Sequence
  Synthetic
gcgcagccacgcgcgcagg

SEQ ID NO: 4948 - RNA, 20 nt, Artificial Sequence
  Synthetic
cgcgcagccacgcgcgcagg

SEQ ID NO: 4949 - RNA, 21 nt, Artificial Sequence
  Synthetic
ucgcgcagccacgcgcgcagg

SEQ ID NO: 4950 - RNA, 22 nt, Artificial Sequence
  Synthetic
cucgcgcagccacgcgcgcagg

SEQ ID NO: 4951 - RNA, 23 nt, Artificial Sequence
  Synthetic
gcucgcgcagccacgcgcgcagg

SEQ ID NO: 4952 - RNA, 24 nt, Artificial Sequence
  Synthetic
agcucgcgcagccacgcgcgcagg

SEQ ID NO: 4953 - RNA, 18 nt, Artificial Sequence
  Synthetic
aggaugcggacgacgagg

SEQ ID NO: 4954 - RNA, 19 nt, Artificial Sequence
  Synthetic
gaggaugcggacgacgagg

SEQ ID NO: 4955 - RNA, 20 nt, Artificial Sequence
  Synthetic
agaggaugcggacgacgagg

SEQ ID NO: 4956 - RNA, 21 nt, Artificial Sequence
  Synthetic
aagaggaugcggacgacgagg

SEQ ID NO: 4957 - RNA, 22 nt, Artificial Sequence
  Synthetic
gaagaggaugcggacgacgagg

SEQ ID NO: 4958 - RNA, 23 nt, Artificial Sequence
  Synthetic
cgaagaggaugcggacgacgagg

SEQ ID NO: 4959 - RNA, 24 nt, Artificial Sequence
  Synthetic
acgaagaggaugcggacgacgagg

SEQ ID NO: 4960 - RNA, 18 nt, Artificial Sequence
  Synthetic
ccucgucggacgacgagg

SEQ ID NO: 4961 - RNA, 19 nt, Artificial Sequence
  Synthetic
uccucgucggacgacgagg

SEQ ID NO: 4962 - RNA, 20 nt, Artificial Sequence
  Synthetic
guccucgucggacgacgagg

SEQ ID NO: 4963 - RNA, 21 nt, Artificial Sequence
  Synthetic
cguccucgucggacgacgagg

SEQ ID NO: 4964 - RNA, 22 nt, Artificial Sequence
  Synthetic
ucguccucgucggacgacgagg

SEQ ID NO: 4965 - RNA, 23 nt, Artificial Sequence
  Synthetic
cucguccucgucggacgacgagg

SEQ ID NO: 4966 - RNA, 24 nt, Artificial Sequence
  Synthetic
ccucguccucgucggacgacgagg

SEQ ID NO: 4967 - RNA, 18 nt, Artificial Sequence
  Synthetic
agaggggggguggcccgg

SEQ ID NO: 4968 - RNA, 19 nt, Artificial Sequence
  Synthetic
gagaggggggguggcccgg

SEQ ID NO: 4969 - RNA, 20 nt, Artificial Sequence
  Synthetic
ggagaggggggguggcccgg

SEQ ID NO: 4970 - RNA, 21 nt, Artificial Sequence
  Synthetic
cggagaggggggguggcccgg

SEQ ID NO: 4971 - RNA, 22 nt, Artificial Sequence
  Synthetic
ucggagaggggggguggcccgg

SEQ ID NO: 4972 - RNA, 23 nt, Artificial Sequence
  Synthetic
cucggagaggggggguggcccgg

SEQ ID NO: 4973 - RNA, 24 nt, Artificial Sequence
  Synthetic
ccucggagaggggggguggcccgg

SEQ ID NO: 4974 - RNA, 18 nt, Artificial Sequence
  Synthetic
gccgcgcagcaccagcgg

SEQ ID NO: 4975 - RNA, 19 nt, Artificial Sequence
  Synthetic
cgccgcgcagcaccagcgg

SEQ ID NO: 4976 - RNA, 20 nt, Artificial Sequence
  Synthetic
ucgccgcgcagcaccagcgg

SEQ ID NO: 4977 - RNA, 21 nt, Artificial Sequence
  Synthetic
gucgccgcgcagcaccagcgg

SEQ ID NO: 4978 - RNA, 22 nt, Artificial Sequence
  Synthetic
cgucgccgcgcagcaccagcgg

SEQ ID NO: 4979 - RNA, 23 nt, Artificial Sequence
  Synthetic
ucgucgccgcgcagcaccagcgg

SEQ ID NO: 4980 - RNA, 24 nt, Artificial Sequence
  Synthetic
gucgucgccgcgcagcaccagcgg

SEQ ID NO: 4981 - RNA, 18 nt, Artificial Sequence
  Synthetic
ggucgucgccccccgcgg

SEQ ID NO: 4982 - RNA, 19 nt, Artificial Sequence
  Synthetic
gggucgucgccccccgcgg

SEQ ID NO: 4983 - RNA, 20 nt, Artificial Sequence
  Synthetic
ggggucgucgccccccgcgg

SEQ ID NO: 4984 - RNA, 21 nt, Artificial Sequence
  Synthetic
cggggucgucgccccccgcgg

SEQ ID NO: 4985 - RNA, 22 nt, Artificial Sequence
  Synthetic
ucggggucgucgccccccgcgg

SEQ ID NO: 4986 - RNA, 23 nt, Artificial Sequence
  Synthetic
gucggggucgucgccccccgcgg

SEQ ID NO: 4987 - RNA, 24 nt, Artificial Sequence
  Synthetic
cgucggggucgucgccccccgcgg

SEQ ID NO: 4988 - RNA, 18 nt, Artificial Sequence
  Synthetic
gccccucccgcggcgcgg

SEQ ID NO: 4989 - RNA, 19 nt, Artificial Sequence
  Synthetic
cgccccucccgcggcgcgg

SEQ ID NO: 4990 - RNA, 20 nt, Artificial Sequence
  Synthetic
gcgccccucccgcggcgcgg

SEQ ID NO: 4991 - RNA, 21 nt, Artificial Sequence
  Synthetic
ugcgccccucccgcggcgcgg

SEQ ID NO: 4992 - RNA, 22 nt, Artificial Sequence
  Synthetic
uugcgccccucccgcggcgcgg

SEQ ID NO: 4993 - RNA, 23 nt, Artificial Sequence
  Synthetic
cuugcgccccucccgcggcgcgg

SEQ ID NO: 4994 - RNA, 24 nt, Artificial Sequence
  Synthetic
gcuugcgccccucccgcggcgcgg

SEQ ID NO: 4995 - RNA, 18 nt, Artificial Sequence
  Synthetic
cacggccacggggcgcgg

SEQ ID NO: 4996 - RNA, 19 nt, Artificial Sequence
  Synthetic
acacggccacggggcgcgg

SEQ ID NO: 4997 - RNA, 20 nt, Artificial Sequence
  Synthetic
gacacggccacggggcgcgg

SEQ ID NO: 4998 - RNA, 21 nt, Artificial Sequence
  Synthetic
cgacacggccacggggcgcgg

SEQ ID NO: 4999 - RNA, 22 nt, Artificial Sequence
  Synthetic
gcgacacggccacggggcgcgg

SEQ ID NO: 5000 - RNA, 23 nt, Artificial Sequence
  Synthetic
cgcgacacggccacggggcgcgg

SEQ ID NO: 5001 - RNA, 24 nt, Artificial Sequence
  Synthetic
gcgcgacacggccacggggcgcgg

SEQ ID NO: 5002 - RNA, 18 nt, Artificial Sequence
  Synthetic
cccgggcggcgccggcgg

SEQ ID NO: 5003 - RNA, 19 nt, Artificial Sequence
  Synthetic
ucccgggcggcgccggcgg

SEQ ID NO: 5004 - RNA, 20 nt, Artificial Sequence
  Synthetic
aucccgggcggcgccggcgg

SEQ ID NO: 5005 - RNA, 21 nt, Artificial Sequence
  Synthetic
aaucccgggcggcgccggcgg

SEQ ID NO: 5006 - RNA, 22 nt, Artificial Sequence
  Synthetic
gaaucccgggcggcgccggcgg

SEQ ID NO: 5007 - RNA, 23 nt, Artificial Sequence
  Synthetic
cgaaucccgggcggcgccggcgg

SEQ ID NO: 5008 - RNA, 24 nt, Artificial Sequence
  Synthetic
gcgaaucccgggcggcgccggcgg

SEQ ID NO: 5009 - RNA, 18 nt, Artificial Sequence
  Synthetic
gucggcgugcggcggcgg

SEQ ID NO: 5010 - RNA, 19 nt, Artificial Sequence
  Synthetic
cgucggcgugcggcggcgg

SEQ ID NO: 5011 - RNA, 20 nt, Artificial Sequence
  Synthetic
gcgucggcgugcggcggcgg

SEQ ID NO: 5012 - RNA, 21 nt, Artificial Sequence
  Synthetic
cgcgucggcgugcggcggcgg

SEQ ID NO: 5013 - RNA, 22 nt, Artificial Sequence
  Synthetic
gcgcgucggcgugcggcggcgg

SEQ ID NO: 5014 - RNA, 23 nt, Artificial Sequence
  Synthetic
ggcgcgucggcgugcggcggcgg

SEQ ID NO: 5015 - RNA, 24 nt, Artificial Sequence
  Synthetic
gggcgcgucggcgugcggcggcgg

SEQ ID NO: 5016 - RNA, 18 nt, Artificial Sequence
  Synthetic
gccgccgccuccgggcgg

SEQ ID NO: 5017 - RNA, 19 nt, Artificial Sequence
  Synthetic
ggccgccgccuccgggcgg

SEQ ID NO: 5018 - RNA, 20 nt, Artificial Sequence
  Synthetic
gggccgccgccuccgggcgg

SEQ ID NO: 5019 - RNA, 21 nt, Artificial Sequence
  Synthetic
cgggccgccgccuccgggcgg

SEQ ID NO: 5020 - RNA, 22 nt, Artificial Sequence
  Synthetic
gcgggccgccgccuccgggcgg

SEQ ID NO: 5021 - RNA, 23 nt, Artificial Sequence
  Synthetic
cgcgggccgccgccuccgggcgg

SEQ ID NO: 5022 - RNA, 24 nt, Artificial Sequence
  Synthetic
ucgcgggccgccgccuccgggcgg

SEQ ID NO: 5023 - RNA, 18 nt, Artificial Sequence
  Synthetic
cgcacgcggccugggcgg

SEQ ID NO: 5024 - RNA, 19 nt, Artificial Sequence
  Synthetic
ccgcacgcggccugggcgg

SEQ ID NO: 5025 - RNA, 20 nt, Artificial Sequence
  Synthetic
gccgcacgcggccugggcgg

SEQ ID NO: 5026 - RNA, 21 nt, Artificial Sequence
  Synthetic
cgccgcacgcggccugggcgg

SEQ ID NO: 5027 - RNA, 22 nt, Artificial Sequence
  Synthetic
ccgccgcacgcggccugggcgg

SEQ ID NO: 5028 - RNA, 23 nt, Artificial Sequence
  Synthetic
gccgccgcacgcggccugggcgg

SEQ ID NO: 5029 - RNA, 24 nt, Artificial Sequence
  Synthetic
cgccgccgcacgcggccugggcgg

SEQ ID NO: 5030 - RNA, 18 nt, Artificial Sequence
  Synthetic
gcggcccgcgccaccggg

SEQ ID NO: 5031 - RNA, 19 nt, Artificial Sequence
  Synthetic
cgcggcccgcgccaccggg

SEQ ID NO: 5032 - RNA, 20 nt, Artificial Sequence
  Synthetic
ccgcggcccgcgccaccggg

SEQ ID NO: 5033 - RNA, 21 nt, Artificial Sequence
  Synthetic
uccgcggcccgcgccaccggg

SEQ ID NO: 5034 - RNA, 22 nt, Artificial Sequence
  Synthetic
cuccgcggcccgcgccaccggg

SEQ ID NO: 5035 - RNA, 23 nt, Artificial Sequence
  Synthetic
ccuccgcggcccgcgccaccggg

SEQ ID NO: 5036 - RNA, 24 nt, Artificial Sequence
  Synthetic
cccuccgcggcccgcgccaccggg

SEQ ID NO: 5037 - RNA, 18 nt, Artificial Sequence
  Synthetic
cgcgcgaagacccccggg

SEQ ID NO: 5038 - RNA, 19 nt, Artificial Sequence
  Synthetic
gcgcgcgaagacccccggg

SEQ ID NO: 5039 - RNA, 20 nt, Artificial Sequence
  Synthetic
cgcgcgcgaagacccccggg

SEQ ID NO: 5040 - RNA, 21 nt, Artificial Sequence
  Synthetic
acgcgcgcgaagacccccggg

SEQ ID NO: 5041 - RNA, 22 nt, Artificial Sequence
  Synthetic
cacgcgcgcgaagacccccggg

SEQ ID NO: 5042 - RNA, 23 nt, Artificial Sequence
  Synthetic
ccacgcgcgcgaagacccccggg

SEQ ID NO: 5043 - RNA, 24 nt, Artificial Sequence
  Synthetic
uccacgcgcgcgaagacccccggg

SEQ ID NO: 5044 - RNA, 18 nt, Artificial Sequence
  Synthetic
gaggggggguggcccggg

SEQ ID NO: 5045 - RNA, 19 nt, Artificial Sequence
  Synthetic
agaggggggguggcccggg

SEQ ID NO: 5046 - RNA, 20 nt, Artificial Sequence
  Synthetic
gagaggggggguggcccggg

SEQ ID NO: 5047 - RNA, 21 nt, Artificial Sequence
  Synthetic
ggagaggggggguggcccggg

SEQ ID NO: 5048 - RNA, 22 nt, Artificial Sequence
  Synthetic
cggagaggggggguggcccggg

SEQ ID NO: 5049 - RNA, 23 nt, Artificial Sequence
  Synthetic
ucggagaggggggguggcccggg

SEQ ID NO: 5050 - RNA, 24 nt, Artificial Sequence
  Synthetic
cucggagaggggggguggcccggg

SEQ ID NO: 5051 - RNA, 18 nt, Artificial Sequence
  Synthetic
cgccuccgggcggccggg

SEQ ID NO: 5052 - RNA, 19 nt, Artificial Sequence
  Synthetic
ccgccuccgggcggccggg

SEQ ID NO: 5053 - RNA, 20 nt, Artificial Sequence
  Synthetic
gccgccuccgggcggccggg

SEQ ID NO: 5054 - RNA, 21 nt, Artificial Sequence
  Synthetic
cgccgccuccgggcggccggg

SEQ ID NO: 5055 - RNA, 22 nt, Artificial Sequence
  Synthetic
ccgccgccuccgggcggccggg

SEQ ID NO: 5056 - RNA, 23 nt, Artificial Sequence
  Synthetic
gccgccgccuccgggcggccggg

SEQ ID NO: 5057 - RNA, 24 nt, Artificial Sequence
  Synthetic
ggccgccgccuccgggcggccggg

SEQ ID NO: 5058 - RNA, 18 nt, Artificial Sequence
  Synthetic
ccgggcggccgggccggg

SEQ ID NO: 5059 - RNA, 19 nt, Artificial Sequence
  Synthetic
uccgggcggccgggccggg

SEQ ID NO: 5060 - RNA, 20 nt, Artificial Sequence
  Synthetic
cuccgggcggccgggccggg

SEQ ID NO: 5061 - RNA, 21 nt, Artificial Sequence
  Synthetic
ccuccgggcggccgggccggg

SEQ ID NO: 5062 - RNA, 22 nt, Artificial Sequence
  Synthetic
gccuccgggcggccgggccggg

SEQ ID NO: 5063 - RNA, 23 nt, Artificial Sequence
  Synthetic
cgccuccgggcggccgggccggg

SEQ ID NO: 5064 - RNA, 24 nt, Artificial Sequence
  Synthetic
ccgccuccgggcggccgggccggg

SEQ ID NO: 5065 - RNA, 18 nt, Artificial Sequence
  Synthetic
ggcaccggcguguccggg

SEQ ID NO: 5066 - RNA, 19 nt, Artificial Sequence
  Synthetic
gggcaccggcguguccggg

SEQ ID NO: 5067 - RNA, 20 nt, Artificial Sequence
  Synthetic
ugggcaccggcguguccggg

SEQ ID NO: 5068 - RNA, 21 nt, Artificial Sequence
  Synthetic
augggcaccggcguguccggg

SEQ ID NO: 5069 - RNA, 22 nt, Artificial Sequence
  Synthetic
caugggcaccggcguguccggg

SEQ ID NO: 5070 - RNA, 23 nt, Artificial Sequence
  Synthetic
acaugggcaccggcguguccggg

SEQ ID NO: 5071 - RNA, 24 nt, Artificial Sequence
  Synthetic
gacaugggcaccggcguguccggg

SEQ ID NO: 5072 - RNA, 18 nt, Artificial Sequence
  Synthetic
ggcccggggcgccgcggg

SEQ ID NO: 5073 - RNA, 19 nt, Artificial Sequence
  Synthetic
cggcccggggcgccgcggg

SEQ ID NO: 5074 - RNA, 20 nt, Artificial Sequence
  Synthetic
gcggcccggggcgccgcggg

SEQ ID NO: 5075 - RNA, 21 nt, Artificial Sequence
  Synthetic
ggcggcccggggcgccgcggg

SEQ ID NO: 5076 - RNA, 22 nt, Artificial Sequence
  Synthetic
cggcggcccggggcgccgcggg

SEQ ID NO: 5077 - RNA, 23 nt, Artificial Sequence
  Synthetic
gcggcggcccggggcgccgcggg

SEQ ID NO: 5078 - RNA, 24 nt, Artificial Sequence
  Synthetic
cgcggcggcccggggcgccgcggg

SEQ ID NO: 5079 - RNA, 18 nt, Artificial Sequence
  Synthetic
ggggggcgcgggcgcggg

SEQ ID NO: 5080 - RNA, 19 nt, Artificial Sequence
  Synthetic
aggggggcgcgggcgcggg

SEQ ID NO: 5081 - RNA, 20 nt, Artificial Sequence
  Synthetic
gaggggggcgcgggcgcggg

SEQ ID NO: 5082 - RNA, 21 nt, Artificial Sequence
  Synthetic
ggaggggggcgcgggcgcggg

SEQ ID NO: 5083 - RNA, 22 nt, Artificial Sequence
  Synthetic
uggaggggggcgcgggcgcggg

SEQ ID NO: 5084 - RNA, 23 nt, Artificial Sequence
  Synthetic
guggaggggggcgcgggcgcggg

SEQ ID NO: 5085 - RNA, 24 nt, Artificial Sequence
  Synthetic
cguggaggggggcgcgggcgcggg

SEQ ID NO: 5086 - RNA, 18 nt, Artificial Sequence
  Synthetic
ccgcggggggcuggcggg

SEQ ID NO: 5087 - RNA, 19 nt, Artificial Sequence
  Synthetic
gccgcggggggcuggcggg

SEQ ID NO: 5088 - RNA, 20 nt, Artificial Sequence
  Synthetic
ggccgcggggggcuggcggg

SEQ ID NO: 5089 - RNA, 21 nt, Artificial Sequence
  Synthetic
cggccgcggggggcuggcggg

SEQ ID NO: 5090 - RNA, 22 nt, Artificial Sequence
  Synthetic
ccggccgcggggggcuggcggg

SEQ ID NO: 5091 - RNA, 23 nt, Artificial Sequence
  Synthetic
uccggccgcggggggcuggcggg

SEQ ID NO: 5092 - RNA, 24 nt, Artificial Sequence
  Synthetic
cuccggccgcggggggcuggcggg

SEQ ID NO: 5093 - RNA, 18 nt, Artificial Sequence
  Synthetic
agggccggucgccagggg

SEQ ID NO: 5094 - RNA, 19 nt, Artificial Sequence
  Synthetic
gagggccggucgccagggg

SEQ ID NO: 5095 - RNA, 20 nt, Artificial Sequence
  Synthetic
ugagggccggucgccagggg

SEQ ID NO: 5096 - RNA, 21 nt, Artificial Sequence
  Synthetic
augagggccggucgccagggg

SEQ ID NO: 5097 - RNA, 22 nt, Artificial Sequence
  Synthetic
caugagggccggucgccagggg

SEQ ID NO: 5098 - RNA, 23 nt, Artificial Sequence
  Synthetic
acaugagggccggucgccagggg

SEQ ID NO: 5099 - RNA, 24 nt, Artificial Sequence
  Synthetic
aacaugagggccggucgccagggg

SEQ ID NO: 5100 - RNA, 18 nt, Artificial Sequence
  Synthetic
acagcacccgccccgggg

SEQ ID NO: 5101 - RNA, 19 nt, Artificial Sequence
  Synthetic
uacagcacccgccccgggg

SEQ ID NO: 5102 - RNA, 20 nt, Artificial Sequence
  Synthetic
guacagcacccgccccgggg

SEQ ID NO: 5103 - RNA, 21 nt, Artificial Sequence
  Synthetic
cguacagcacccgccccgggg

SEQ ID NO: 5104 - RNA, 22 nt, Artificial Sequence
  Synthetic
ccguacagcacccgccccgggg

SEQ ID NO: 5105 - RNA, 23 nt, Artificial Sequence
  Synthetic
gccguacagcacccgccccgggg

SEQ ID NO: 5106 - RNA, 24 nt, Artificial Sequence
  Synthetic
cgccguacagcacccgccccgggg

SEQ ID NO: 5107 - RNA, 18 nt, Artificial Sequence
  Synthetic
gggggcgcgggcgcgggg

SEQ ID NO: 5108 - RNA, 19 nt, Artificial Sequence
  Synthetic
ggggggcgcgggcgcgggg

SEQ ID NO: 5109 - RNA, 20 nt, Artificial Sequence
  Synthetic
aggggggcgcgggcgcgggg

SEQ ID NO: 5110 - RNA, 21 nt, Artificial Sequence
  Synthetic
gaggggggcgcgggcgcgggg

SEQ ID NO: 5111 - RNA, 22 nt, Artificial Sequence
  Synthetic
ggaggggggcgcgggcgcgggg

SEQ ID NO: 5112 - RNA, 23 nt, Artificial Sequence
  Synthetic
uggaggggggcgcgggcgcgggg

SEQ ID NO: 5113 - RNA, 24 nt, Artificial Sequence
  Synthetic
guggaggggggcgcgggcgcgggg

SEQ ID NO: 5114 - RNA, 18 nt, Artificial Sequence
  Synthetic
gcggccugggcggcgggg

SEQ ID NO: 5115 - RNA, 19 nt, Artificial Sequence
  Synthetic
cgcggccugggcggcgggg

SEQ ID NO: 5116 - RNA, 20 nt, Artificial Sequence
  Synthetic
acgcggccugggcggcgggg

SEQ ID NO: 5117 - RNA, 21 nt, Artificial Sequence
  Synthetic
cacgcggccugggcggcgggg

SEQ ID NO: 5118 - RNA, 22 nt, Artificial Sequence
  Synthetic
gcacgcggccugggcggcgggg

SEQ ID NO: 5119 - RNA, 23 nt, Artificial Sequence
  Synthetic
cgcacgcggccugggcggcgggg

SEQ ID NO: 5120 - RNA, 24 nt, Artificial Sequence
  Synthetic
ccgcacgcggccugggcggcgggg

SEQ ID NO: 5121 - RNA, 18 nt, Artificial Sequence
  Synthetic
gccgcgggcugggcgggg

SEQ ID NO: 5122 - RNA, 19 nt, Artificial Sequence
  Synthetic
cgccgcgggcugggcgggg

SEQ ID NO: 5123 - RNA, 20 nt, Artificial Sequence
  Synthetic
gcgccgcgggcugggcgggg

SEQ ID NO: 5124 - RNA, 21 nt, Artificial Sequence
  Synthetic
ggcgccgcgggcugggcgggg

SEQ ID NO: 5125 - RNA, 22 nt, Artificial Sequence
  Synthetic
gggcgccgcgggcugggcgggg

SEQ ID NO: 5126 - RNA, 23 nt, Artificial Sequence
  Synthetic
ggggcgccgcgggcugggcgggg

SEQ ID NO: 5127 - RNA, 24 nt, Artificial Sequence
  Synthetic
cggggcgccgcgggcugggcgggg

SEQ ID NO: 5128 - RNA, 18 nt, Artificial Sequence
  Synthetic
acgcgcacguccucgggg

SEQ ID NO: 5129 - RNA, 19 nt, Artificial Sequence
  Synthetic
cacgcgcacguccucgggg

SEQ ID NO: 5130 - RNA, 20 nt, Artificial Sequence
  Synthetic
ccacgcgcacguccucgggg

SEQ ID NO: 5131 - RNA, 21 nt, Artificial Sequence
  Synthetic
accacgcgcacguccucgggg

SEQ ID NO: 5132 - RNA, 22 nt, Artificial Sequence
  Synthetic
caccacgcgcacguccucgggg

SEQ ID NO: 5133 - RNA, 23 nt, Artificial Sequence
  Synthetic
ccaccacgcgcacguccucgggg

SEQ ID NO: 5134 - RNA, 24 nt, Artificial Sequence
  Synthetic
accaccacgcgcacguccucgggg

SEQ ID NO: 5135 - RNA, 18 nt, Artificial Sequence
  Synthetic
cgccagccgcccaggggg

SEQ ID NO: 5136 - RNA, 19 nt, Artificial Sequence
  Synthetic
ccgccagccgcccaggggg

SEQ ID NO: 5137 - RNA, 20 nt, Artificial Sequence
  Synthetic
gccgccagccgcccaggggg

SEQ ID NO: 5138 - RNA, 21 nt, Artificial Sequence
  Synthetic
cgccgccagccgcccaggggg

SEQ ID NO: 5139 - RNA, 22 nt, Artificial Sequence
  Synthetic
ccgccgccagccgcccaggggg

SEQ ID NO: 5140 - RNA, 23 nt, Artificial Sequence
  Synthetic
gccgccgccagccgcccaggggg

SEQ ID NO: 5141 - RNA, 24 nt, Artificial Sequence
  Synthetic
ugccgccgccagccgcccaggggg

SEQ ID NO: 5142 - RNA, 18 nt, Artificial Sequence
  Synthetic
cagcacccgccccggggg

SEQ ID NO: 5143 - RNA, 19 nt, Artificial Sequence
  Synthetic
acagcacccgccccggggg

SEQ ID NO: 5144 - RNA, 20 nt, Artificial Sequence
  Synthetic
uacagcacccgccccggggg

SEQ ID NO: 5145 - RNA, 21 nt, Artificial Sequence
  Synthetic
guacagcacccgccccggggg

SEQ ID NO: 5146 - RNA, 22 nt, Artificial Sequence
  Synthetic
cguacagcacccgccccggggg

SEQ ID NO: 5147 - RNA, 23 nt, Artificial Sequence
  Synthetic
ccguacagcacccgccccggggg

SEQ ID NO: 5148 - RNA, 24 nt, Artificial Sequence
  Synthetic
gccguacagcacccgccccggggg

SEQ ID NO: 5149 - RNA, 18 nt, Artificial Sequence
  Synthetic
ccggcggccccguggggg

SEQ ID NO: 5150 - RNA, 19 nt, Artificial Sequence
  Synthetic
cccggcggccccguggggg

SEQ ID NO: 5151 - RNA, 20 nt, Artificial Sequence
  Synthetic
ccccggcggccccguggggg

SEQ ID NO: 5152 - RNA, 21 nt, Artificial Sequence
  Synthetic
cccccggcggccccguggggg

SEQ ID NO: 5153 - RNA, 22 nt, Artificial Sequence
  Synthetic
gcccccggcggccccguggggg

SEQ ID NO: 5154 - RNA, 23 nt, Artificial Sequence
  Synthetic
ggcccccggcggccccguggggg

SEQ ID NO: 5155 - RNA, 24 nt, Artificial Sequence
  Synthetic
cggcccccggcggccccguggggg

SEQ ID NO: 5156 - RNA, 18 nt, Artificial Sequence
  Synthetic
cccggcggccccgugggg

SEQ ID NO: 5157 - RNA, 19 nt, Artificial Sequence
  Synthetic
ccccggcggccccgugggg

SEQ ID NO: 5158 - RNA, 20 nt, Artificial Sequence
  Synthetic
cccccggcggccccgugggg

SEQ ID NO: 5159 - RNA, 21 nt, Artificial Sequence
  Synthetic
gcccccggcggccccgugggg

SEQ ID NO: 5160 - RNA, 22 nt, Artificial Sequence
  Synthetic
ggcccccggcggccccgugggg

SEQ ID NO: 5161 - RNA, 23 nt, Artificial Sequence
  Synthetic
cggcccccggcggccccgugggg

SEQ ID NO: 5162 - RNA, 24 nt, Artificial Sequence
  Synthetic
gcggcccccggcggccccgugggg

SEQ ID NO: 5163 - RNA, 18 nt, Artificial Sequence
  Synthetic
ggggcgccgcgggcuggg

SEQ ID NO: 5164 - RNA, 19 nt, Artificial Sequence
  Synthetic
cggggcgccgcgggcuggg

SEQ ID NO: 5165 - RNA, 20 nt, Artificial Sequence
  Synthetic
ccggggcgccgcgggcuggg

SEQ ID NO: 5166 - RNA, 21 nt, Artificial Sequence
  Synthetic
cccggggcgccgcgggcuggg

SEQ ID NO: 5167 - RNA, 22 nt, Artificial Sequence
  Synthetic
gcccggggcgccgcgggcuggg

SEQ ID NO: 5168 - RNA, 23 nt, Artificial Sequence
  Synthetic
ggcccggggcgccgcgggcuggg

SEQ ID NO: 5169 - RNA, 24 nt, Artificial Sequence
  Synthetic
cggcccggggcgccgcgggcuggg

SEQ ID NO: 5170 - RNA, 18 nt, Artificial Sequence
  Synthetic
cggggcgccgcgggcugg

SEQ ID NO: 5171 - RNA, 19 nt, Artificial Sequence
  Synthetic
ccggggcgccgcgggcugg

SEQ ID NO: 5172 - RNA, 20 nt, Artificial Sequence
  Synthetic
cccggggcgccgcgggcugg

SEQ ID NO: 5173 - RNA, 21 nt, Artificial Sequence
  Synthetic
gcccggggcgccgcgggcugg

SEQ ID NO: 5174 - RNA, 22 nt, Artificial Sequence
  Synthetic
ggcccggggcgccgcgggcugg

SEQ ID NO: 5175 - RNA, 23 nt, Artificial Sequence
  Synthetic
cggcccggggcgccgcgggcugg

SEQ ID NO: 5176 - RNA, 24 nt, Artificial Sequence
  Synthetic
gcggcccggggcgccgcgggcugg

SEQ ID NO: 5177 - RNA, 18 nt, Artificial Sequence
  Synthetic
ugccgcugcggcccgugg

SEQ ID NO: 5178 - RNA, 19 nt, Artificial Sequence
  Synthetic
gugccgcugcggcccgugg

SEQ ID NO: 5179 - RNA, 20 nt, Artificial Sequence
  Synthetic
ggugccgcugcggcccgugg

SEQ ID NO: 5180 - RNA, 21 nt, Artificial Sequence
  Synthetic
cggugccgcugcggcccgugg

SEQ ID NO: 5181 - RNA, 22 nt, Artificial Sequence
  Synthetic
acggugccgcugcggcccgugg

SEQ ID NO: 5182 - RNA, 23 nt, Artificial Sequence
  Synthetic
cacggugccgcugcggcccgugg

SEQ ID NO: 5183 - RNA, 24 nt, Artificial Sequence
  Synthetic
gcacggugccgcugcggcccgugg

SEQ ID NO: 5184 - RNA, 18 nt, Artificial Sequence
  Synthetic
cgggccccgggggcgugg

SEQ ID NO: 5185 - RNA, 19 nt, Artificial Sequence
  Synthetic
ucgggccccgggggcgugg

SEQ ID NO: 5186 - RNA, 20 nt, Artificial Sequence
  Synthetic
cucgggccccgggggcgugg

SEQ ID NO: 5187 - RNA, 21 nt, Artificial Sequence
  Synthetic
gcucgggccccgggggcgugg

SEQ ID NO: 5188 - RNA, 22 nt, Artificial Sequence
  Synthetic
ggcucgggccccgggggcgugg

SEQ ID NO: 5189 - RNA, 23 nt, Artificial Sequence
  Synthetic
gggcucgggccccgggggcgugg

SEQ ID NO: 5190 - RNA, 24 nt, Artificial Sequence
  Synthetic
cgggcucgggccccgggggcgugg

SEQ ID NO: 5191 - RNA, 18 nt, Artificial Sequence
  Synthetic
gcgggcgccgccgugugg

SEQ ID NO: 5192 - RNA, 19 nt, Artificial Sequence
  Synthetic
cgcgggcgccgccgugugg

SEQ ID NO: 5193 - RNA, 20 nt, Artificial Sequence
  Synthetic
ccgcgggcgccgccgugugg

SEQ ID NO: 5194 - RNA, 21 nt, Artificial Sequence
  Synthetic
gccgcgggcgccgccgugugg

SEQ ID NO: 5195 - RNA, 22 nt, Artificial Sequence
  Synthetic
ggccgcgggcgccgccgugugg

SEQ ID NO: 5196 - RNA, 23 nt, Artificial Sequence
  Synthetic
cggccgcgggcgccgccgugugg

SEQ ID NO: 5197 - RNA, 24 nt, Artificial Sequence
  Synthetic
gcggccgcgggcgccgccgugugg

SEQ ID NO: 5198 - RNA, 18 nt, Artificial Sequence
  Synthetic
gccacgcugccggugaug

SEQ ID NO: 5199 - RNA, 19 nt, Artificial Sequence
  Synthetic
cgccacgcugccggugaug

SEQ ID NO: 5200 - RNA, 20 nt, Artificial Sequence
  Synthetic
gcgccacgcugccggugaug

SEQ ID NO: 5201 - RNA, 21 nt, Artificial Sequence
  Synthetic
cgcgccacgcugccggugaug

SEQ ID NO: 5202 - RNA, 22 nt, Artificial Sequence
  Synthetic
ccgcgccacgcugccggugaug

SEQ ID NO: 5203 - RNA, 23 nt, Artificial Sequence
  Synthetic
cccgcgccacgcugccggugaug

SEQ ID NO: 5204 - RNA, 24 nt, Artificial Sequence
  Synthetic
gcccgcgccacgcugccggugaug

SEQ ID NO: 5205 - RNA, 18 nt, Artificial Sequence
  Synthetic
cgccggucgccggcgcug

SEQ ID NO: 5206 - RNA, 19 nt, Artificial Sequence
  Synthetic
ccgccggucgccggcgcug

SEQ ID NO: 5207 - RNA, 20 nt, Artificial Sequence
  Synthetic
gccgccggucgccggcgcug

SEQ ID NO: 5208 - RNA, 21 nt, Artificial Sequence
  Synthetic
agccgccggucgccggcgcug

SEQ ID NO: 5209 - RNA, 22 nt, Artificial Sequence
  Synthetic
gagccgccggucgccggcgcug

SEQ ID NO: 5210 - RNA, 23 nt, Artificial Sequence
  Synthetic
ugagccgccggucgccggcgcug

SEQ ID NO: 5211 - RNA, 24 nt, Artificial Sequence
  Synthetic
augagccgccggucgccggcgcug

SEQ ID NO: 5212 - RNA, 18 nt, Artificial Sequence
  Synthetic
uccggccgcggggggcug

SEQ ID NO: 5213 - RNA, 19 nt, Artificial Sequence
  Synthetic
cuccggccgcggggggcug

SEQ ID NO: 5214 - RNA, 20 nt, Artificial Sequence
  Synthetic
ccuccggccgcggggggcug

SEQ ID NO: 5215 - RNA, 21 nt, Artificial Sequence
  Synthetic
cccuccggccgcggggggcug

SEQ ID NO: 5216 - RNA, 22 nt, Artificial Sequence
  Synthetic
ucccuccggccgcggggggcug

SEQ ID NO: 5217 - RNA, 23 nt, Artificial Sequence
  Synthetic
gucccuccggccgcggggggcug

SEQ ID NO: 5218 - RNA, 24 nt, Artificial Sequence
  Synthetic
ggucccuccggccgcggggggcug

SEQ ID NO: 5219 - RNA, 18 nt, Artificial Sequence
  Synthetic
gucgucggcgucggcgug

SEQ ID NO: 5220 - RNA, 19 nt, Artificial Sequence
  Synthetic
cgucgucggcgucggcgug

SEQ ID NO: 5221 - RNA, 20 nt, Artificial Sequence
  Synthetic
ucgucgucggcgucggcgug

SEQ ID NO: 5222 - RNA, 21 nt, Artificial Sequence
  Synthetic
gucgucgucggcgucggcgug

SEQ ID NO: 5223 - RNA, 22 nt, Artificial Sequence
  Synthetic
cgucgucgucggcgucggcgug

SEQ ID NO: 5224 - RNA, 23 nt, Artificial Sequence
  Synthetic
gcgucgucgucggcgucggcgug

SEQ ID NO: 5225 - RNA, 24 nt, Artificial Sequence
  Synthetic
ggcgucgucgucggcgucggcgug

SEQ ID NO: 5226 - RNA, 18 nt, Artificial Sequence
  Synthetic
ucgggccccgggggcgug

SEQ ID NO: 5227 - RNA, 19 nt, Artificial Sequence
  Synthetic
cucgggccccgggggcgug

SEQ ID NO: 5228 - RNA, 20 nt, Artificial Sequence
  Synthetic
gcucgggccccgggggcgug

SEQ ID NO: 5229 - RNA, 21 nt, Artificial Sequence
  Synthetic
ggcucgggccccgggggcgug

SEQ ID NO: 5230 - RNA, 22 nt, Artificial Sequence
  Synthetic
gggcucgggccccgggggcgug

SEQ ID NO: 5231 - RNA, 23 nt, Artificial Sequence
  Synthetic
cgggcucgggccccgggggcgug

SEQ ID NO: 5232 - RNA, 24 nt, Artificial Sequence
  Synthetic
gcgggcucgggccccgggggcgug

SEQ ID NO: 5233 - RNA, 18 nt, Artificial Sequence
  Synthetic
cgcgccacgcugccggug

SEQ ID NO: 5234 - RNA, 19 nt, Artificial Sequence
  Synthetic
ccgcgccacgcugccggug

SEQ ID NO: 5235 - RNA, 20 nt, Artificial Sequence
  Synthetic
cccgcgccacgcugccggug

SEQ ID NO: 5236 - RNA, 21 nt, Artificial Sequence
  Synthetic
gcccgcgccacgcugccggug

SEQ ID NO: 5237 - RNA, 22 nt, Artificial Sequence
  Synthetic
ggcccgcgccacgcugccggug

SEQ ID NO: 5238 - RNA, 23 nt, Artificial Sequence
  Synthetic
cggcccgcgccacgcugccggug

SEQ ID NO: 5239 - RNA, 24 nt, Artificial Sequence
  Synthetic
acggcccgcgccacgcugccggug

SEQ ID NO: 5240 - RNA, 18 nt, Artificial Sequence
  Synthetic
ggcccgcgggucaaacau

SEQ ID NO: 5241 - RNA, 19 nt, Artificial Sequence
  Synthetic
gggcccgcgggucaaacau

SEQ ID NO: 5242 - RNA, 20 nt, Artificial Sequence
  Synthetic
agggcccgcgggucaaacau

SEQ ID NO: 5243 - RNA, 21 nt, Artificial Sequence
  Synthetic
cagggcccgcgggucaaacau

SEQ ID NO: 5244 - RNA, 22 nt, Artificial Sequence
  Synthetic
ccagggcccgcgggucaaacau

SEQ ID NO: 5245 - RNA, 23 nt, Artificial Sequence
  Synthetic
gccagggcccgcgggucaaacau

SEQ ID NO: 5246 - RNA, 24 nt, Artificial Sequence
  Synthetic
ggccagggcccgcgggucaaacau

SEQ ID NO: 5247 - RNA, 18 nt, Artificial Sequence
  Synthetic
gcgcgcggcgcccgagau

SEQ ID NO: 5248 - RNA, 19 nt, Artificial Sequence
  Synthetic
ugcgcgcggcgcccgagau

SEQ ID NO: 5249 - RNA, 20 nt, Artificial Sequence
  Synthetic
uugcgcgcggcgcccgagau

SEQ ID NO: 5250 - RNA, 21 nt, Artificial Sequence
  Synthetic
guugcgcgcggcgcccgagau

SEQ ID NO: 5251 - RNA, 22 nt, Artificial Sequence
  Synthetic
uguugcgcgcggcgcccgagau

SEQ ID NO: 5252 - RNA, 23 nt, Artificial Sequence
  Synthetic
cuguugcgcgcggcgcccgagau

SEQ ID NO: 5253 - RNA, 24 nt, Artificial Sequence
  Synthetic
gcuguugcgcgcggcgcccgagau

SEQ ID NO: 5254 - RNA, 18 nt, Artificial Sequence
  Synthetic
gacgaggacgaagaggau

SEQ ID NO: 5255 - RNA, 19 nt, Artificial Sequence
  Synthetic
cgacgaggacgaagaggau

SEQ ID NO: 5256 - RNA, 20 nt, Artificial Sequence
  Synthetic
acgacgaggacgaagaggau

SEQ ID NO: 5257 - RNA, 21 nt, Artificial Sequence
  Synthetic
gacgacgaggacgaagaggau

SEQ ID NO: 5258 - RNA, 22 nt, Artificial Sequence
  Synthetic
ggacgacgaggacgaagaggau

SEQ ID NO: 5259 - RNA, 23 nt, Artificial Sequence
  Synthetic
cggacgacgaggacgaagaggau

SEQ ID NO: 5260 - RNA, 24 nt, Artificial Sequence
  Synthetic
ucggacgacgaggacgaagaggau

SEQ ID NO: 5261 - RNA, 18 nt, Artificial Sequence
  Synthetic
guacagcagccgcgugau

SEQ ID NO: 5262 - RNA, 19 nt, Artificial Sequence
  Synthetic
uguacagcagccgcgugau

SEQ ID NO: 5263 - RNA, 20 nt, Artificial Sequence
  Synthetic
guguacagcagccgcgugau

SEQ ID NO: 5264 - RNA, 21 nt, Artificial Sequence
  Synthetic
gguguacagcagccgcgugau

SEQ ID NO: 5265 - RNA, 22 nt, Artificial Sequence
  Synthetic
ggguguacagcagccgcgugau

SEQ ID NO: 5266 - RNA, 23 nt, Artificial Sequence
  Synthetic
gggguguacagcagccgcgugau

SEQ ID NO: 5267 - RNA, 24 nt, Artificial Sequence
  Synthetic
cgggguguacagcagccgcgugau

SEQ ID NO: 5268 - RNA, 18 nt, Artificial Sequence
  Synthetic
ggucgcgggccgccgccu

SEQ ID NO: 5269 - RNA, 19 nt, Artificial Sequence
  Synthetic
gggucgcgggccgccgccu

SEQ ID NO: 5270 - RNA, 20 nt, Artificial Sequence
  Synthetic
ggggucgcgggccgccgccu

SEQ ID NO: 5271 - RNA, 21 nt, Artificial Sequence
  Synthetic
gggggucgcgggccgccgccu

SEQ ID NO: 5272 - RNA, 22 nt, Artificial Sequence
  Synthetic
cgggggucgcgggccgccgccu

SEQ ID NO: 5273 - RNA, 23 nt, Artificial Sequence
  Synthetic
ucgggggucgcgggccgccgccu

SEQ ID NO: 5274 - RNA, 24 nt, Artificial Sequence
  Synthetic
uucgggggucgcgggccgccgccu

SEQ ID NO: 5275 - RNA, 18 nt, Artificial Sequence
  Synthetic
ggggcuugggcgcggccu

SEQ ID NO: 5276 - RNA, 19 nt, Artificial Sequence
  Synthetic
cggggcuugggcgcggccu

SEQ ID NO: 5277 - RNA, 20 nt, Artificial Sequence
  Synthetic
ccggggcuugggcgcggccu

SEQ ID NO: 5278 - RNA, 21 nt, Artificial Sequence
  Synthetic
cccggggcuugggcgcggccu

SEQ ID NO: 5279 - RNA, 22 nt, Artificial Sequence
  Synthetic
gcccggggcuugggcgcggccu

SEQ ID NO: 5280 - RNA, 23 nt, Artificial Sequence
  Synthetic
cgcccggggcuugggcgcggccu

SEQ ID NO: 5281 - RNA, 24 nt, Artificial Sequence
  Synthetic
ccgcccggggcuugggcgcggccu

SEQ ID NO: 5282 - RNA, 18 nt, Artificial Sequence
  Synthetic
cgccgcucuucuucgucu

SEQ ID NO: 5283 - RNA, 19 nt, Artificial Sequence
  Synthetic
gcgccgcucuucuucgucu

SEQ ID NO: 5284 - RNA, 20 nt, Artificial Sequence
  Synthetic
cgcgccgcucuucuucgucu

SEQ ID NO: 5285 - RNA, 21 nt, Artificial Sequence
  Synthetic
ccgcgccgcucuucuucgucu

SEQ ID NO: 5286 - RNA, 22 nt, Artificial Sequence
  Synthetic
uccgcgccgcucuucuucgucu

SEQ ID NO: 5287 - RNA, 23 nt, Artificial Sequence
  Synthetic
guccgcgccgcucuucuucgucu

SEQ ID NO: 5288 - RNA, 24 nt, Artificial Sequence
  Synthetic
cguccgcgccgcucuucuucgucu

SEQ ID NO: 5289 - RNA, 18 nt, Artificial Sequence
  Synthetic
cgcccagcgccgacacgu

SEQ ID NO: 5290 - RNA, 19 nt, Artificial Sequence
  Synthetic
gcgcccagcgccgacacgu

SEQ ID NO: 5291 - RNA, 20 nt, Artificial Sequence
  Synthetic
ugcgcccagcgccgacacgu

SEQ ID NO: 5292 - RNA, 21 nt, Artificial Sequence
  Synthetic
gugcgcccagcgccgacacgu

SEQ ID NO: 5293 - RNA, 22 nt, Artificial Sequence
  Synthetic
ugugcgcccagcgccgacacgu

SEQ ID NO: 5294 - RNA, 23 nt, Artificial Sequence
  Synthetic
cugugcgcccagcgccgacacgu

SEQ ID NO: 5295 - RNA, 24 nt, Artificial Sequence
  Synthetic
ccugugcgcccagcgccgacacgu

SEQ ID NO: 5296 - RNA, 18 nt, Artificial Sequence
  Synthetic
accccauggccuccgcgu

SEQ ID NO: 5297 - RNA, 19 nt, Artificial Sequence
  Synthetic
caccccauggccuccgcgu

SEQ ID NO: 5298 - RNA, 20 nt, Artificial Sequence
  Synthetic
ccaccccauggccuccgcgu

SEQ ID NO: 5299 - RNA, 21 nt, Artificial Sequence
  Synthetic
gccaccccauggccuccgcgu

SEQ ID NO: 5300 - RNA, 22 nt, Artificial Sequence
  Synthetic
agccaccccauggccuccgcgu

SEQ ID NO: 5301 - RNA, 23 nt, Artificial Sequence
  Synthetic
gagccaccccauggccuccgcgu

SEQ ID NO: 5302 - RNA, 24 nt, Artificial Sequence
  Synthetic
ggagccaccccauggccuccgcgu

SEQ ID NO: 5303 - RNA, 18 nt, Artificial Sequence
  Synthetic
ggaggggggcgcgggcgu

SEQ ID NO: 5304 - RNA, 19 nt, Artificial Sequence
  Synthetic
gggaggggggcgcgggcgu

SEQ ID NO: 5305 - RNA, 20 nt, Artificial Sequence
  Synthetic
ggggaggggggcgcgggcgu

SEQ ID NO: 5306 - RNA, 21 nt, Artificial Sequence
  Synthetic
cggggaggggggcgcgggcgu

SEQ ID NO: 5307 - RNA, 22 nt, Artificial Sequence
  Synthetic
gcggggaggggggcgcgggcgu

SEQ ID NO: 5308 - RNA, 23 nt, Artificial Sequence
  Synthetic
cgcggggaggggggcgcgggcgu

SEQ ID NO: 5309 - RNA, 24 nt, Artificial Sequence
  Synthetic
gcgcggggaggggggcgcgggcgu

SEQ ID NO: 5310 - RNA, 18 nt, Artificial Sequence
  Synthetic
cgcgcacguccucggggu

SEQ ID NO: 5311 - RNA, 19 nt, Artificial Sequence
  Synthetic
acgcgcacguccucggggu

SEQ ID NO: 5312 - RNA, 20 nt, Artificial Sequence
  Synthetic
cacgcgcacguccucggggu

SEQ ID NO: 5313 - RNA, 21 nt, Artificial Sequence
  Synthetic
ccacgcgcacguccucggggu

SEQ ID NO: 5314 - RNA, 22 nt, Artificial Sequence
  Synthetic
accacgcgcacguccucggggu

SEQ ID NO: 5315 - RNA, 23 nt, Artificial Sequence
  Synthetic
caccacgcgcacguccucggggu

SEQ ID NO: 5316 - RNA, 24 nt, Artificial Sequence
  Synthetic
ccaccacgcgcacguccucggggu

SEQ ID NO: 5317 - RNA, 18 nt, Artificial Sequence
  Synthetic
gccagccgcccagggggu

SEQ ID NO: 5318 - RNA, 19 nt, Artificial Sequence
  Synthetic
cgccagccgcccagggggu

SEQ ID NO: 5319 - RNA, 20 nt, Artificial Sequence
  Synthetic
ccgccagccgcccagggggu

SEQ ID NO: 5320 - RNA, 21 nt, Artificial Sequence
  Synthetic
gccgccagccgcccagggggu

SEQ ID NO: 5321 - RNA, 22 nt, Artificial Sequence
  Synthetic
cgccgccagccgcccagggggu

SEQ ID NO: 5322 - RNA, 23 nt, Artificial Sequence
  Synthetic
ccgccgccagccgcccagggggu

SEQ ID NO: 5323 - RNA, 24 nt, Artificial Sequence
  Synthetic
gccgccgccagccgcccagggggu

SEQ ID NO: 5324 - RNA, 18 nt, Artificial Sequence
  Synthetic
acaugggcaccggcgugu

SEQ ID NO: 5325 - RNA, 19 nt, Artificial Sequence
  Synthetic
gacaugggcaccggcgugu

SEQ ID NO: 5326 - RNA, 20 nt, Artificial Sequence
  Synthetic
ggacaugggcaccggcgugu

SEQ ID NO: 5327 - RNA, 21 nt, Artificial Sequence
  Synthetic
gggacaugggcaccggcgugu

SEQ ID NO: 5328 - RNA, 22 nt, Artificial Sequence
  Synthetic
ggggacaugggcaccggcgugu

SEQ ID NO: 5329 - RNA, 23 nt, Artificial Sequence
  Synthetic
cggggacaugggcaccggcgugu

SEQ ID NO: 5330 - RNA, 24 nt, Artificial Sequence
  Synthetic
gcggggacaugggcaccggcgugu

SEQ ID NO: 5331 - RNA, 18 nt, Artificial Sequence
  Synthetic
gccgcucuucuucgucuu

SEQ ID NO: 5332 - RNA, 19 nt, Artificial Sequence
  Synthetic
cgccgcucuucuucgucuu

SEQ ID NO: 5333 - RNA, 20 nt, Artificial Sequence
  Synthetic
gcgccgcucuucuucgucuu

SEQ ID NO: 5334 - RNA, 21 nt, Artificial Sequence
  Synthetic
cgcgccgcucuucuucgucuu

SEQ ID NO: 5335 - RNA, 22 nt, Artificial Sequence
  Synthetic
ccgcgccgcucuucuucgucuu

SEQ ID NO: 5336 - RNA, 23 nt, Artificial Sequence
  Synthetic
uccgcgccgcucuucuucgucuu

SEQ ID NO: 5337 - RNA, 24 nt, Artificial Sequence
  Synthetic
guccgcgccgcucuucuucgucuu

SEQ ID NO: 5338 - RNA, 18 nt, Artificial Sequence
  Synthetic
ggggaccacgcgcggguu

SEQ ID NO: 5339 - RNA, 19 nt, Artificial Sequence
  Synthetic
cggggaccacgcgcggguu

SEQ ID NO: 5340 - RNA, 20 nt, Artificial Sequence
  Synthetic
ccggggaccacgcgcggguu

SEQ ID NO: 5341 - RNA, 21 nt, Artificial Sequence
  Synthetic
cccggggaccacgcgcggguu

SEQ ID NO: 5342 - RNA, 22 nt, Artificial Sequence
  Synthetic
ccccggggaccacgcgcggguu

SEQ ID NO: 5343 - RNA, 23 nt, Artificial Sequence
  Synthetic
uccccggggaccacgcgcggguu

SEQ ID NO: 5344 - RNA, 24 nt, Artificial Sequence
  Synthetic
guccccggggaccacgcgcggguu

SEQ ID NO: 5345 - RNA, 18 nt, Artificial Sequence
  Synthetic
ggccgccugggcgggcaa

SEQ ID NO: 5346 - RNA, 19 nt, Artificial Sequence
  Synthetic
cggccgccugggcgggcaa

SEQ ID NO: 5347 - RNA, 20 nt, Artificial Sequence
  Synthetic
acggccgccugggcgggcaa

SEQ ID NO: 5348 - RNA, 21 nt, Artificial Sequence
  Synthetic
cacggccgccugggcgggcaa

SEQ ID NO: 5349 - RNA, 22 nt, Artificial Sequence
  Synthetic
acacggccgccugggcgggcaa

SEQ ID NO: 5350 - RNA, 23 nt, Artificial Sequence
  Synthetic
gacacggccgccugggcgggcaa

SEQ ID NO: 5351 - RNA, 24 nt, Artificial Sequence
  Synthetic
ggacacggccgccugggcgggcaa

SEQ ID NO: 5352 - RNA, 18 nt, Artificial Sequence
  Synthetic
cgauaacccccaccccca

SEQ ID NO: 5353 - RNA, 19 nt, Artificial Sequence
  Synthetic
acgauaacccccaccccca

SEQ ID NO: 5354 - RNA, 20 nt, Artificial Sequence
  Synthetic
gacgauaacccccaccccca

SEQ ID NO: 5355 - RNA, 21 nt, Artificial Sequence
  Synthetic
cgacgauaacccccaccccca

SEQ ID NO: 5356 - RNA, 22 nt, Artificial Sequence
  Synthetic
acgacgauaacccccaccccca

SEQ ID NO: 5357 - RNA, 23 nt, Artificial Sequence
  Synthetic
gacgacgauaacccccaccccca

SEQ ID NO: 5358 - RNA, 24 nt, Artificial Sequence
  Synthetic
cgacgacgauaacccccaccccca

SEQ ID NO: 5359 - RNA, 18 nt, Artificial Sequence
  Synthetic
gccgucgccgccgccgca

SEQ ID NO: 5360 - RNA, 19 nt, Artificial Sequence
  Synthetic
cgccgucgccgccgccgca

SEQ ID NO: 5361 - RNA, 20 nt, Artificial Sequence
  Synthetic
ccgccgucgccgccgccgca

SEQ ID NO: 5362 - RNA, 21 nt, Artificial Sequence
  Synthetic
gccgccgucgccgccgccgca

SEQ ID NO: 5363 - RNA, 22 nt, Artificial Sequence
  Synthetic
cgccgccgucgccgccgccgca

SEQ ID NO: 5364 - RNA, 23 nt, Artificial Sequence
  Synthetic
ucgccgccgucgccgccgccgca

SEQ ID NO: 5365 - RNA, 24 nt, Artificial Sequence
  Synthetic
gucgccgccgucgccgccgccgca

SEQ ID NO: 5366 - RNA, 18 nt, Artificial Sequence
  Synthetic
cggccuccgcgggccgca

SEQ ID NO: 5367 - RNA, 19 nt, Artificial Sequence
  Synthetic
gcggccuccgcgggccgca

SEQ ID NO: 5368 - RNA, 20 nt, Artificial Sequence
  Synthetic
cgcggccuccgcgggccgca

SEQ ID NO: 5369 - RNA, 21 nt, Artificial Sequence
  Synthetic
ccgcggccuccgcgggccgca

SEQ ID NO: 5370 - RNA, 22 nt, Artificial Sequence
  Synthetic
cccgcggccuccgcgggccgca

SEQ ID NO: 5371 - RNA, 23 nt, Artificial Sequence
  Synthetic
ccccgcggccuccgcgggccgca

SEQ ID NO: 5372 - RNA, 24 nt, Artificial Sequence
  Synthetic
cccccgcggccuccgcgggccgca

SEQ ID NO: 5373 - RNA, 18 nt, Artificial Sequence
  Synthetic
gcggcggcggccagcgca

SEQ ID NO: 5374 - RNA, 19 nt, Artificial Sequence
  Synthetic
ggcggcggcggccagcgca

SEQ ID NO: 5375 - RNA, 20 nt, Artificial Sequence
  Synthetic
uggcggcggcggccagcgca

SEQ ID NO: 5376 - RNA, 21 nt, Artificial Sequence
  Synthetic
cuggcggcggcggccagcgca

SEQ ID NO: 5377 - RNA, 22 nt, Artificial Sequence
  Synthetic
gcuggcggcggcggccagcgca

SEQ ID NO: 5378 - RNA, 23 nt, Artificial Sequence
  Synthetic
ugcuggcggcggcggccagcgca

SEQ ID NO: 5379 - RNA, 24 nt, Artificial Sequence
  Synthetic
cugcuggcggcggcggccagcgca

SEQ ID NO: 5380 - RNA, 18 nt, Artificial Sequence
  Synthetic
gugucggcgcugggcgca

SEQ ID NO: 5381 - RNA, 19 nt, Artificial Sequence
  Synthetic
cgugucggcgcugggcgca

SEQ ID NO: 5382 - RNA, 20 nt, Artificial Sequence
  Synthetic
acgugucggcgcugggcgca

SEQ ID NO: 5383 - RNA, 21 nt, Artificial Sequence
  Synthetic
gacgugucggcgcugggcgca

SEQ ID NO: 5384 - RNA, 22 nt, Artificial Sequence
  Synthetic
cgacgugucggcgcugggcgca

SEQ ID NO: 5385 - RNA, 23 nt, Artificial Sequence
  Synthetic
ccgacgugucggcgcugggcgca

SEQ ID NO: 5386 - RNA, 24 nt, Artificial Sequence
  Synthetic
cccgacgugucggcgcugggcgca

SEQ ID NO: 5387 - RNA, 18 nt, Artificial Sequence
  Synthetic
ugcgcguggccggcggca

SEQ ID NO: 5388 - RNA, 19 nt, Artificial Sequence
  Synthetic
cugcgcguggccggcggca

SEQ ID NO: 5389 - RNA, 20 nt, Artificial Sequence
  Synthetic
ccugcgcguggccggcggca

SEQ ID NO: 5390 - RNA, 21 nt, Artificial Sequence
  Synthetic
accugcgcguggccggcggca

SEQ ID NO: 5391 - RNA, 22 nt, Artificial Sequence
  Synthetic
gaccugcgcguggccggcggca

SEQ ID NO: 5392 - RNA, 23 nt, Artificial Sequence
  Synthetic
ggaccugcgcguggccggcggca

SEQ ID NO: 5393 - RNA, 24 nt, Artificial Sequence
  Synthetic
gggaccugcgcguggccggcggca

SEQ ID NO: 5394 - RNA, 18 nt, Artificial Sequence
  Synthetic
aucgcgacggguacguca

SEQ ID NO: 5395 - RNA, 19 nt, Artificial Sequence
  Synthetic
uaucgcgacggguacguca

SEQ ID NO: 5396 - RNA, 20 nt, Artificial Sequence
  Synthetic
cuaucgcgacggguacguca

SEQ ID NO: 5397 - RNA, 21 nt, Artificial Sequence
  Synthetic
gcuaucgcgacggguacguca

SEQ ID NO: 5398 - RNA, 22 nt, Artificial Sequence
  Synthetic
cgcuaucgcgacggguacguca

SEQ ID NO: 5399 - RNA, 23 nt, Artificial Sequence
  Synthetic
gcgcuaucgcgacggguacguca

SEQ ID NO: 5400 - RNA, 24 nt, Artificial Sequence
  Synthetic
cgcgcuaucgcgacggguacguca

SEQ ID NO: 5401 - RNA, 18 nt, Artificial Sequence
  Synthetic
cgacggcggcgcguucga

SEQ ID NO: 5402 - RNA, 19 nt, Artificial Sequence
  Synthetic
acgacggcggcgcguucga

SEQ ID NO: 5403 - RNA, 20 nt, Artificial Sequence
  Synthetic
gacgacggcggcgcguucga

SEQ ID NO: 5404 - RNA, 21 nt, Artificial Sequence
  Synthetic
agacgacggcggcgcguucga

SEQ ID NO: 5405 - RNA, 22 nt, Artificial Sequence
  Synthetic
aagacgacggcggcgcguucga

SEQ ID NO: 5406 - RNA, 23 nt, Artificial Sequence
  Synthetic
gaagacgacggcggcgcguucga

SEQ ID NO: 5407 - RNA, 24 nt, Artificial Sequence
  Synthetic
cgaagacgacggcggcgcguucga

SEQ ID NO: 5408 - RNA, 18 nt, Artificial Sequence
  Synthetic
gcggcgggaaguugugga

SEQ ID NO: 5409 - RNA, 19 nt, Artificial Sequence
  Synthetic
cgcggcgggaaguugugga

SEQ ID NO: 5410 - RNA, 20 nt, Artificial Sequence
  Synthetic
ccgcggcgggaaguugugga

SEQ ID NO: 5411 - RNA, 21 nt, Artificial Sequence
  Synthetic
cccgcggcgggaaguugugga

SEQ ID NO: 5412 - RNA, 22 nt, Artificial Sequence
  Synthetic
ccccgcggcgggaaguugugga

SEQ ID NO: 5413 - RNA, 23 nt, Artificial Sequence
  Synthetic
cccccgcggcgggaaguugugga

SEQ ID NO: 5414 - RNA, 24 nt, Artificial Sequence
  Synthetic
gcccccgcggcgggaaguugugga

SEQ ID NO: 5415 - RNA, 18 nt, Artificial Sequence
  Synthetic
gcgagaacgcggcgcuga

SEQ ID NO: 5416 - RNA, 19 nt, Artificial Sequence
  Synthetic
cgcgagaacgcggcgcuga

SEQ ID NO: 5417 - RNA, 20 nt, Artificial Sequence
  Synthetic
gcgcgagaacgcggcgcuga

SEQ ID NO: 5418 - RNA, 21 nt, Artificial Sequence
  Synthetic
cgcgcgagaacgcggcgcuga

SEQ ID NO: 5419 - RNA, 22 nt, Artificial Sequence
  Synthetic
gcgcgcgagaacgcggcgcuga

SEQ ID NO: 5420 - RNA, 23 nt, Artificial Sequence
  Synthetic
ggcgcgcgagaacgcggcgcuga

SEQ ID NO: 5421 - RNA, 24 nt, Artificial Sequence
  Synthetic
uggcgcgcgagaacgcggcgcuga

SEQ ID NO: 5422 - RNA, 18 nt, Artificial Sequence
  Synthetic
gaccugcuguuugacaac

SEQ ID NO: 5423 - RNA, 19 nt, Artificial Sequence
  Synthetic
ggaccugcuguuugacaac

SEQ ID NO: 5424 - RNA, 20 nt, Artificial Sequence
  Synthetic
cggaccugcuguuugacaac

SEQ ID NO: 5425 - RNA, 21 nt, Artificial Sequence
  Synthetic
gcggaccugcuguuugacaac

SEQ ID NO: 5426 - RNA, 22 nt, Artificial Sequence
  Synthetic
cgcggaccugcuguuugacaac

SEQ ID NO: 5427 - RNA, 23 nt, Artificial Sequence
  Synthetic
ccgcggaccugcuguuugacaac

SEQ ID NO: 5428 - RNA, 24 nt, Artificial Sequence
  Synthetic
gccgcggaccugcuguuugacaac

SEQ ID NO: 5429 - RNA, 18 nt, Artificial Sequence
  Synthetic
gcgcgggccgugccccac

SEQ ID NO: 5430 - RNA, 19 nt, Artificial Sequence
  Synthetic
ggcgcgggccgugccccac

SEQ ID NO: 5431 - RNA, 20 nt, Artificial Sequence
  Synthetic
uggcgcgggccgugccccac

SEQ ID NO: 5432 - RNA, 21 nt, Artificial Sequence
  Synthetic
guggcgcgggccgugccccac

SEQ ID NO: 5433 - RNA, 22 nt, Artificial Sequence
  Synthetic
cguggcgcgggccgugccccac

SEQ ID NO: 5434 - RNA, 23 nt, Artificial Sequence
  Synthetic
gcguggcgcgggccgugccccac

SEQ ID NO: 5435 - RNA, 24 nt, Artificial Sequence
  Synthetic
agcguggcgcgggccgugccccac

SEQ ID NO: 5436 - RNA, 18 nt, Artificial Sequence
  Synthetic
cgugcugcugcuguccac

SEQ ID NO: 5437 - RNA, 19 nt, Artificial Sequence
  Synthetic
gcgugcugcugcuguccac

SEQ ID NO: 5438 - RNA, 20 nt, Artificial Sequence
  Synthetic
ggcgugcugcugcuguccac

SEQ ID NO: 5439 - RNA, 21 nt, Artificial Sequence
  Synthetic
gggcgugcugcugcuguccac

SEQ ID NO: 5440 - RNA, 22 nt, Artificial Sequence
  Synthetic
agggcgugcugcugcuguccac

SEQ ID NO: 5441 - RNA, 23 nt, Artificial Sequence
  Synthetic
cagggcgugcugcugcuguccac

SEQ ID NO: 5442 - RNA, 24 nt, Artificial Sequence
  Synthetic
acagggcgugcugcugcuguccac

SEQ ID NO: 5443 - RNA, 18 nt, Artificial Sequence
  Synthetic
acgcggccgaccacgcac

SEQ ID NO: 5444 - RNA, 19 nt, Artificial Sequence
  Synthetic
gacgcggccgaccacgcac

SEQ ID NO: 5445 - RNA, 20 nt, Artificial Sequence
  Synthetic
cgacgcggccgaccacgcac

SEQ ID NO: 5446 - RNA, 21 nt, Artificial Sequence
  Synthetic
acgacgcggccgaccacgcac

SEQ ID NO: 5447 - RNA, 22 nt, Artificial Sequence
  Synthetic
aacgacgcggccgaccacgcac

SEQ ID NO: 5448 - RNA, 23 nt, Artificial Sequence
  Synthetic
caacgacgcggccgaccacgcac

SEQ ID NO: 5449 - RNA, 24 nt, Artificial Sequence
  Synthetic
gcaacgacgcggccgaccacgcac

SEQ ID NO: 5450 - RNA, 18 nt, Artificial Sequence
  Synthetic
ucguccucgucguccgac

SEQ ID NO: 5451 - RNA, 19 nt, Artificial Sequence
  Synthetic
uucguccucgucguccgac

SEQ ID NO: 5452 - RNA, 20 nt, Artificial Sequence
  Synthetic
cuucguccucgucguccgac

SEQ ID NO: 5453 - RNA, 21 nt, Artificial Sequence
  Synthetic
ucuucguccucgucguccgac

SEQ ID NO: 5454 - RNA, 22 nt, Artificial Sequence
  Synthetic
cucuucguccucgucguccgac

SEQ ID NO: 5455 - RNA, 23 nt, Artificial Sequence
  Synthetic
ccucuucguccucgucguccgac

SEQ ID NO: 5456 - RNA, 24 nt, Artificial Sequence
  Synthetic
uccucuucguccucgucguccgac

SEQ ID NO: 5457 - RNA, 18 nt, Artificial Sequence
  Synthetic
ucgucguccgacgaggac

SEQ ID NO: 5458 - RNA, 19 nt, Artificial Sequence
  Synthetic
cucgucguccgacgaggac

SEQ ID NO: 5459 - RNA, 20 nt, Artificial Sequence
  Synthetic
ccucgucguccgacgaggac

SEQ ID NO: 5460 - RNA, 21 nt, Artificial Sequence
  Synthetic
uccucgucguccgacgaggac

SEQ ID NO: 5461 - RNA, 22 nt, Artificial Sequence
  Synthetic
guccucgucguccgacgaggac

SEQ ID NO: 5462 - RNA, 23 nt, Artificial Sequence
  Synthetic
cguccucgucguccgacgaggac

SEQ ID NO: 5463 - RNA, 24 nt, Artificial Sequence
  Synthetic
ucguccucgucguccgacgaggac

SEQ ID NO: 5464 - RNA, 18 nt, Artificial Sequence
  Synthetic
cugcuguacaccccggac

SEQ ID NO: 5465 - RNA, 19 nt, Artificial Sequence
  Synthetic
gcugcuguacaccccggac

SEQ ID NO: 5466 - RNA, 20 nt, Artificial Sequence
  Synthetic
ggcugcuguacaccccggac

SEQ ID NO: 5467 - RNA, 21 nt, Artificial Sequence
  Synthetic
cggcugcuguacaccccggac

SEQ ID NO: 5468 - RNA, 22 nt, Artificial Sequence
  Synthetic
gcggcugcuguacaccccggac

SEQ ID NO: 5469 - RNA, 23 nt, Artificial Sequence
  Synthetic
cgcggcugcuguacaccccggac

SEQ ID NO: 5470 - RNA, 24 nt, Artificial Sequence
  Synthetic
acgcggcugcuguacaccccggac

SEQ ID NO: 5471 - RNA, 18 nt, Artificial Sequence
  Synthetic
cggcgggaaguuguggac

SEQ ID NO: 5472 - RNA, 19 nt, Artificial Sequence
  Synthetic
gcggcgggaaguuguggac

SEQ ID NO: 5473 - RNA, 20 nt, Artificial Sequence
  Synthetic
cgcggcgggaaguuguggac

SEQ ID NO: 5474 - RNA, 21 nt, Artificial Sequence
  Synthetic
ccgcggcgggaaguuguggac

SEQ ID NO: 5475 - RNA, 22 nt, Artificial Sequence
  Synthetic
cccgcggcgggaaguuguggac

SEQ ID NO: 5476 - RNA, 23 nt, Artificial Sequence
  Synthetic
ccccgcggcgggaaguuguggac

SEQ ID NO: 5477 - RNA, 24 nt, Artificial Sequence
  Synthetic
cccccgcggcgggaaguuguggac

SEQ ID NO: 5478 - RNA, 18 nt, Artificial Sequence
  Synthetic
ggcgccggcgcagaugac

SEQ ID NO: 5479 - RNA, 19 nt, Artificial Sequence
  Synthetic
cggcgccggcgcagaugac

SEQ ID NO: 5480 - RNA, 20 nt, Artificial Sequence
  Synthetic
ccggcgccggcgcagaugac

SEQ ID NO: 5481 - RNA, 21 nt, Artificial Sequence
  Synthetic
cccggcgccggcgcagaugac

SEQ ID NO: 5482 - RNA, 22 nt, Artificial Sequence
  Synthetic
ccccggcgccggcgcagaugac

SEQ ID NO: 5483 - RNA, 23 nt, Artificial Sequence
  Synthetic
gccccggcgccggcgcagaugac

SEQ ID NO: 5484 - RNA, 24 nt, Artificial Sequence
  Synthetic
agccccggcgccggcgcagaugac

SEQ ID NO: 5485 - RNA, 18 nt, Artificial Sequence
  Synthetic
cgagaacgcggcgcugac

SEQ ID NO: 5486 - RNA, 19 nt, Artificial Sequence
  Synthetic
gcgagaacgcggcgcugac

SEQ ID NO: 5487 - RNA, 20 nt, Artificial Sequence
  Synthetic
cgcgagaacgcggcgcugac

SEQ ID NO: 5488 - RNA, 21 nt, Artificial Sequence
  Synthetic
gcgcgagaacgcggcgcugac

SEQ ID NO: 5489 - RNA, 22 nt, Artificial Sequence
  Synthetic
cgcgcgagaacgcggcgcugac

SEQ ID NO: 5490 - RNA, 23 nt, Artificial Sequence
  Synthetic
gcgcgcgagaacgcggcgcugac

SEQ ID NO: 5491 - RNA, 24 nt, Artificial Sequence
  Synthetic
ggcgcgcgagaacgcggcgcugac

SEQ ID NO: 5492 - RNA, 18 nt, Artificial Sequence
  Synthetic
acgcggcugcuguacacc

SEQ ID NO: 5493 - RNA, 19 nt, Artificial Sequence
  Synthetic
cacgcggcugcuguacacc

SEQ ID NO: 5494 - RNA, 20 nt, Artificial Sequence
  Synthetic
ucacgcggcugcuguacacc

SEQ ID NO: 5495 - RNA, 21 nt, Artificial Sequence
  Synthetic
aucacgcggcugcuguacacc

SEQ ID NO: 5496 - RNA, 22 nt, Artificial Sequence
  Synthetic
gaucacgcggcugcuguacacc

SEQ ID NO: 5497 - RNA, 23 nt, Artificial Sequence
  Synthetic
ugaucacgcggcugcuguacacc

SEQ ID NO: 5498 - RNA, 24 nt, Artificial Sequence
  Synthetic
cugaucacgcggcugcuguacacc

SEQ ID NO: 5499 - RNA, 18 nt, Artificial Sequence
  Synthetic
ugcgccagauccccgacc

SEQ ID NO: 5500 - RNA, 19 nt, Artificial Sequence
  Synthetic
augcgccagauccccgacc

SEQ ID NO: 5501 - RNA, 20 nt, Artificial Sequence
  Synthetic
gaugcgccagauccccgacc

SEQ ID NO: 5502 - RNA, 21 nt, Artificial Sequence
  Synthetic
ggaugcgccagauccccgacc

SEQ ID NO: 5503 - RNA, 22 nt, Artificial Sequence
  Synthetic
uggaugcgccagauccccgacc

SEQ ID NO: 5504 - RNA, 23 nt, Artificial Sequence
  Synthetic
cuggaugcgccagauccccgacc

SEQ ID NO: 5505 - RNA, 24 nt, Artificial Sequence
  Synthetic
ccuggaugcgccagauccccgacc

SEQ ID NO: 5506 - RNA, 18 nt, Artificial Sequence
  Synthetic
ggcggcggcccgcgaccc

SEQ ID NO: 5507 - RNA, 19 nt, Artificial Sequence
  Synthetic
aggcggcggcccgcgaccc

SEQ ID NO: 5508 - RNA, 20 nt, Artificial Sequence
  Synthetic
gaggcggcggcccgcgaccc

SEQ ID NO: 5509 - RNA, 21 nt, Artificial Sequence
  Synthetic
ggaggcggcggcccgcgaccc

SEQ ID NO: 5510 - RNA, 22 nt, Artificial Sequence
  Synthetic
cggaggcggcggcccgcgaccc

SEQ ID NO: 5511 - RNA, 23 nt, Artificial Sequence
  Synthetic
ccggaggcggcggcccgcgaccc

SEQ ID NO: 5512 - RNA, 24 nt, Artificial Sequence
  Synthetic
cccggaggcggcggcccgcgaccc

SEQ ID NO: 5513 - RNA, 18 nt, Artificial Sequence
  Synthetic
ccgcggccggagggaccc

SEQ ID NO: 5514 - RNA, 19 nt, Artificial Sequence
  Synthetic
cccgcggccggagggaccc

SEQ ID NO: 5515 - RNA, 20 nt, Artificial Sequence
  Synthetic
ccccgcggccggagggaccc

SEQ ID NO: 5516 - RNA, 21 nt, Artificial Sequence
  Synthetic
cccccgcggccggagggaccc

SEQ ID NO: 5517 - RNA, 22 nt, Artificial Sequence
  Synthetic
ccccccgcggccggagggaccc

SEQ ID NO: 5518 - RNA, 23 nt, Artificial Sequence
  Synthetic
gccccccgcggccggagggaccc

SEQ ID NO: 5519 - RNA, 24 nt, Artificial Sequence
  Synthetic
agccccccgcggccggagggaccc

SEQ ID NO: 5520 - RNA, 18 nt, Artificial Sequence
  Synthetic
ggcccucauguuugaccc

SEQ ID NO: 5521 - RNA, 19 nt, Artificial Sequence
  Synthetic
cggcccucauguuugaccc

SEQ ID NO: 5522 - RNA, 20 nt, Artificial Sequence
  Synthetic
ccggcccucauguuugaccc

SEQ ID NO: 5523 - RNA, 21 nt, Artificial Sequence
  Synthetic
accggcccucauguuugaccc

SEQ ID NO: 5524 - RNA, 22 nt, Artificial Sequence
  Synthetic
gaccggcccucauguuugaccc

SEQ ID NO: 5525 - RNA, 23 nt, Artificial Sequence
  Synthetic
cgaccggcccucauguuugaccc

SEQ ID NO: 5526 - RNA, 24 nt, Artificial Sequence
  Synthetic
gcgaccggcccucauguuugaccc

SEQ ID NO: 5527 - RNA, 18 nt, Artificial Sequence
  Synthetic
gccgagggccccgacccc

SEQ ID NO: 5528 - RNA, 19 nt, Artificial Sequence
  Synthetic
cgccgagggccccgacccc

SEQ ID NO: 5529 - RNA, 20 nt, Artificial Sequence
  Synthetic
ccgccgagggccccgacccc

SEQ ID NO: 5530 - RNA, 21 nt, Artificial Sequence
  Synthetic
cccgccgagggccccgacccc

SEQ ID NO: 5531 - RNA, 22 nt, Artificial Sequence
  Synthetic
gcccgccgagggccccgacccc

SEQ ID NO: 5532 - RNA, 23 nt, Artificial Sequence
  Synthetic
ggcccgccgagggccccgacccc

SEQ ID NO: 5533 - RNA, 24 nt, Artificial Sequence
  Synthetic
cggcccgccgagggccccgacccc

SEQ ID NO: 5534 - RNA, 18 nt, Artificial Sequence
  Synthetic
cgccagauccccgacccc

SEQ ID NO: 5535 - RNA, 19 nt, Artificial Sequence
  Synthetic
gcgccagauccccgacccc

SEQ ID NO: 5536 - RNA, 20 nt, Artificial Sequence
  Synthetic
ugcgccagauccccgacccc

SEQ ID NO: 5537 - RNA, 21 nt, Artificial Sequence
  Synthetic
augcgccagauccccgacccc

SEQ ID NO: 5538 - RNA, 22 nt, Artificial Sequence
  Synthetic
gaugcgccagauccccgacccc

SEQ ID NO: 5539 - RNA, 23 nt, Artificial Sequence
  Synthetic
ggaugcgccagauccccgacccc

SEQ ID NO: 5540 - RNA, 24 nt, Artificial Sequence
  Synthetic
uggaugcgccagauccccgacccc

SEQ ID NO: 5541 - RNA, 18 nt, Artificial Sequence
  Synthetic
acgauaacccccaccccc

SEQ ID NO: 5542 - RNA, 19 nt, Artificial Sequence
  Synthetic
gacgauaacccccaccccc

SEQ ID NO: 5543 - RNA, 20 nt, Artificial Sequence
  Synthetic
cgacgauaacccccaccccc

SEQ ID NO: 5544 - RNA, 21 nt, Artificial Sequence
  Synthetic
acgacgauaacccccaccccc

SEQ ID NO: 5545 - RNA, 22 nt, Artificial Sequence
  Synthetic
gacgacgauaacccccaccccc

SEQ ID NO: 5546 - RNA, 23 nt, Artificial Sequence
  Synthetic
cgacgacgauaacccccaccccc

SEQ ID NO: 5547 - RNA, 24 nt, Artificial Sequence
  Synthetic
acgacgacgauaacccccaccccc

SEQ ID NO: 5548 - RNA, 18 nt, Artificial Sequence
  Synthetic
gccgcgcccgccuccccc

SEQ ID NO: 5549 - RNA, 19 nt, Artificial Sequence
  Synthetic
cgccgcgcccgccuccccc

SEQ ID NO: 5550 - RNA, 20 nt, Artificial Sequence
  Synthetic
ccgccgcgcccgccuccccc

SEQ ID NO: 5551 - RNA, 21 nt, Artificial Sequence
  Synthetic
uccgccgcgcccgccuccccc

SEQ ID NO: 5552 - RNA, 22 nt, Artificial Sequence
  Synthetic
guccgccgcgcccgccuccccc

SEQ ID NO: 5553 - RNA, 23 nt, Artificial Sequence
  Synthetic
uguccgccgcgcccgccuccccc

SEQ ID NO: 5554 - RNA, 24 nt, Artificial Sequence
  Synthetic
cuguccgccgcgcccgccuccccc

SEQ ID NO: 5555 - RNA, 18 nt, Artificial Sequence
  Synthetic
gcuggcggcggcagcccc

SEQ ID NO: 5556 - RNA, 19 nt, Artificial Sequence
  Synthetic
ggcuggcggcggcagcccc

SEQ ID NO: 5557 - RNA, 20 nt, Artificial Sequence
  Synthetic
cggcuggcggcggcagcccc

SEQ ID NO: 5558 - RNA, 21 nt, Artificial Sequence
  Synthetic
gcggcuggcggcggcagcccc

SEQ ID NO: 5559 - RNA, 22 nt, Artificial Sequence
  Synthetic
ggcggcuggcggcggcagcccc

SEQ ID NO: 5560 - RNA, 23 nt, Artificial Sequence
  Synthetic
gggcggcuggcggcggcagcccc

SEQ ID NO: 5561 - RNA, 24 nt, Artificial Sequence
  Synthetic
ugggcggcuggcggcggcagcccc

SEQ ID NO: 5562 - RNA, 18 nt, Artificial Sequence
  Synthetic
cgccccccuccacgcccc

SEQ ID NO: 5563 - RNA, 19 nt, Artificial Sequence
  Synthetic
gcgccccccuccacgcccc

SEQ ID NO: 5564 - RNA, 20 nt, Artificial Sequence
  Synthetic
cgcgccccccuccacgcccc

SEQ ID NO: 5565 - RNA, 21 nt, Artificial Sequence
  Synthetic
ccgcgccccccuccacgcccc

SEQ ID NO: 5566 - RNA, 22 nt, Artificial Sequence
  Synthetic
cccgcgccccccuccacgcccc

SEQ ID NO: 5567 - RNA, 23 nt, Artificial Sequence
  Synthetic
gcccgcgccccccuccacgcccc

SEQ ID NO: 5568 - RNA, 24 nt, Artificial Sequence
  Synthetic
cgcccgcgccccccuccacgcccc

SEQ ID NO: 5569 - RNA, 18 nt, Artificial Sequence
  Synthetic
gcgccgggcccccgcccc

SEQ ID NO: 5570 - RNA, 19 nt, Artificial Sequence
  Synthetic
ggcgccgggcccccgcccc

SEQ ID NO: 5571 - RNA, 20 nt, Artificial Sequence
  Synthetic
cggcgccgggcccccgcccc

SEQ ID NO: 5572 - RNA, 21 nt, Artificial Sequence
  Synthetic
ccggcgccgggcccccgcccc

SEQ ID NO: 5573 - RNA, 22 nt, Artificial Sequence
  Synthetic
cccggcgccgggcccccgcccc

SEQ ID NO: 5574 - RNA, 23 nt, Artificial Sequence
  Synthetic
gcccggcgccgggcccccgcccc

SEQ ID NO: 5575 - RNA, 24 nt, Artificial Sequence
  Synthetic
ggcccggcgccgggcccccgcccc

SEQ ID NO: 5576 - RNA, 18 nt, Artificial Sequence
  Synthetic
aacccgcgcguggucccc

SEQ ID NO: 5577 - RNA, 19 nt, Artificial Sequence
  Synthetic
gaacccgcgcguggucccc

SEQ ID NO: 5578 - RNA, 20 nt, Artificial Sequence
  Synthetic
agaacccgcgcguggucccc

SEQ ID NO: 5579 - RNA, 21 nt, Artificial Sequence
  Synthetic
cagaacccgcgcguggucccc

SEQ ID NO: 5580 - RNA, 22 nt, Artificial Sequence
  Synthetic
ccagaacccgcgcguggucccc

SEQ ID NO: 5581 - RNA, 23 nt, Artificial Sequence
  Synthetic
uccagaacccgcgcguggucccc

SEQ ID NO: 5582 - RNA, 24 nt, Artificial Sequence
  Synthetic
cuccagaacccgcgcguggucccc

SEQ ID NO: 5583 - RNA, 18 nt, Artificial Sequence
  Synthetic
gcgcggcgccggcagccc

SEQ ID NO: 5584 - RNA, 19 nt, Artificial Sequence
  Synthetic
agcgcggcgccggcagccc

SEQ ID NO: 5585 - RNA, 20 nt, Artificial Sequence
  Synthetic
gagcgcggcgccggcagccc

SEQ ID NO: 5586 - RNA, 21 nt, Artificial Sequence
  Synthetic
cgagcgcggcgccggcagccc

SEQ ID NO: 5587 - RNA, 22 nt, Artificial Sequence
  Synthetic
ucgagcgcggcgccggcagccc

SEQ ID NO: 5588 - RNA, 23 nt, Artificial Sequence
  Synthetic
gucgagcgcggcgccggcagccc

SEQ ID NO: 5589 - RNA, 24 nt, Artificial Sequence
  Synthetic
cgucgagcgcggcgccggcagccc

SEQ ID NO: 5590 - RNA, 18 nt, Artificial Sequence
  Synthetic
ggcuggcggcggcagccc

SEQ ID NO: 5591 - RNA, 19 nt, Artificial Sequence
  Synthetic
cggcuggcggcggcagccc

SEQ ID NO: 5592 - RNA, 20 nt, Artificial Sequence
  Synthetic
gcggcuggcggcggcagccc

SEQ ID NO: 5593 - RNA, 21 nt, Artificial Sequence
  Synthetic
ggcggcuggcggcggcagccc

SEQ ID NO: 5594 - RNA, 22 nt, Artificial Sequence
  Synthetic
gggcggcuggcggcggcagccc

SEQ ID NO: 5595 - RNA, 23 nt, Artificial Sequence
  Synthetic
ugggcggcuggcggcggcagccc

SEQ ID NO: 5596 - RNA, 24 nt, Artificial Sequence
  Synthetic
cugggcggcuggcggcggcagccc

SEQ ID NO: 5597 - RNA, 18 nt, Artificial Sequence
  Synthetic
gcgccccccuccacgccc

SEQ ID NO: 5598 - RNA, 19 nt, Artificial Sequence
  Synthetic
cgcgccccccuccacgccc

SEQ ID NO: 5599 - RNA, 20 nt, Artificial Sequence
  Synthetic
ccgcgccccccuccacgccc

SEQ ID NO: 5600 - RNA, 21 nt, Artificial Sequence
  Synthetic
cccgcgccccccuccacgccc

SEQ ID NO: 5601 - RNA, 22 nt, Artificial Sequence
  Synthetic
gcccgcgccccccuccacgccc

SEQ ID NO: 5602 - RNA, 23 nt, Artificial Sequence
  Synthetic
cgcccgcgccccccuccacgccc

SEQ ID NO: 5603 - RNA, 24 nt, Artificial Sequence
  Synthetic
gcgcccgcgccccccuccacgccc

SEQ ID NO: 5604 - RNA, 18 nt, Artificial Sequence
  Synthetic
ggcgccgggcccccgccc

SEQ ID NO: 5605 - RNA, 19 nt, Artificial Sequence
  Synthetic
cggcgccgggcccccgccc

SEQ ID NO: 5606 - RNA, 20 nt, Artificial Sequence
  Synthetic
ccggcgccgggcccccgccc

SEQ ID NO: 5607 - RNA, 21 nt, Artificial Sequence
  Synthetic
cccggcgccgggcccccgccc

SEQ ID NO: 5608 - RNA, 22 nt, Artificial Sequence
  Synthetic
gcccggcgccgggcccccgccc

SEQ ID NO: 5609 - RNA, 23 nt, Artificial Sequence
  Synthetic
ggcccggcgccgggcccccgccc

SEQ ID NO: 5610 - RNA, 24 nt, Artificial Sequence
  Synthetic
uggcccggcgccgggcccccgccc

SEQ ID NO: 5611 - RNA, 18 nt, Artificial Sequence
  Synthetic
cgcccgcggccgccgccc

SEQ ID NO: 5612 - RNA, 19 nt, Artificial Sequence
  Synthetic
gcgcccgcggccgccgccc

SEQ ID NO: 5613 - RNA, 20 nt, Artificial Sequence
  Synthetic
ggcgcccgcggccgccgccc

SEQ ID NO: 5614 - RNA, 21 nt, Artificial Sequence
  Synthetic
cggcgcccgcggccgccgccc

SEQ ID NO: 5615 - RNA, 22 nt, Artificial Sequence
  Synthetic
gcggcgcccgcggccgccgccc

SEQ ID NO: 5616 - RNA, 23 nt, Artificial Sequence
  Synthetic
ggcggcgcccgcggccgccgccc

SEQ ID NO: 5617 - RNA, 24 nt, Artificial Sequence
  Synthetic
cggcggcgcccgcggccgccgccc

SEQ ID NO: 5618 - RNA, 18 nt, Artificial Sequence
  Synthetic
cggggauccucgccgccc

SEQ ID NO: 5619 - RNA, 19 nt, Artificial Sequence
  Synthetic
gcggggauccucgccgccc

SEQ ID NO: 5620 - RNA, 20 nt, Artificial Sequence
  Synthetic
cgcggggauccucgccgccc

SEQ ID NO: 5621 - RNA, 21 nt, Artificial Sequence
  Synthetic
ccgcggggauccucgccgccc

SEQ ID NO: 5622 - RNA, 22 nt, Artificial Sequence
  Synthetic
gccgcggggauccucgccgccc

SEQ ID NO: 5623 - RNA, 23 nt, Artificial Sequence
  Synthetic
cgccgcggggauccucgccgccc

SEQ ID NO: 5624 - RNA, 24 nt, Artificial Sequence
  Synthetic
gcgccgcggggauccucgccgccc

SEQ ID NO: 5625 - RNA, 18 nt, Artificial Sequence
  Synthetic
cggcgacgacgacggccc

SEQ ID NO: 5626 - RNA, 19 nt, Artificial Sequence
  Synthetic
gcggcgacgacgacggccc

SEQ ID NO: 5627 - RNA, 20 nt, Artificial Sequence
  Synthetic
cgcggcgacgacgacggccc

SEQ ID NO: 5628 - RNA, 21 nt, Artificial Sequence
  Synthetic
gcgcggcgacgacgacggccc

SEQ ID NO: 5629 - RNA, 22 nt, Artificial Sequence
  Synthetic
ugcgcggcgacgacgacggccc

SEQ ID NO: 5630 - RNA, 23 nt, Artificial Sequence
  Synthetic
cugcgcggcgacgacgacggccc

SEQ ID NO: 5631 - RNA, 24 nt, Artificial Sequence
  Synthetic
gcugcgcggcgacgacgacggccc

SEQ ID NO: 5632 - RNA, 18 nt, Artificial Sequence
  Synthetic
gaacccgcgcgugguccc

SEQ ID NO: 5633 - RNA, 19 nt, Artificial Sequence
  Synthetic
agaacccgcgcgugguccc

SEQ ID NO: 5634 - RNA, 20 nt, Artificial Sequence
  Synthetic
cagaacccgcgcgugguccc

SEQ ID NO: 5635 - RNA, 21 nt, Artificial Sequence
  Synthetic
ccagaacccgcgcgugguccc

SEQ ID NO: 5636 - RNA, 22 nt, Artificial Sequence
  Synthetic
uccagaacccgcgcgugguccc

SEQ ID NO: 5637 - RNA, 23 nt, Artificial Sequence
  Synthetic
cuccagaacccgcgcgugguccc

SEQ ID NO: 5638 - RNA, 24 nt, Artificial Sequence
  Synthetic
gcuccagaacccgcgcgugguccc

SEQ ID NO: 5639 - RNA, 18 nt, Artificial Sequence
  Synthetic
cgaggccgcgcccaagcc

SEQ ID NO: 5640 - RNA, 19 nt, Artificial Sequence
  Synthetic
ccgaggccgcgcccaagcc

SEQ ID NO: 5641 - RNA, 20 nt, Artificial Sequence
  Synthetic
uccgaggccgcgcccaagcc

SEQ ID NO: 5642 - RNA, 21 nt, Artificial Sequence
  Synthetic
cuccgaggccgcgcccaagcc

SEQ ID NO: 5643 - RNA, 22 nt, Artificial Sequence
  Synthetic
ucuccgaggccgcgcccaagcc

SEQ ID NO: 5644 - RNA, 23 nt, Artificial Sequence
  Synthetic
cucuccgaggccgcgcccaagcc

SEQ ID NO: 5645 - RNA, 24 nt, Artificial Sequence
  Synthetic
ccucuccgaggccgcgcccaagcc

SEQ ID NO: 5646 - RNA, 18 nt, Artificial Sequence
  Synthetic
guggccggccgcgacgcc

SEQ ID NO: 5647 - RNA, 19 nt, Artificial Sequence
  Synthetic
gguggccggccgcgacgcc

SEQ ID NO: 5648 - RNA, 20 nt, Artificial Sequence
  Synthetic
cgguggccggccgcgacgcc

SEQ ID NO: 5649 - RNA, 21 nt, Artificial Sequence
  Synthetic
gcgguggccggccgcgacgcc

SEQ ID NO: 5650 - RNA, 22 nt, Artificial Sequence
  Synthetic
ggcgguggccggccgcgacgcc

SEQ ID NO: 5651 - RNA, 23 nt, Artificial Sequence
  Synthetic
cggcgguggccggccgcgacgcc

SEQ ID NO: 5652 - RNA, 24 nt, Artificial Sequence
  Synthetic
gcggcgguggccggccgcgacgcc

SEQ ID NO: 5653 - RNA, 18 nt, Artificial Sequence
  Synthetic
gugucgcgccggcccgcc

SEQ ID NO: 5654 - RNA, 19 nt, Artificial Sequence
  Synthetic
cgugucgcgccggcccgcc

SEQ ID NO: 5655 - RNA, 20 nt, Artificial Sequence
  Synthetic
ccgugucgcgccggcccgcc

SEQ ID NO: 5656 - RNA, 21 nt, Artificial Sequence
  Synthetic
gccgugucgcgccggcccgcc

SEQ ID NO: 5657 - RNA, 22 nt, Artificial Sequence
  Synthetic
ggccgugucgcgccggcccgcc

SEQ ID NO: 5658 - RNA, 23 nt, Artificial Sequence
  Synthetic
uggccgugucgcgccggcccgcc

SEQ ID NO: 5659 - RNA, 24 nt, Artificial Sequence
  Synthetic
guggccgugucgcgccggcccgcc

SEQ ID NO: 5660 - RNA, 18 nt, Artificial Sequence
  Synthetic
uccgcggccgccgccgcc

SEQ ID NO: 5661 - RNA, 19 nt, Artificial Sequence
  Synthetic
cuccgcggccgccgccgcc

SEQ ID NO: 5662 - RNA, 20 nt, Artificial Sequence
  Synthetic
gcuccgcggccgccgccgcc

SEQ ID NO: 5663 - RNA, 21 nt, Artificial Sequence
  Synthetic
agcuccgcggccgccgccgcc

SEQ ID NO: 5664 - RNA, 22 nt, Artificial Sequence
  Synthetic
gagcuccgcggccgccgccgcc

SEQ ID NO: 5665 - RNA, 23 nt, Artificial Sequence
  Synthetic
cgagcuccgcggccgccgccgcc

SEQ ID NO: 5666 - RNA, 24 nt, Artificial Sequence
  Synthetic
ccgagcuccgcggccgccgccgcc

SEQ ID NO: 5667 - RNA, 18 nt, Artificial Sequence
  Synthetic
gcgcccgcggccgccgcc

SEQ ID NO: 5668 - RNA, 19 nt, Artificial Sequence
  Synthetic
ggcgcccgcggccgccgcc

SEQ ID NO: 5669 - RNA, 20 nt, Artificial Sequence
  Synthetic
cggcgcccgcggccgccgcc

SEQ ID NO: 5670 - RNA, 21 nt, Artificial Sequence
  Synthetic
gcggcgcccgcggccgccgcc

SEQ ID NO: 5671 - RNA, 22 nt, Artificial Sequence
  Synthetic
ggcggcgcccgcggccgccgcc

SEQ ID NO: 5672 - RNA, 23 nt, Artificial Sequence
  Synthetic
cggcggcgcccgcggccgccgcc

SEQ ID NO: 5673 - RNA, 24 nt, Artificial Sequence
  Synthetic
acggcggcgcccgcggccgccgcc

SEQ ID NO: 5674 - RNA, 18 nt, Artificial Sequence
  Synthetic
gcggggauccucgccgcc

SEQ ID NO: 5675 - RNA, 19 nt, Artificial Sequence
  Synthetic
cgcggggauccucgccgcc

SEQ ID NO: 5676 - RNA, 20 nt, Artificial Sequence
  Synthetic
ccgcggggauccucgccgcc

SEQ ID NO: 5677 - RNA, 21 nt, Artificial Sequence
  Synthetic
gccgcggggauccucgccgcc

SEQ ID NO: 5678 - RNA, 22 nt, Artificial Sequence
  Synthetic
cgccgcggggauccucgccgcc

SEQ ID NO: 5679 - RNA, 23 nt, Artificial Sequence
  Synthetic
gcgccgcggggauccucgccgcc

SEQ ID NO: 5680 - RNA, 24 nt, Artificial Sequence
  Synthetic
ggcgccgcggggauccucgccgcc

SEQ ID NO: 5681 - RNA, 18 nt, Artificial Sequence
  Synthetic
cggcccggcccggccgcc

SEQ ID NO: 5682 - RNA, 19 nt, Artificial Sequence
  Synthetic
ccggcccggcccggccgcc

SEQ ID NO: 5683 - RNA, 20 nt, Artificial Sequence
  Synthetic
cccggcccggcccggccgcc

SEQ ID NO: 5684 - RNA, 21 nt, Artificial Sequence
  Synthetic
ucccggcccggcccggccgcc

SEQ ID NO: 5685 - RNA, 22 nt, Artificial Sequence
  Synthetic
gucccggcccggcccggccgcc

SEQ ID NO: 5686 - RNA, 23 nt, Artificial Sequence
  Synthetic
agucccggcccggcccggccgcc

SEQ ID NO: 5687 - RNA, 24 nt, Artificial Sequence
  Synthetic
gagucccggcccggcccggccgcc

SEQ ID NO: 5688 - RNA, 18 nt, Artificial Sequence
  Synthetic
cacccccacggggccgcc

SEQ ID NO: 5689 - RNA, 19 nt, Artificial Sequence
  Synthetic
ccacccccacggggccgcc

SEQ ID NO: 5690 - RNA, 20 nt, Artificial Sequence
  Synthetic
cccacccccacggggccgcc

SEQ ID NO: 5691 - RNA, 21 nt, Artificial Sequence
  Synthetic
ccccacccccacggggccgcc

SEQ ID NO: 5692 - RNA, 22 nt, Artificial Sequence
  Synthetic
cccccacccccacggggccgcc

SEQ ID NO: 5693 - RNA, 23 nt, Artificial Sequence
  Synthetic
acccccacccccacggggccgcc

SEQ ID NO: 5694 - RNA, 24 nt, Artificial Sequence
  Synthetic
aacccccacccccacggggccgcc

SEQ ID NO: 5695 - RNA, 18 nt, Artificial Sequence
  Synthetic
cgccgccuccgccgcgcc

SEQ ID NO: 5696 - RNA, 19 nt, Artificial Sequence
  Synthetic
ccgccgccuccgccgcgcc

SEQ ID NO: 5697 - RNA, 20 nt, Artificial Sequence
  Synthetic
gccgccgccuccgccgcgcc

SEQ ID NO: 5698 - RNA, 21 nt, Artificial Sequence
  Synthetic
cgccgccgccuccgccgcgcc

SEQ ID NO: 5699 - RNA, 22 nt, Artificial Sequence
  Synthetic
ccgccgccgccuccgccgcgcc

SEQ ID NO: 5700 - RNA, 23 nt, Artificial Sequence
  Synthetic
gccgccgccgccuccgccgcgcc

SEQ ID NO: 5701 - RNA, 24 nt, Artificial Sequence
  Synthetic
ggccgccgccgccuccgccgcgcc

SEQ ID NO: 5702 - RNA, 18 nt, Artificial Sequence
  Synthetic
uuuggcccccugcgcgcc

SEQ ID NO: 5703 - RNA, 19 nt, Artificial Sequence
  Synthetic
cuuuggcccccugcgcgcc

SEQ ID NO: 5704 - RNA, 20 nt, Artificial Sequence
  Synthetic
ucuuuggcccccugcgcgcc

SEQ ID NO: 5705 - RNA, 21 nt, Artificial Sequence
  Synthetic
cucuuuggcccccugcgcgcc

SEQ ID NO: 5706 - RNA, 22 nt, Artificial Sequence
  Synthetic
ccucuuuggcccccugcgcgcc

SEQ ID NO: 5707 - RNA, 23 nt, Artificial Sequence
  Synthetic
gccucuuuggcccccugcgcgcc

SEQ ID NO: 5708 - RNA, 24 nt, Artificial Sequence
  Synthetic
cgccucuuuggcccccugcgcgcc

SEQ ID NO: 5709 - RNA, 18 nt, Artificial Sequence
  Synthetic
guggccgccgugcgcgcc

SEQ ID NO: 5710 - RNA, 19 nt, Artificial Sequence
  Synthetic
cguggccgccgugcgcgcc

SEQ ID NO: 5711 - RNA, 20 nt, Artificial Sequence
  Synthetic
ccguggccgccgugcgcgcc

SEQ ID NO: 5712 - RNA, 21 nt, Artificial Sequence
  Synthetic
gccguggccgccgugcgcgcc

SEQ ID NO: 5713 - RNA, 22 nt, Artificial Sequence
  Synthetic
cgccguggccgccgugcgcgcc

SEQ ID NO: 5714 - RNA, 23 nt, Artificial Sequence
  Synthetic
ccgccguggccgccgugcgcgcc

SEQ ID NO: 5715 - RNA, 24 nt, Artificial Sequence
  Synthetic
gccgccguggccgccgugcgcgcc

SEQ ID NO: 5716 - RNA, 18 nt, Artificial Sequence
  Synthetic
guggacugggaaggcgcc

SEQ ID NO: 5717 - RNA, 19 nt, Artificial Sequence
  Synthetic
uguggacugggaaggcgcc

SEQ ID NO: 5718 - RNA, 20 nt, Artificial Sequence
  Synthetic
uuguggacugggaaggcgcc

SEQ ID NO: 5719 - RNA, 21 nt, Artificial Sequence
  Synthetic
guuguggacugggaaggcgcc

SEQ ID NO: 5720 - RNA, 22 nt, Artificial Sequence
  Synthetic
aguuguggacugggaaggcgcc

SEQ ID NO: 5721 - RNA, 23 nt, Artificial Sequence
  Synthetic
aaguuguggacugggaaggcgcc

SEQ ID NO: 5722 - RNA, 24 nt, Artificial Sequence
  Synthetic
gaaguuguggacugggaaggcgcc

SEQ ID NO: 5723 - RNA, 18 nt, Artificial Sequence
  Synthetic
cccgccggguacggcgcc

SEQ ID NO: 5724 - RNA, 19 nt, Artificial Sequence
  Synthetic
gcccgccggguacggcgcc

SEQ ID NO: 5725 - RNA, 20 nt, Artificial Sequence
  Synthetic
ugcccgccggguacggcgcc

SEQ ID NO: 5726 - RNA, 21 nt, Artificial Sequence
  Synthetic
gugcccgccggguacggcgcc

SEQ ID NO: 5727 - RNA, 22 nt, Artificial Sequence
  Synthetic
ggugcccgccggguacggcgcc

SEQ ID NO: 5728 - RNA, 23 nt, Artificial Sequence
  Synthetic
cggugcccgccggguacggcgcc

SEQ ID NO: 5729 - RNA, 24 nt, Artificial Sequence
  Synthetic
gcggugcccgccggguacggcgcc

SEQ ID NO: 5730 - RNA, 18 nt, Artificial Sequence
  Synthetic
cgcccagcccgcggcgcc

SEQ ID NO: 5731 - RNA, 19 nt, Artificial Sequence
  Synthetic
ccgcccagcccgcggcgcc

SEQ ID NO: 5732 - RNA, 20 nt, Artificial Sequence
  Synthetic
cccgcccagcccgcggcgcc

SEQ ID NO: 5733 - RNA, 21 nt, Artificial Sequence
  Synthetic
ccccgcccagcccgcggcgcc

SEQ ID NO: 5734 - RNA, 22 nt, Artificial Sequence
  Synthetic
cccccgcccagcccgcggcgcc

SEQ ID NO: 5735 - RNA, 23 nt, Artificial Sequence
  Synthetic
gcccccgcccagcccgcggcgcc

SEQ ID NO: 5736 - RNA, 24 nt, Artificial Sequence
  Synthetic
cgcccccgcccagcccgcggcgcc

SEQ ID NO: 5737 - RNA, 18 nt, Artificial Sequence
  Synthetic
cgacgccgguucgaggcc

SEQ ID NO: 5738 - RNA, 19 nt, Artificial Sequence
  Synthetic
gcgacgccgguucgaggcc

SEQ ID NO: 5739 - RNA, 20 nt, Artificial Sequence
  Synthetic
cgcgacgccgguucgaggcc

SEQ ID NO: 5740 - RNA, 21 nt, Artificial Sequence
  Synthetic
gcgcgacgccgguucgaggcc

SEQ ID NO: 5741 - RNA, 22 nt, Artificial Sequence
  Synthetic
ggcgcgacgccgguucgaggcc

SEQ ID NO: 5742 - RNA, 23 nt, Artificial Sequence
  Synthetic
aggcgcgacgccgguucgaggcc

SEQ ID NO: 5743 - RNA, 24 nt, Artificial Sequence
  Synthetic
gaggcgcgacgccgguucgaggcc

SEQ ID NO: 5744 - RNA, 18 nt, Artificial Sequence
  Synthetic
accccggacgcggaggcc

SEQ ID NO: 5745 - RNA, 19 nt, Artificial Sequence
  Synthetic
caccccggacgcggaggcc

SEQ ID NO: 5746 - RNA, 20 nt, Artificial Sequence
  Synthetic
acaccccggacgcggaggcc

SEQ ID NO: 5747 - RNA, 21 nt, Artificial Sequence
  Synthetic
uacaccccggacgcggaggcc

SEQ ID NO: 5748 - RNA, 22 nt, Artificial Sequence
  Synthetic
guacaccccggacgcggaggcc

SEQ ID NO: 5749 - RNA, 23 nt, Artificial Sequence
  Synthetic
uguacaccccggacgcggaggcc

SEQ ID NO: 5750 - RNA, 24 nt, Artificial Sequence
  Synthetic
cuguacaccccggacgcggaggcc

SEQ ID NO: 5751 - RNA, 18 nt, Artificial Sequence
  Synthetic
gcggcgacgacgacggcc

SEQ ID NO: 5752 - RNA, 19 nt, Artificial Sequence
  Synthetic
cgcggcgacgacgacggcc

SEQ ID NO: 5753 - RNA, 20 nt, Artificial Sequence
  Synthetic
gcgcggcgacgacgacggcc

SEQ ID NO: 5754 - RNA, 21 nt, Artificial Sequence
  Synthetic
ugcgcggcgacgacgacggcc

SEQ ID NO: 5755 - RNA, 22 nt, Artificial Sequence
  Synthetic
cugcgcggcgacgacgacggcc

SEQ ID NO: 5756 - RNA, 23 nt, Artificial Sequence
  Synthetic
gcugcgcggcgacgacgacggcc

SEQ ID NO: 5757 - RNA, 24 nt, Artificial Sequence
  Synthetic
ugcugcgcggcgacgacgacggcc

SEQ ID NO: 5758 - RNA, 18 nt, Artificial Sequence
  Synthetic
gacggccgggcggcggcc

SEQ ID NO: 5759 - RNA, 19 nt, Artificial Sequence
  Synthetic
ggacggccgggcggcggcc

SEQ ID NO: 5760 - RNA, 20 nt, Artificial Sequence
  Synthetic
uggacggccgggcggcggcc

SEQ ID NO: 5761 - RNA, 21 nt, Artificial Sequence
  Synthetic
cuggacggccgggcggcggcc

SEQ ID NO: 5762 - RNA, 22 nt, Artificial Sequence
  Synthetic
gcuggacggccgggcggcggcc

SEQ ID NO: 5763 - RNA, 23 nt, Artificial Sequence
  Synthetic
cgcuggacggccgggcggcggcc

SEQ ID NO: 5764 - RNA, 24 nt, Artificial Sequence
  Synthetic
gcgcuggacggccgggcggcggcc

SEQ ID NO: 5765 - RNA, 18 nt, Artificial Sequence
  Synthetic
auucgcugggccucggcc

SEQ ID NO: 5766 - RNA, 19 nt, Artificial Sequence
  Synthetic
gauucgcugggccucggcc

SEQ ID NO: 5767 - RNA, 20 nt, Artificial Sequence
  Synthetic
ggauucgcugggccucggcc

SEQ ID NO: 5768 - RNA, 21 nt, Artificial Sequence
  Synthetic
gggauucgcugggccucggcc

SEQ ID NO: 5769 - RNA, 22 nt, Artificial Sequence
  Synthetic
cgggauucgcugggccucggcc

SEQ ID NO: 5770 - RNA, 23 nt, Artificial Sequence
  Synthetic
ccgggauucgcugggccucggcc

SEQ ID NO: 5771 - RNA, 24 nt, Artificial Sequence
  Synthetic
cccgggauucgcugggccucggcc

SEQ ID NO: 5772 - RNA, 18 nt, Artificial Sequence
  Synthetic
cgggccgcguguucggcc

SEQ ID NO: 5773 - RNA, 19 nt, Artificial Sequence
  Synthetic
ucgggccgcguguucggcc

SEQ ID NO: 5774 - RNA, 20 nt, Artificial Sequence
  Synthetic
cucgggccgcguguucggcc

SEQ ID NO: 5775 - RNA, 21 nt, Artificial Sequence
  Synthetic
ccucgggccgcguguucggcc

SEQ ID NO: 5776 - RNA, 22 nt, Artificial Sequence
  Synthetic
gccucgggccgcguguucggcc

SEQ ID NO: 5777 - RNA, 23 nt, Artificial Sequence
  Synthetic
ggccucgggccgcguguucggcc

SEQ ID NO: 5778 - RNA, 24 nt, Artificial Sequence
  Synthetic
uggccucgggccgcguguucggcc

SEQ ID NO: 5779 - RNA, 18 nt, Artificial Sequence
  Synthetic
ggcccgguggcgcgggcc

SEQ ID NO: 5780 - RNA, 19 nt, Artificial Sequence
  Synthetic
cggcccgguggcgcgggcc

SEQ ID NO: 5781 - RNA, 20 nt, Artificial Sequence
  Synthetic
ccggcccgguggcgcgggcc

SEQ ID NO: 5782 - RNA, 21 nt, Artificial Sequence
  Synthetic
cccggcccgguggcgcgggcc

SEQ ID NO: 5783 - RNA, 22 nt, Artificial Sequence
  Synthetic
gcccggcccgguggcgcgggcc

SEQ ID NO: 5784 - RNA, 23 nt, Artificial Sequence
  Synthetic
ggcccggcccgguggcgcgggcc

SEQ ID NO: 5785 - RNA, 24 nt, Artificial Sequence
  Synthetic
cggcccggcccgguggcgcgggcc

SEQ ID NO: 5786 - RNA, 18 nt, Artificial Sequence
  Synthetic
agccuggucgccggggcc

SEQ ID NO: 5787 - RNA, 19 nt, Artificial Sequence
  Synthetic
gagccuggucgccggggcc

SEQ ID NO: 5788 - RNA, 20 nt, Artificial Sequence
  Synthetic
ugagccuggucgccggggcc

SEQ ID NO: 5789 - RNA, 21 nt, Artificial Sequence
  Synthetic
gugagccuggucgccggggcc

SEQ ID NO: 5790 - RNA, 22 nt, Artificial Sequence
  Synthetic
cgugagccuggucgccggggcc

SEQ ID NO: 5791 - RNA, 23 nt, Artificial Sequence
  Synthetic
ccgugagccuggucgccggggcc

SEQ ID NO: 5792 - RNA, 24 nt, Artificial Sequence
  Synthetic
gccgugagccuggucgccggggcc

SEQ ID NO: 5793 - RNA, 18 nt, Artificial Sequence
  Synthetic
cuggccuucgccggggcc

SEQ ID NO: 5794 - RNA, 19 nt, Artificial Sequence
  Synthetic
ccuggccuucgccggggcc

SEQ ID NO: 5795 - RNA, 20 nt, Artificial Sequence
  Synthetic
accuggccuucgccggggcc

SEQ ID NO: 5796 - RNA, 21 nt, Artificial Sequence
  Synthetic
gaccuggccuucgccggggcc

SEQ ID NO: 5797 - RNA, 22 nt, Artificial Sequence
  Synthetic
ggaccuggccuucgccggggcc

SEQ ID NO: 5798 - RNA, 23 nt, Artificial Sequence
  Synthetic
gggaccuggccuucgccggggcc

SEQ ID NO: 5799 - RNA, 24 nt, Artificial Sequence
  Synthetic
cgggaccuggccuucgccggggcc

SEQ ID NO: 5800 - RNA, 18 nt, Artificial Sequence
  Synthetic
cuggccggcggcggggcc

SEQ ID NO: 5801 - RNA, 19 nt, Artificial Sequence
  Synthetic
ccuggccggcggcggggcc

SEQ ID NO: 5802 - RNA, 20 nt, Artificial Sequence
  Synthetic
accuggccggcggcggggcc

SEQ ID NO: 5803 - RNA, 21 nt, Artificial Sequence
  Synthetic
gaccuggccggcggcggggcc

SEQ ID NO: 5804 - RNA, 22 nt, Artificial Sequence
  Synthetic
ggaccuggccggcggcggggcc

SEQ ID NO: 5805 - RNA, 23 nt, Artificial Sequence
  Synthetic
aggaccuggccggcggcggggcc

SEQ ID NO: 5806 - RNA, 24 nt, Artificial Sequence
  Synthetic
gaggaccuggccggcggcggggcc

SEQ ID NO: 5807 - RNA, 18 nt, Artificial Sequence
  Synthetic
gcggcgcugacgggggcc

SEQ ID NO: 5808 - RNA, 19 nt, Artificial Sequence
  Synthetic
cgcggcgcugacgggggcc

SEQ ID NO: 5809 - RNA, 20 nt, Artificial Sequence
  Synthetic
acgcggcgcugacgggggcc

SEQ ID NO: 5810 - RNA, 21 nt, Artificial Sequence
  Synthetic
aacgcggcgcugacgggggcc

SEQ ID NO: 5811 - RNA, 22 nt, Artificial Sequence
  Synthetic
gaacgcggcgcugacgggggcc

SEQ ID NO: 5812 - RNA, 23 nt, Artificial Sequence
  Synthetic
agaacgcggcgcugacgggggcc

SEQ ID NO: 5813 - RNA, 24 nt, Artificial Sequence
  Synthetic
gagaacgcggcgcugacgggggcc

SEQ ID NO: 5814 - RNA, 18 nt, Artificial Sequence
  Synthetic
cuggcggcggcgggggcc

SEQ ID NO: 5815 - RNA, 19 nt, Artificial Sequence
  Synthetic
gcuggcggcggcgggggcc

SEQ ID NO: 5816 - RNA, 20 nt, Artificial Sequence
  Synthetic
ugcuggcggcggcgggggcc

SEQ ID NO: 5817 - RNA, 21 nt, Artificial Sequence
  Synthetic
gugcuggcggcggcgggggcc

SEQ ID NO: 5818 - RNA, 22 nt, Artificial Sequence
  Synthetic
cgugcuggcggcggcgggggcc

SEQ ID NO: 5819 - RNA, 23 nt, Artificial Sequence
  Synthetic
ccgugcuggcggcggcgggggcc

SEQ ID NO: 5820 - RNA, 24 nt, Artificial Sequence
  Synthetic
accgugcuggcggcggcgggggcc

SEQ ID NO: 5821 - RNA, 18 nt, Artificial Sequence
  Synthetic
auccuggaggcgcuggcc

SEQ ID NO: 5822 - RNA, 19 nt, Artificial Sequence
  Synthetic
gauccuggaggcgcuggcc

SEQ ID NO: 5823 - RNA, 20 nt, Artificial Sequence
  Synthetic
ggauccuggaggcgcuggcc

SEQ ID NO: 5824 - RNA, 21 nt, Artificial Sequence
  Synthetic
gggauccuggaggcgcuggcc

SEQ ID NO: 5825 - RNA, 22 nt, Artificial Sequence
  Synthetic
cgggauccuggaggcgcuggcc

SEQ ID NO: 5826 - RNA, 23 nt, Artificial Sequence
  Synthetic
gcgggauccuggaggcgcuggcc

SEQ ID NO: 5827 - RNA, 24 nt, Artificial Sequence
  Synthetic
cgcgggauccuggaggcgcuggcc

SEQ ID NO: 5828 - RNA, 18 nt, Artificial Sequence
  Synthetic
cgccgcacggugcuggcc

SEQ ID NO: 5829 - RNA, 19 nt, Artificial Sequence
  Synthetic
gcgccgcacggugcuggcc

SEQ ID NO: 5830 - RNA, 20 nt, Artificial Sequence
  Synthetic
ugcgccgcacggugcuggcc

SEQ ID NO: 5831 - RNA, 21 nt, Artificial Sequence
  Synthetic
cugcgccgcacggugcuggcc

SEQ ID NO: 5832 - RNA, 22 nt, Artificial Sequence
  Synthetic
ccugcgccgcacggugcuggcc

SEQ ID NO: 5833 - RNA, 23 nt, Artificial Sequence
  Synthetic
accugcgccgcacggugcuggcc

SEQ ID NO: 5834 - RNA, 24 nt, Artificial Sequence
  Synthetic
gaccugcgccgcacggugcuggcc

SEQ ID NO: 5835 - RNA, 18 nt, Artificial Sequence
  Synthetic
gcggcggccgccguggcc

SEQ ID NO: 5836 - RNA, 19 nt, Artificial Sequence
  Synthetic
cgcggcggccgccguggcc

SEQ ID NO: 5837 - RNA, 20 nt, Artificial Sequence
  Synthetic
acgcggcggccgccguggcc

SEQ ID NO: 5838 - RNA, 21 nt, Artificial Sequence
  Synthetic
cacgcggcggccgccguggcc

SEQ ID NO: 5839 - RNA, 22 nt, Artificial Sequence
  Synthetic
gcacgcggcggccgccguggcc

SEQ ID NO: 5840 - RNA, 23 nt, Artificial Sequence
  Synthetic
cgcacgcggcggccgccguggcc

SEQ ID NO: 5841 - RNA, 24 nt, Artificial Sequence
  Synthetic
gcgcacgcggcggccgccguggcc

SEQ ID NO: 5842 - RNA, 18 nt, Artificial Sequence
  Synthetic
agugccuggccgccugcc

SEQ ID NO: 5843 - RNA, 19 nt, Artificial Sequence
  Synthetic
gagugccuggccgccugcc

SEQ ID NO: 5844 - RNA, 20 nt, Artificial Sequence
  Synthetic
cgagugccuggccgccugcc

SEQ ID NO: 5845 - RNA, 21 nt, Artificial Sequence
  Synthetic
ucgagugccuggccgccugcc

SEQ ID NO: 5846 - RNA, 22 nt, Artificial Sequence
  Synthetic
gucgagugccuggccgccugcc

SEQ ID NO: 5847 - RNA, 23 nt, Artificial Sequence
  Synthetic
cgucgagugccuggccgccugcc

SEQ ID NO: 5848 - RNA, 24 nt, Artificial Sequence
  Synthetic
ccgucgagugccuggccgccugcc

SEQ ID NO: 5849 - RNA, 18 nt, Artificial Sequence
  Synthetic
ccugggccccgcgcugcc

SEQ ID NO: 5850 - RNA, 19 nt, Artificial Sequence
  Synthetic
cccugggccccgcgcugcc

SEQ ID NO: 5851 - RNA, 20 nt, Artificial Sequence
  Synthetic
gcccugggccccgcgcugcc

SEQ ID NO: 5852 - RNA, 21 nt, Artificial Sequence
  Synthetic
ggcccugggccccgcgcugcc

SEQ ID NO: 5853 - RNA, 22 nt, Artificial Sequence
  Synthetic
gggcccugggccccgcgcugcc

SEQ ID NO: 5854 - RNA, 23 nt, Artificial Sequence
  Synthetic
ggggcccugggccccgcgcugcc

SEQ ID NO: 5855 - RNA, 24 nt, Artificial Sequence
  Synthetic
cggggcccugggccccgcgcugcc

SEQ ID NO: 5856 - RNA, 18 nt, Artificial Sequence
  Synthetic
ccgccugccgcgggaucc

SEQ ID NO: 5857 - RNA, 19 nt, Artificial Sequence
  Synthetic
gccgccugccgcgggaucc

SEQ ID NO: 5858 - RNA, 20 nt, Artificial Sequence
  Synthetic
ggccgccugccgcgggaucc

SEQ ID NO: 5859 - RNA, 21 nt, Artificial Sequence
  Synthetic
uggccgccugccgcgggaucc

SEQ ID NO: 5860 - RNA, 22 nt, Artificial Sequence
  Synthetic
cuggccgccugccgcgggaucc

SEQ ID NO: 5861 - RNA, 23 nt, Artificial Sequence
  Synthetic
ccuggccgccugccgcgggaucc

SEQ ID NO: 5862 - RNA, 24 nt, Artificial Sequence
  Synthetic
gccuggccgccugccgcgggaucc

SEQ ID NO: 5863 - RNA, 18 nt, Artificial Sequence
  Synthetic
aggacccccgcggccucc

SEQ ID NO: 5864 - RNA, 19 nt, Artificial Sequence
  Synthetic
gaggacccccgcggccucc

SEQ ID NO: 5865 - RNA, 20 nt, Artificial Sequence
  Synthetic
cgaggacccccgcggccucc

SEQ ID NO: 5866 - RNA, 21 nt, Artificial Sequence
  Synthetic
gcgaggacccccgcggccucc

SEQ ID NO: 5867 - RNA, 22 nt, Artificial Sequence
  Synthetic
ggcgaggacccccgcggccucc

SEQ ID NO: 5868 - RNA, 23 nt, Artificial Sequence
  Synthetic
cggcgaggacccccgcggccucc

SEQ ID NO: 5869 - RNA, 24 nt, Artificial Sequence
  Synthetic
gcggcgaggacccccgcggccucc

SEQ ID NO: 5870 - RNA, 18 nt, Artificial Sequence
  Synthetic
gcgaccuggcggccgucc

SEQ ID NO: 5871 - RNA, 19 nt, Artificial Sequence
  Synthetic
ggcgaccuggcggccgucc

SEQ ID NO: 5872 - RNA, 20 nt, Artificial Sequence
  Synthetic
cggcgaccuggcggccgucc

SEQ ID NO: 5873 - RNA, 21 nt, Artificial Sequence
  Synthetic
acggcgaccuggcggccgucc

SEQ ID NO: 5874 - RNA, 22 nt, Artificial Sequence
  Synthetic
gacggcgaccuggcggccgucc

SEQ ID NO: 5875 - RNA, 23 nt, Artificial Sequence
  Synthetic
cgacggcgaccuggcggccgucc

SEQ ID NO: 5876 - RNA, 24 nt, Artificial Sequence
  Synthetic
ucgacggcgaccuggcggccgucc

SEQ ID NO: 5877 - RNA, 18 nt, Artificial Sequence
  Synthetic
agaacccgcgcguggucc

SEQ ID NO: 5878 - RNA, 19 nt, Artificial Sequence
  Synthetic
cagaacccgcgcguggucc

SEQ ID NO: 5879 - RNA, 20 nt, Artificial Sequence
  Synthetic
ccagaacccgcgcguggucc

SEQ ID NO: 5880 - RNA, 21 nt, Artificial Sequence
  Synthetic
uccagaacccgcgcguggucc

SEQ ID NO: 5881 - RNA, 22 nt, Artificial Sequence
  Synthetic
cuccagaacccgcgcguggucc

SEQ ID NO: 5882 - RNA, 23 nt, Artificial Sequence
  Synthetic
gcuccagaacccgcgcguggucc

SEQ ID NO: 5883 - RNA, 24 nt, Artificial Sequence
  Synthetic
ggcuccagaacccgcgcguggucc

SEQ ID NO: 5884 - RNA, 18 nt, Artificial Sequence
  Synthetic
cgcgacggguacgucagc

SEQ ID NO: 5885 - RNA, 19 nt, Artificial Sequence
  Synthetic
ucgcgacggguacgucagc

SEQ ID NO: 5886 - RNA, 20 nt, Artificial Sequence
  Synthetic
aucgcgacggguacgucagc

SEQ ID NO: 5887 - RNA, 21 nt, Artificial Sequence
  Synthetic
uaucgcgacggguacgucagc

SEQ ID NO: 5888 - RNA, 22 nt, Artificial Sequence
  Synthetic
cuaucgcgacggguacgucagc

SEQ ID NO: 5889 - RNA, 23 nt, Artificial Sequence
  Synthetic
gcuaucgcgacggguacgucagc

SEQ ID NO: 5890 - RNA, 24 nt, Artificial Sequence
  Synthetic
cgcuaucgcgacggguacgucagc

SEQ ID NO: 5891 - RNA, 18 nt, Artificial Sequence
  Synthetic
ggcggacgccgcccccgc

SEQ ID NO: 5892 - RNA, 19 nt, Artificial Sequence
  Synthetic
gggcggacgccgcccccgc

SEQ ID NO: 5893 - RNA, 20 nt, Artificial Sequence
  Synthetic
cgggcggacgccgcccccgc

SEQ ID NO: 5894 - RNA, 21 nt, Artificial Sequence
  Synthetic
ccgggcggacgccgcccccgc

SEQ ID NO: 5895 - RNA, 22 nt, Artificial Sequence
  Synthetic
cccgggcggacgccgcccccgc

SEQ ID NO: 5896 - RNA, 23 nt, Artificial Sequence
  Synthetic
ccccgggcggacgccgcccccgc

SEQ ID NO: 5897 - RNA, 24 nt, Artificial Sequence
  Synthetic
cccccgggcggacgccgcccccgc

SEQ ID NO: 5898 - RNA, 18 nt, Artificial Sequence
  Synthetic
cgcgcccgccucccccgc

SEQ ID NO: 5899 - RNA, 19 nt, Artificial Sequence
  Synthetic
ccgcgcccgccucccccgc

SEQ ID NO: 5900 - RNA, 20 nt, Artificial Sequence
  Synthetic
gccgcgcccgccucccccgc

SEQ ID NO: 5901 - RNA, 21 nt, Artificial Sequence
  Synthetic
cgccgcgcccgccucccccgc

SEQ ID NO: 5902 - RNA, 22 nt, Artificial Sequence
  Synthetic
ccgccgcgcccgccucccccgc

SEQ ID NO: 5903 - RNA, 23 nt, Artificial Sequence
  Synthetic
uccgccgcgcccgccucccccgc

SEQ ID NO: 5904 - RNA, 24 nt, Artificial Sequence
  Synthetic
guccgccgcgcccgccucccccgc

SEQ ID NO: 5905 - RNA, 18 nt, Artificial Sequence
  Synthetic
ggccugggcgacagccgc

SEQ ID NO: 5906 - RNA, 19 nt, Artificial Sequence
  Synthetic
cggccugggcgacagccgc

SEQ ID NO: 5907 - RNA, 20 nt, Artificial Sequence
  Synthetic
gcggccugggcgacagccgc

SEQ ID NO: 5908 - RNA, 21 nt, Artificial Sequence
  Synthetic
ggcggccugggcgacagccgc

SEQ ID NO: 5909 - RNA, 22 nt, Artificial Sequence
  Synthetic
cggcggccugggcgacagccgc

SEQ ID NO: 5910 - RNA, 23 nt, Artificial Sequence
  Synthetic
acggcggccugggcgacagccgc

SEQ ID NO: 5911 - RNA, 24 nt, Artificial Sequence
  Synthetic
uacggcggccugggcgacagccgc

SEQ ID NO: 5912 - RNA, 18 nt, Artificial Sequence
  Synthetic
ccgccuccgccgcgccgc

SEQ ID NO: 5913 - RNA, 19 nt, Artificial Sequence
  Synthetic
gccgccuccgccgcgccgc

SEQ ID NO: 5914 - RNA, 20 nt, Artificial Sequence
  Synthetic
cgccgccuccgccgcgccgc

SEQ ID NO: 5915 - RNA, 21 nt, Artificial Sequence
  Synthetic
ccgccgccuccgccgcgccgc

SEQ ID NO: 5916 - RNA, 22 nt, Artificial Sequence
  Synthetic
gccgccgccuccgccgcgccgc

SEQ ID NO: 5917 - RNA, 23 nt, Artificial Sequence
  Synthetic
cgccgccgccuccgccgcgccgc

SEQ ID NO: 5918 - RNA, 24 nt, Artificial Sequence
  Synthetic
ccgccgccgccuccgccgcgccgc

SEQ ID NO: 5919 - RNA, 18 nt, Artificial Sequence
  Synthetic
cccugccgccggcgccgc

SEQ ID NO: 5920 - RNA, 19 nt, Artificial Sequence
  Synthetic
gcccugccgccggcgccgc

SEQ ID NO: 5921 - RNA, 20 nt, Artificial Sequence
  Synthetic
ggcccugccgccggcgccgc

SEQ ID NO: 5922 - RNA, 21 nt, Artificial Sequence
  Synthetic
gggcccugccgccggcgccgc

SEQ ID NO: 5923 - RNA, 22 nt, Artificial Sequence
  Synthetic
ggggcccugccgccggcgccgc

SEQ ID NO: 5924 - RNA, 23 nt, Artificial Sequence
  Synthetic
gggggcccugccgccggcgccgc

SEQ ID NO: 5925 - RNA, 24 nt, Artificial Sequence
  Synthetic
cgggggcccugccgccggcgccgc

SEQ ID NO: 5926 - RNA, 18 nt, Artificial Sequence
  Synthetic
cgggccggacacggccgc

SEQ ID NO: 5927 - RNA, 19 nt, Artificial Sequence
  Synthetic
gcgggccggacacggccgc

SEQ ID NO: 5928 - RNA, 20 nt, Artificial Sequence
  Synthetic
ugcgggccggacacggccgc

SEQ ID NO: 5929 - RNA, 21 nt, Artificial Sequence
  Synthetic
gugcgggccggacacggccgc

SEQ ID NO: 5930 - RNA, 22 nt, Artificial Sequence
  Synthetic
ugugcgggccggacacggccgc

SEQ ID NO: 5931 - RNA, 23 nt, Artificial Sequence
  Synthetic
cugugcgggccggacacggccgc

SEQ ID NO: 5932 - RNA, 24 nt, Artificial Sequence
  Synthetic
gcugugcgggccggacacggccgc

SEQ ID NO: 5933 - RNA, 18 nt, Artificial Sequence
  Synthetic
ccggcccggcccggccgc

SEQ ID NO: 5934 - RNA, 19 nt, Artificial Sequence
  Synthetic
cccggcccggcccggccgc

SEQ ID NO: 5935 - RNA, 20 nt, Artificial Sequence
  Synthetic
ucccggcccggcccggccgc

SEQ ID NO: 5936 - RNA, 21 nt, Artificial Sequence
  Synthetic
gucccggcccggcccggccgc

SEQ ID NO: 5937 - RNA, 22 nt, Artificial Sequence
  Synthetic
agucccggcccggcccggccgc

SEQ ID NO: 5938 - RNA, 23 nt, Artificial Sequence
  Synthetic
gagucccggcccggcccggccgc

SEQ ID NO: 5939 - RNA, 24 nt, Artificial Sequence
  Synthetic
agagucccggcccggcccggccgc

SEQ ID NO: 5940 - RNA, 18 nt, Artificial Sequence
  Synthetic
ccacccccacggggccgc

SEQ ID NO: 5941 - RNA, 19 nt, Artificial Sequence
  Synthetic
cccacccccacggggccgc

SEQ ID NO: 5942 - RNA, 20 nt, Artificial Sequence
  Synthetic
ccccacccccacggggccgc

SEQ ID NO: 5943 - RNA, 21 nt, Artificial Sequence
  Synthetic
cccccacccccacggggccgc

SEQ ID NO: 5944 - RNA, 22 nt, Artificial Sequence
  Synthetic
acccccacccccacggggccgc

SEQ ID NO: 5945 - RNA, 23 nt, Artificial Sequence
  Synthetic
aacccccacccccacggggccgc

SEQ ID NO: 5946 - RNA, 24 nt, Artificial Sequence
  Synthetic
uaacccccacccccacggggccgc

SEQ ID NO: 5947 - RNA, 18 nt, Artificial Sequence
  Synthetic
ggcgcugacgggggccgc

SEQ ID NO: 5948 - RNA, 19 nt, Artificial Sequence
  Synthetic
cggcgcugacgggggccgc

SEQ ID NO: 5949 - RNA, 20 nt, Artificial Sequence
  Synthetic
gcggcgcugacgggggccgc

SEQ ID NO: 5950 - RNA, 21 nt, Artificial Sequence
  Synthetic
cgcggcgcugacgggggccgc

SEQ ID NO: 5951 - RNA, 22 nt, Artificial Sequence
  Synthetic
acgcggcgcugacgggggccgc

SEQ ID NO: 5952 - RNA, 23 nt, Artificial Sequence
  Synthetic
aacgcggcgcugacgggggccgc

SEQ ID NO: 5953 - RNA, 24 nt, Artificial Sequence
  Synthetic
gaacgcggcgcugacgggggccgc

SEQ ID NO: 5954 - RNA, 18 nt, Artificial Sequence
  Synthetic
cacgccgccugcgcgcgc

SEQ ID NO: 5955 - RNA, 19 nt, Artificial Sequence
  Synthetic
gcacgccgccugcgcgcgc

SEQ ID NO: 5956 - RNA, 20 nt, Artificial Sequence
  Synthetic
cgcacgccgccugcgcgcgc

SEQ ID NO: 5957 - RNA, 21 nt, Artificial Sequence
  Synthetic
ucgcacgccgccugcgcgcgc

SEQ ID NO: 5958 - RNA, 22 nt, Artificial Sequence
  Synthetic
cucgcacgccgccugcgcgcgc

SEQ ID NO: 5959 - RNA, 23 nt, Artificial Sequence
  Synthetic
acucgcacgccgccugcgcgcgc

SEQ ID NO: 5960 - RNA, 24 nt, Artificial Sequence
  Synthetic
cacucgcacgccgccugcgcgcgc

SEQ ID NO: 5961 - RNA, 18 nt, Artificial Sequence
  Synthetic
ccgggggucuucgcgcgc

SEQ ID NO: 5962 - RNA, 19 nt, Artificial Sequence
  Synthetic
cccgggggucuucgcgcgc

SEQ ID NO: 5963 - RNA, 20 nt, Artificial Sequence
  Synthetic
gcccgggggucuucgcgcgc

SEQ ID NO: 5964 - RNA, 21 nt, Artificial Sequence
  Synthetic
ggcccgggggucuucgcgcgc

SEQ ID NO: 5965 - RNA, 22 nt, Artificial Sequence
  Synthetic
cggcccgggggucuucgcgcgc

SEQ ID NO: 5966 - RNA, 23 nt, Artificial Sequence
  Synthetic
ucggcccgggggucuucgcgcgc

SEQ ID NO: 5967 - RNA, 24 nt, Artificial Sequence
  Synthetic
uucggcccgggggucuucgcgcgc

SEQ ID NO: 5968 - RNA, 18 nt, Artificial Sequence
  Synthetic
gcgccccuguuggcgcgc

SEQ ID NO: 5969 - RNA, 19 nt, Artificial Sequence
  Synthetic
cgcgccccuguuggcgcgc

SEQ ID NO: 5970 - RNA, 20 nt, Artificial Sequence
  Synthetic
acgcgccccuguuggcgcgc

SEQ ID NO: 5971 - RNA, 21 nt, Artificial Sequence
  Synthetic
uacgcgccccuguuggcgcgc

SEQ ID NO: 5972 - RNA, 22 nt, Artificial Sequence
  Synthetic
cuacgcgccccuguuggcgcgc

SEQ ID NO: 5973 - RNA, 23 nt, Artificial Sequence
  Synthetic
ccuacgcgccccuguuggcgcgc

SEQ ID NO: 5974 - RNA, 24 nt, Artificial Sequence
  Synthetic
gccuacgcgccccuguuggcgcgc

SEQ ID NO: 5975 - RNA, 18 nt, Artificial Sequence
  Synthetic
uguggacugggaaggcgc

SEQ ID NO: 5976 - RNA, 19 nt, Artificial Sequence
  Synthetic
uuguggacugggaaggcgc

SEQ ID NO: 5977 - RNA, 20 nt, Artificial Sequence
  Synthetic
guuguggacugggaaggcgc

SEQ ID NO: 5978 - RNA, 21 nt, Artificial Sequence
  Synthetic
aguuguggacugggaaggcgc

SEQ ID NO: 5979 - RNA, 22 nt, Artificial Sequence
  Synthetic
aaguuguggacugggaaggcgc

SEQ ID NO: 5980 - RNA, 23 nt, Artificial Sequence
  Synthetic
gaaguuguggacugggaaggcgc

SEQ ID NO: 5981 - RNA, 24 nt, Artificial Sequence
  Synthetic
ggaaguuguggacugggaaggcgc

SEQ ID NO: 5982 - RNA, 18 nt, Artificial Sequence
  Synthetic
cgggccucuggggggcgc

SEQ ID NO: 5983 - RNA, 19 nt, Artificial Sequence
  Synthetic
ccgggccucuggggggcgc

SEQ ID NO: 5984 - RNA, 20 nt, Artificial Sequence
  Synthetic
cccgggccucuggggggcgc

SEQ ID NO: 5985 - RNA, 21 nt, Artificial Sequence
  Synthetic
gcccgggccucuggggggcgc

SEQ ID NO: 5986 - RNA, 22 nt, Artificial Sequence
  Synthetic
cgcccgggccucuggggggcgc

SEQ ID NO: 5987 - RNA, 23 nt, Artificial Sequence
  Synthetic
ccgcccgggccucuggggggcgc

SEQ ID NO: 5988 - RNA, 24 nt, Artificial Sequence
  Synthetic
gccgcccgggccucuggggggcgc

SEQ ID NO: 5989 - RNA, 18 nt, Artificial Sequence
  Synthetic
cggcggccgugugggcgc

SEQ ID NO: 5990 - RNA, 19 nt, Artificial Sequence
  Synthetic
ccggcggccgugugggcgc

SEQ ID NO: 5991 - RNA, 20 nt, Artificial Sequence
  Synthetic
cccggcggccgugugggcgc

SEQ ID NO: 5992 - RNA, 21 nt, Artificial Sequence
  Synthetic
ccccggcggccgugugggcgc

SEQ ID NO: 5993 - RNA, 22 nt, Artificial Sequence
  Synthetic
gccccggcggccgugugggcgc

SEQ ID NO: 5994 - RNA, 23 nt, Artificial Sequence
  Synthetic
cgccccggcggccgugugggcgc

SEQ ID NO: 5995 - RNA, 24 nt, Artificial Sequence
  Synthetic
gcgccccggcggccgugugggcgc

SEQ ID NO: 5996 - RNA, 18 nt, Artificial Sequence
  Synthetic
ggcccguguacguggcgc

SEQ ID NO: 5997 - RNA, 19 nt, Artificial Sequence
  Synthetic
cggcccguguacguggcgc

SEQ ID NO: 5998 - RNA, 20 nt, Artificial Sequence
  Synthetic
gcggcccguguacguggcgc

SEQ ID NO: 5999 - RNA, 21 nt, Artificial Sequence
  Synthetic
ugcggcccguguacguggcgc

SEQ ID NO: 6000 - RNA, 22 nt, Artificial Sequence
  Synthetic
cugcggcccguguacguggcgc

SEQ ID NO: 6001 - RNA, 23 nt, Artificial Sequence
  Synthetic
gcugcggcccguguacguggcgc

SEQ ID NO: 6002 - RNA, 24 nt, Artificial Sequence
  Synthetic
cgcugcggcccguguacguggcgc

SEQ ID NO: 6003 - RNA, 18 nt, Artificial Sequence
  Synthetic
acgcgccccuguuggcgc

SEQ ID NO: 6004 - RNA, 19 nt, Artificial Sequence
  Synthetic
uacgcgccccuguuggcgc

SEQ ID NO: 6005 - RNA, 20 nt, Artificial Sequence
  Synthetic
cuacgcgccccuguuggcgc

SEQ ID NO: 6006 - RNA, 21 nt, Artificial Sequence
  Synthetic
ccuacgcgccccuguuggcgc

SEQ ID NO: 6007 - RNA, 22 nt, Artificial Sequence
  Synthetic
gccuacgcgccccuguuggcgc

SEQ ID NO: 6008 - RNA, 23 nt, Artificial Sequence
  Synthetic
cgccuacgcgccccuguuggcgc

SEQ ID NO: 6009 - RNA, 24 nt, Artificial Sequence
  Synthetic
gcgccuacgcgccccuguuggcgc

SEQ ID NO: 6010 - RNA, 18 nt, Artificial Sequence
  Synthetic
gugcucaugcgccugcgc

SEQ ID NO: 6011 - RNA, 19 nt, Artificial Sequence
  Synthetic
ggugcucaugcgccugcgc

SEQ ID NO: 6012 - RNA, 20 nt, Artificial Sequence
  Synthetic
uggugcucaugcgccugcgc

SEQ ID NO: 6013 - RNA, 21 nt, Artificial Sequence
  Synthetic
cuggugcucaugcgccugcgc

SEQ ID NO: 6014 - RNA, 22 nt, Artificial Sequence
  Synthetic
gcuggugcucaugcgccugcgc

SEQ ID NO: 6015 - RNA, 23 nt, Artificial Sequence
  Synthetic
cgcuggugcucaugcgccugcgc

SEQ ID NO: 6016 - RNA, 24 nt, Artificial Sequence
  Synthetic
gcgcuggugcucaugcgccugcgc

SEQ ID NO: 6017 - RNA, 18 nt, Artificial Sequence
  Synthetic
cgccgugagccuggucgc

SEQ ID NO: 6018 - RNA, 19 nt, Artificial Sequence
  Synthetic
gcgccgugagccuggucgc

SEQ ID NO: 6019 - RNA, 20 nt, Artificial Sequence
  Synthetic
cgcgccgugagccuggucgc

SEQ ID NO: 6020 - RNA, 21 nt, Artificial Sequence
  Synthetic
gcgcgccgugagccuggucgc

SEQ ID NO: 6021 - RNA, 22 nt, Artificial Sequence
  Synthetic
ugcgcgccgugagccuggucgc

SEQ ID NO: 6022 - RNA, 23 nt, Artificial Sequence
  Synthetic
gugcgcgccgugagccuggucgc

SEQ ID NO: 6023 - RNA, 24 nt, Artificial Sequence
  Synthetic
cgugcgcgccgugagccuggucgc

SEQ ID NO: 6024 - RNA, 18 nt, Artificial Sequence
  Synthetic
gcgggaccuggccuucgc

SEQ ID NO: 6025 - RNA, 19 nt, Artificial Sequence
  Synthetic
cgcgggaccuggccuucgc

SEQ ID NO: 6026 - RNA, 20 nt, Artificial Sequence
  Synthetic
acgcgggaccuggccuucgc

SEQ ID NO: 6027 - RNA, 21 nt, Artificial Sequence
  Synthetic
cacgcgggaccuggccuucgc

SEQ ID NO: 6028 - RNA, 22 nt, Artificial Sequence
  Synthetic
ccacgcgggaccuggccuucgc

SEQ ID NO: 6029 - RNA, 23 nt, Artificial Sequence
  Synthetic
uccacgcgggaccuggccuucgc

SEQ ID NO: 6030 - RNA, 24 nt, Artificial Sequence
  Synthetic
guccacgcgggaccuggccuucgc

SEQ ID NO: 6031 - RNA, 18 nt, Artificial Sequence
  Synthetic
cgaccacgcacgcgaggc

SEQ ID NO: 6032 - RNA, 19 nt, Artificial Sequence
  Synthetic
ccgaccacgcacgcgaggc

SEQ ID NO: 6033 - RNA, 20 nt, Artificial Sequence
  Synthetic
gccgaccacgcacgcgaggc

SEQ ID NO: 6034 - RNA, 21 nt, Artificial Sequence
  Synthetic
ggccgaccacgcacgcgaggc

SEQ ID NO: 6035 - RNA, 22 nt, Artificial Sequence
  Synthetic
cggccgaccacgcacgcgaggc

SEQ ID NO: 6036 - RNA, 23 nt, Artificial Sequence
  Synthetic
gcggccgaccacgcacgcgaggc

SEQ ID NO: 6037 - RNA, 24 nt, Artificial Sequence
  Synthetic
cgcggccgaccacgcacgcgaggc

SEQ ID NO: 6038 - RNA, 18 nt, Artificial Sequence
  Synthetic
cgcggcgacgacgacggc

SEQ ID NO: 6039 - RNA, 19 nt, Artificial Sequence
  Synthetic
gcgcggcgacgacgacggc

SEQ ID NO: 6040 - RNA, 20 nt, Artificial Sequence
  Synthetic
ugcgcggcgacgacgacggc

SEQ ID NO: 6041 - RNA, 21 nt, Artificial Sequence
  Synthetic
cugcgcggcgacgacgacggc

SEQ ID NO: 6042 - RNA, 22 nt, Artificial Sequence
  Synthetic
gcugcgcggcgacgacgacggc

SEQ ID NO: 6043 - RNA, 23 nt, Artificial Sequence
  Synthetic
ugcugcgcggcgacgacgacggc

SEQ ID NO: 6044 - RNA, 24 nt, Artificial Sequence
  Synthetic
gugcugcgcggcgacgacgacggc

SEQ ID NO: 6045 - RNA, 18 nt, Artificial Sequence
  Synthetic
ggcgcggacgcccccggc

SEQ ID NO: 6046 - RNA, 19 nt, Artificial Sequence
  Synthetic
cggcgcggacgcccccggc

SEQ ID NO: 6047 - RNA, 20 nt, Artificial Sequence
  Synthetic
gcggcgcggacgcccccggc

SEQ ID NO: 6048 - RNA, 21 nt, Artificial Sequence
  Synthetic
agcggcgcggacgcccccggc

SEQ ID NO: 6049 - RNA, 22 nt, Artificial Sequence
  Synthetic
gagcggcgcggacgcccccggc

SEQ ID NO: 6050 - RNA, 23 nt, Artificial Sequence
  Synthetic
agagcggcgcggacgcccccggc

SEQ ID NO: 6051 - RNA, 24 nt, Artificial Sequence
  Synthetic
aagagcggcgcggacgcccccggc

SEQ ID NO: 6052 - RNA, 18 nt, Artificial Sequence
  Synthetic
aagacgaagaagagcggc

SEQ ID NO: 6053 - RNA, 19 nt, Artificial Sequence
  Synthetic
gaagacgaagaagagcggc

SEQ ID NO: 6054 - RNA, 20 nt, Artificial Sequence
  Synthetic
cgaagacgaagaagagcggc

SEQ ID NO: 6055 - RNA, 21 nt, Artificial Sequence
  Synthetic
ccgaagacgaagaagagcggc

SEQ ID NO: 6056 - RNA, 22 nt, Artificial Sequence
  Synthetic
cccgaagacgaagaagagcggc

SEQ ID NO: 6057 - RNA, 23 nt, Artificial Sequence
  Synthetic
ccccgaagacgaagaagagcggc

SEQ ID NO: 6058 - RNA, 24 nt, Artificial Sequence
  Synthetic
cccccgaagacgaagaagagcggc

SEQ ID NO: 6059 - RNA, 18 nt, Artificial Sequence
  Synthetic
ccgccagccccccgcggc

SEQ ID NO: 6060 - RNA, 19 nt, Artificial Sequence
  Synthetic
cccgccagccccccgcggc

SEQ ID NO: 6061 - RNA, 20 nt, Artificial Sequence
  Synthetic
gcccgccagccccccgcggc

SEQ ID NO: 6062 - RNA, 21 nt, Artificial Sequence
  Synthetic
ggcccgccagccccccgcggc

SEQ ID NO: 6063 - RNA, 22 nt, Artificial Sequence
  Synthetic
cggcccgccagccccccgcggc

SEQ ID NO: 6064 - RNA, 23 nt, Artificial Sequence
  Synthetic
ccggcccgccagccccccgcggc

SEQ ID NO: 6065 - RNA, 24 nt, Artificial Sequence
  Synthetic
cccggcccgccagccccccgcggc

SEQ ID NO: 6066 - RNA, 18 nt, Artificial Sequence
  Synthetic
uggccacgcccccgcggc

SEQ ID NO: 6067 - RNA, 19 nt, Artificial Sequence
  Synthetic
uuggccacgcccccgcggc

SEQ ID NO: 6068 - RNA, 20 nt, Artificial Sequence
  Synthetic
cuuggccacgcccccgcggc

SEQ ID NO: 6069 - RNA, 21 nt, Artificial Sequence
  Synthetic
gcuuggccacgcccccgcggc

SEQ ID NO: 6070 - RNA, 22 nt, Artificial Sequence
  Synthetic
ggcuuggccacgcccccgcggc

SEQ ID NO: 6071 - RNA, 23 nt, Artificial Sequence
  Synthetic
gggcuuggccacgcccccgcggc

SEQ ID NO: 6072 - RNA, 24 nt, Artificial Sequence
  Synthetic
cgggcuuggccacgcccccgcggc

SEQ ID NO: 6073 - RNA, 18 nt, Artificial Sequence
  Synthetic
cgggugcuguacggcggc

SEQ ID NO: 6074 - RNA, 19 nt, Artificial Sequence
  Synthetic
gcgggugcuguacggcggc

SEQ ID NO: 6075 - RNA, 20 nt, Artificial Sequence
  Synthetic
ggcgggugcuguacggcggc

SEQ ID NO: 6076 - RNA, 21 nt, Artificial Sequence
  Synthetic
gggcgggugcuguacggcggc

SEQ ID NO: 6077 - RNA, 22 nt, Artificial Sequence
  Synthetic
ggggcgggugcuguacggcggc

SEQ ID NO: 6078 - RNA, 23 nt, Artificial Sequence
  Synthetic
cggggcgggugcuguacggcggc

SEQ ID NO: 6079 - RNA, 24 nt, Artificial Sequence
  Synthetic
ccggggcgggugcuguacggcggc

SEQ ID NO: 6080 - RNA, 18 nt, Artificial Sequence
  Synthetic
cgugcgcuggccggcggc

SEQ ID NO: 6081 - RNA, 19 nt, Artificial Sequence
  Synthetic
ccgugcgcuggccggcggc

SEQ ID NO: 6082 - RNA, 20 nt, Artificial Sequence
  Synthetic
gccgugcgcuggccggcggc

SEQ ID NO: 6083 - RNA, 21 nt, Artificial Sequence
  Synthetic
cgccgugcgcuggccggcggc

SEQ ID NO: 6084 - RNA, 22 nt, Artificial Sequence
  Synthetic
gcgccgugcgcuggccggcggc

SEQ ID NO: 6085 - RNA, 23 nt, Artificial Sequence
  Synthetic
ugcgccgugcgcuggccggcggc

SEQ ID NO: 6086 - RNA, 24 nt, Artificial Sequence
  Synthetic
gugcgccgugcgcuggccggcggc

SEQ ID NO: 6087 - RNA, 18 nt, Artificial Sequence
  Synthetic
caagccccgggcggcggc

SEQ ID NO: 6088 - RNA, 19 nt, Artificial Sequence
  Synthetic
ccaagccccgggcggcggc

SEQ ID NO: 6089 - RNA, 20 nt, Artificial Sequence
  Synthetic
cccaagccccgggcggcggc

SEQ ID NO: 6090 - RNA, 21 nt, Artificial Sequence
  Synthetic
gcccaagccccgggcggcggc

SEQ ID NO: 6091 - RNA, 22 nt, Artificial Sequence
  Synthetic
cgcccaagccccgggcggcggc

SEQ ID NO: 6092 - RNA, 23 nt, Artificial Sequence
  Synthetic
gcgcccaagccccgggcggcggc

SEQ ID NO: 6093 - RNA, 24 nt, Artificial Sequence
  Synthetic
cgcgcccaagccccgggcggcggc

SEQ ID NO: 6094 - RNA, 18 nt, Artificial Sequence
  Synthetic
caccgugcuggcggcggc

SEQ ID NO: 6095 - RNA, 19 nt, Artificial Sequence
  Synthetic
gcaccgugcuggcggcggc

SEQ ID NO: 6096 - RNA, 20 nt, Artificial Sequence
  Synthetic
ggcaccgugcuggcggcggc

SEQ ID NO: 6097 - RNA, 21 nt, Artificial Sequence
  Synthetic
cggcaccgugcuggcggcggc

SEQ ID NO: 6098 - RNA, 22 nt, Artificial Sequence
  Synthetic
gcggcaccgugcuggcggcggc

SEQ ID NO: 6099 - RNA, 23 nt, Artificial Sequence
  Synthetic
agcggcaccgugcuggcggcggc

SEQ ID NO: 6100 - RNA, 24 nt, Artificial Sequence
  Synthetic
cagcggcaccgugcuggcggcggc

SEQ ID NO: 6101 - RNA, 18 nt, Artificial Sequence
  Synthetic
gcggccggccgcuucggc

SEQ ID NO: 6102 - RNA, 19 nt, Artificial Sequence
  Synthetic
ggcggccggccgcuucggc

SEQ ID NO: 6103 - RNA, 20 nt, Artificial Sequence
  Synthetic
uggcggccggccgcuucggc

SEQ ID NO: 6104 - RNA, 21 nt, Artificial Sequence
  Synthetic
auggcggccggccgcuucggc

SEQ ID NO: 6105 - RNA, 22 nt, Artificial Sequence
  Synthetic
cauggcggccggccgcuucggc

SEQ ID NO: 6106 - RNA, 23 nt, Artificial Sequence
  Synthetic
ccauggcggccggccgcuucggc

SEQ ID NO: 6107 - RNA, 24 nt, Artificial Sequence
  Synthetic
gccauggcggccggccgcuucggc

SEQ ID NO: 6108 - RNA, 18 nt, Artificial Sequence
  Synthetic
gugcgcacgcgcuucggc

SEQ ID NO: 6109 - RNA, 19 nt, Artificial Sequence
  Synthetic
cgugcgcacgcgcuucggc

SEQ ID NO: 6110 - RNA, 20 nt, Artificial Sequence
  Synthetic
gcgugcgcacgcgcuucggc

SEQ ID NO: 6111 - RNA, 21 nt, Artificial Sequence
  Synthetic
cgcgugcgcacgcgcuucggc

SEQ ID NO: 6112 - RNA, 22 nt, Artificial Sequence
  Synthetic
ccgcgugcgcacgcgcuucggc

SEQ ID NO: 6113 - RNA, 23 nt, Artificial Sequence
  Synthetic
accgcgugcgcacgcgcuucggc

SEQ ID NO: 6114 - RNA, 24 nt, Artificial Sequence
  Synthetic
uaccgcgugcgcacgcgcuucggc

SEQ ID NO: 6115 - RNA, 18 nt, Artificial Sequence
  Synthetic
ucgggccgcguguucggc

SEQ ID NO: 6116 - RNA, 19 nt, Artificial Sequence
  Synthetic
cucgggccgcguguucggc

SEQ ID NO: 6117 - RNA, 20 nt, Artificial Sequence
  Synthetic
ccucgggccgcguguucggc

SEQ ID NO: 6118 - RNA, 21 nt, Artificial Sequence
  Synthetic
gccucgggccgcguguucggc

SEQ ID NO: 6119 - RNA, 22 nt, Artificial Sequence
  Synthetic
ggccucgggccgcguguucggc

SEQ ID NO: 6120 - RNA, 23 nt, Artificial Sequence
  Synthetic
uggccucgggccgcguguucggc

SEQ ID NO: 6121 - RNA, 24 nt, Artificial Sequence
  Synthetic
cuggccucgggccgcguguucggc

SEQ ID NO: 6122 - RNA, 18 nt, Artificial Sequence
  Synthetic
uacucgccgcugccgggc

SEQ ID NO: 6123 - RNA, 19 nt, Artificial Sequence
  Synthetic
guacucgccgcugccgggc

SEQ ID NO: 6124 - RNA, 20 nt, Artificial Sequence
  Synthetic
uguacucgccgcugccgggc

SEQ ID NO: 6125 - RNA, 21 nt, Artificial Sequence
  Synthetic
cuguacucgccgcugccgggc

SEQ ID NO: 6126 - RNA, 22 nt, Artificial Sequence
  Synthetic
gcuguacucgccgcugccgggc

SEQ ID NO: 6127 - RNA, 23 nt, Artificial Sequence
  Synthetic
ugcuguacucgccgcugccgggc

SEQ ID NO: 6128 - RNA, 24 nt, Artificial Sequence
  Synthetic
gugcuguacucgccgcugccgggc

SEQ ID NO: 6129 - RNA, 18 nt, Artificial Sequence
  Synthetic
ccuccacgcccccggggc

SEQ ID NO: 6130 - RNA, 19 nt, Artificial Sequence
  Synthetic
cccuccacgcccccggggc

SEQ ID NO: 6131 - RNA, 20 nt, Artificial Sequence
  Synthetic
ccccuccacgcccccggggc

SEQ ID NO: 6132 - RNA, 21 nt, Artificial Sequence
  Synthetic
cccccuccacgcccccggggc

SEQ ID NO: 6133 - RNA, 22 nt, Artificial Sequence
  Synthetic
ccccccuccacgcccccggggc

SEQ ID NO: 6134 - RNA, 23 nt, Artificial Sequence
  Synthetic
gccccccuccacgcccccggggc

SEQ ID NO: 6135 - RNA, 24 nt, Artificial Sequence
  Synthetic
cgccccccuccacgcccccggggc

SEQ ID NO: 6136 - RNA, 18 nt, Artificial Sequence
  Synthetic
gccugcgcgcgcuggggc

SEQ ID NO: 6137 - RNA, 19 nt, Artificial Sequence
  Synthetic
cgccugcgcgcgcuggggc

SEQ ID NO: 6138 - RNA, 20 nt, Artificial Sequence
  Synthetic
ccgccugcgcgcgcuggggc

SEQ ID NO: 6139 - RNA, 21 nt, Artificial Sequence
  Synthetic
gccgccugcgcgcgcuggggc

SEQ ID NO: 6140 - RNA, 22 nt, Artificial Sequence
  Synthetic
cgccgccugcgcgcgcuggggc

SEQ ID NO: 6141 - RNA, 23 nt, Artificial Sequence
  Synthetic
acgccgccugcgcgcgcuggggc

SEQ ID NO: 6142 - RNA, 24 nt, Artificial Sequence
  Synthetic
cacgccgccugcgcgcgcuggggc

SEQ ID NO: 6143 - RNA, 18 nt, Artificial Sequence
  Synthetic
uguacguggcgcuggggc

SEQ ID NO: 6144 - RNA, 19 nt, Artificial Sequence
  Synthetic
guguacguggcgcuggggc

SEQ ID NO: 6145 - RNA, 20 nt, Artificial Sequence
  Synthetic
cguguacguggcgcuggggc

SEQ ID NO: 6146 - RNA, 21 nt, Artificial Sequence
  Synthetic
ccguguacguggcgcuggggc

SEQ ID NO: 6147 - RNA, 22 nt, Artificial Sequence
  Synthetic
cccguguacguggcgcuggggc

SEQ ID NO: 6148 - RNA, 23 nt, Artificial Sequence
  Synthetic
gcccguguacguggcgcuggggc

SEQ ID NO: 6149 - RNA, 24 nt, Artificial Sequence
  Synthetic
ggcccguguacguggcgcuggggc

SEQ ID NO: 6150 - RNA, 18 nt, Artificial Sequence
  Synthetic
ggccgucccggggcuggc

SEQ ID NO: 6151 - RNA, 19 nt, Artificial Sequence
  Synthetic
cggccgucccggggcuggc

SEQ ID NO: 6152 - RNA, 20 nt, Artificial Sequence
  Synthetic
gcggccgucccggggcuggc

SEQ ID NO: 6153 - RNA, 21 nt, Artificial Sequence
  Synthetic
ggcggccgucccggggcuggc

SEQ ID NO: 6154 - RNA, 22 nt, Artificial Sequence
  Synthetic
uggcggccgucccggggcuggc

SEQ ID NO: 6155 - RNA, 23 nt, Artificial Sequence
  Synthetic
cuggcggccgucccggggcuggc

SEQ ID NO: 6156 - RNA, 24 nt, Artificial Sequence
  Synthetic
ccuggcggccgucccggggcuggc

SEQ ID NO: 6157 - RNA, 18 nt, Artificial Sequence
  Synthetic
caucaccggcagcguggc

SEQ ID NO: 6158 - RNA, 19 nt, Artificial Sequence
  Synthetic
ucaucaccggcagcguggc

SEQ ID NO: 6159 - RNA, 20 nt, Artificial Sequence
  Synthetic
uucaucaccggcagcguggc

SEQ ID NO: 6160 - RNA, 21 nt, Artificial Sequence
  Synthetic
cuucaucaccggcagcguggc

SEQ ID NO: 6161 - RNA, 22 nt, Artificial Sequence
  Synthetic
ccuucaucaccggcagcguggc

SEQ ID NO: 6162 - RNA, 23 nt, Artificial Sequence
  Synthetic
uccuucaucaccggcagcguggc

SEQ ID NO: 6163 - RNA, 24 nt, Artificial Sequence
  Synthetic
cuccuucaucaccggcagcguggc

SEQ ID NO: 6164 - RNA, 18 nt, Artificial Sequence
  Synthetic
ccggcccggcccgguggc

SEQ ID NO: 6165 - RNA, 19 nt, Artificial Sequence
  Synthetic
gccggcccggcccgguggc

SEQ ID NO: 6166 - RNA, 20 nt, Artificial Sequence
  Synthetic
cgccggcccggcccgguggc

SEQ ID NO: 6167 - RNA, 21 nt, Artificial Sequence
  Synthetic
gcgccggcccggcccgguggc

SEQ ID NO: 6168 - RNA, 22 nt, Artificial Sequence
  Synthetic
cgcgccggcccggcccgguggc

SEQ ID NO: 6169 - RNA, 23 nt, Artificial Sequence
  Synthetic
gcgcgccggcccggcccgguggc

SEQ ID NO: 6170 - RNA, 24 nt, Artificial Sequence
  Synthetic
ugcgcgccggcccggcccgguggc

SEQ ID NO: 6171 - RNA, 18 nt, Artificial Sequence
  Synthetic
uuugcgcccgcgcccugc

SEQ ID NO: 6172 - RNA, 19 nt, Artificial Sequence
  Synthetic
uuuugcgcccgcgcccugc

SEQ ID NO: 6173 - RNA, 20 nt, Artificial Sequence
  Synthetic
cuuuugcgcccgcgcccugc

SEQ ID NO: 6174 - RNA, 21 nt, Artificial Sequence
  Synthetic
acuuuugcgcccgcgcccugc

SEQ ID NO: 6175 - RNA, 22 nt, Artificial Sequence
  Synthetic
gacuuuugcgcccgcgcccugc

SEQ ID NO: 6176 - RNA, 23 nt, Artificial Sequence
  Synthetic
ggacuuuugcgcccgcgcccugc

SEQ ID NO: 6177 - RNA, 24 nt, Artificial Sequence
  Synthetic
gggacuuuugcgcccgcgcccugc

SEQ ID NO: 6178 - RNA, 18 nt, Artificial Sequence
  Synthetic
uggugcucaugcgccugc

SEQ ID NO: 6179 - RNA, 19 nt, Artificial Sequence
  Synthetic
cuggugcucaugcgccugc

SEQ ID NO: 6180 - RNA, 20 nt, Artificial Sequence
  Synthetic
gcuggugcucaugcgccugc

SEQ ID NO: 6181 - RNA, 21 nt, Artificial Sequence
  Synthetic
cgcuggugcucaugcgccugc

SEQ ID NO: 6182 - RNA, 22 nt, Artificial Sequence
  Synthetic
gcgcuggugcucaugcgccugc

SEQ ID NO: 6183 - RNA, 23 nt, Artificial Sequence
  Synthetic
cgcgcuggugcucaugcgccugc

SEQ ID NO: 6184 - RNA, 24 nt, Artificial Sequence
  Synthetic
acgcgcuggugcucaugcgccugc

SEQ ID NO: 6185 - RNA, 18 nt, Artificial Sequence
  Synthetic
gccugcgcgcguggcugc

SEQ ID NO: 6186 - RNA, 19 nt, Artificial Sequence
  Synthetic
cgccugcgcgcguggcugc

SEQ ID NO: 6187 - RNA, 20 nt, Artificial Sequence
  Synthetic
ccgccugcgcgcguggcugc

SEQ ID NO: 6188 - RNA, 21 nt, Artificial Sequence
  Synthetic
cccgccugcgcgcguggcugc

SEQ ID NO: 6189 - RNA, 22 nt, Artificial Sequence
  Synthetic
ccccgccugcgcgcguggcugc

SEQ ID NO: 6190 - RNA, 23 nt, Artificial Sequence
  Synthetic
gccccgccugcgcgcguggcugc

SEQ ID NO: 6191 - RNA, 24 nt, Artificial Sequence
  Synthetic
cgccccgccugcgcgcguggcugc

SEQ ID NO: 6192 - RNA, 18 nt, Artificial Sequence
  Synthetic
ggcgcgccggacuucugc

SEQ ID NO: 6193 - RNA, 19 nt, Artificial Sequence
  Synthetic
cggcgcgccggacuucugc

SEQ ID NO: 6194 - RNA, 20 nt, Artificial Sequence
  Synthetic
ccggcgcgccggacuucugc

SEQ ID NO: 6195 - RNA, 21 nt, Artificial Sequence
  Synthetic
cccggcgcgccggacuucugc

SEQ ID NO: 6196 - RNA, 22 nt, Artificial Sequence
  Synthetic
gcccggcgcgccggacuucugc

SEQ ID NO: 6197 - RNA, 23 nt, Artificial Sequence
  Synthetic
cgcccggcgcgccggacuucugc

SEQ ID NO: 6198 - RNA, 24 nt, Artificial Sequence
  Synthetic
gcgcccggcgcgccggacuucugc

SEQ ID NO: 6199 - RNA, 18 nt, Artificial Sequence
  Synthetic
cgggggccguggaggugc

SEQ ID NO: 6200 - RNA, 19 nt, Artificial Sequence
  Synthetic
gcgggggccguggaggugc

SEQ ID NO: 6201 - RNA, 20 nt, Artificial Sequence
  Synthetic
ggcgggggccguggaggugc

SEQ ID NO: 6202 - RNA, 21 nt, Artificial Sequence
  Synthetic
cggcgggggccguggaggugc

SEQ ID NO: 6203 - RNA, 22 nt, Artificial Sequence
  Synthetic
gcggcgggggccguggaggugc

SEQ ID NO: 6204 - RNA, 23 nt, Artificial Sequence
  Synthetic
ggcggcgggggccguggaggugc

SEQ ID NO: 6205 - RNA, 24 nt, Artificial Sequence
  Synthetic
cggcggcgggggccguggaggugc

SEQ ID NO: 6206 - RNA, 18 nt, Artificial Sequence
  Synthetic
caggccugcuuccggauc

SEQ ID NO: 6207 - RNA, 19 nt, Artificial Sequence
  Synthetic
ccaggccugcuuccggauc

SEQ ID NO: 6208 - RNA, 20 nt, Artificial Sequence
  Synthetic
accaggccugcuuccggauc

SEQ ID NO: 6209 - RNA, 21 nt, Artificial Sequence
  Synthetic
gaccaggccugcuuccggauc

SEQ ID NO: 6210 - RNA, 22 nt, Artificial Sequence
  Synthetic
ggaccaggccugcuuccggauc

SEQ ID NO: 6211 - RNA, 23 nt, Artificial Sequence
  Synthetic
uggaccaggccugcuuccggauc

SEQ ID NO: 6212 - RNA, 24 nt, Artificial Sequence
  Synthetic
cuggaccaggccugcuuccggauc

SEQ ID NO: 6213 - RNA, 18 nt, Artificial Sequence
  Synthetic
gccgccugccgcgggauc

SEQ ID NO: 6214 - RNA, 19 nt, Artificial Sequence
  Synthetic
ggccgccugccgcgggauc

SEQ ID NO: 6215 - RNA, 20 nt, Artificial Sequence
  Synthetic
uggccgccugccgcgggauc

SEQ ID NO: 6216 - RNA, 21 nt, Artificial Sequence
  Synthetic
cuggccgccugccgcgggauc

SEQ ID NO: 6217 - RNA, 22 nt, Artificial Sequence
  Synthetic
ccuggccgccugccgcgggauc

SEQ ID NO: 6218 - RNA, 23 nt, Artificial Sequence
  Synthetic
gccuggccgccugccgcgggauc

SEQ ID NO: 6219 - RNA, 24 nt, Artificial Sequence
  Synthetic
ugccuggccgccugccgcgggauc

SEQ ID NO: 6220 - RNA, 18 nt, Artificial Sequence
  Synthetic
cggccgggcggcggccuc

SEQ ID NO: 6221 - RNA, 19 nt, Artificial Sequence
  Synthetic
acggccgggcggcggccuc

SEQ ID NO: 6222 - RNA, 20 nt, Artificial Sequence
  Synthetic
gacggccgggcggcggccuc

SEQ ID NO: 6223 - RNA, 21 nt, Artificial Sequence
  Synthetic
ggacggccgggcggcggccuc

SEQ ID NO: 6224 - RNA, 22 nt, Artificial Sequence
  Synthetic
uggacggccgggcggcggccuc

SEQ ID NO: 6225 - RNA, 23 nt, Artificial Sequence
  Synthetic
cuggacggccgggcggcggccuc

SEQ ID NO: 6226 - RNA, 24 nt, Artificial Sequence
  Synthetic
gcuggacggccgggcggcggccuc

SEQ ID NO: 6227 - RNA, 18 nt, Artificial Sequence
  Synthetic
gacagccgcccgggccuc

SEQ ID NO: 6228 - RNA, 19 nt, Artificial Sequence
  Synthetic
cgacagccgcccgggccuc

SEQ ID NO: 6229 - RNA, 20 nt, Artificial Sequence
  Synthetic
gcgacagccgcccgggccuc

SEQ ID NO: 6230 - RNA, 21 nt, Artificial Sequence
  Synthetic
ggcgacagccgcccgggccuc

SEQ ID NO: 6231 - RNA, 22 nt, Artificial Sequence
  Synthetic
gggcgacagccgcccgggccuc

SEQ ID NO: 6232 - RNA, 23 nt, Artificial Sequence
  Synthetic
ugggcgacagccgcccgggccuc

SEQ ID NO: 6233 - RNA, 24 nt, Artificial Sequence
  Synthetic
cugggcgacagccgcccgggccuc

SEQ ID NO: 6234 - RNA, 18 nt, Artificial Sequence
  Synthetic
ggccggcggcggggccuc

SEQ ID NO: 6235 - RNA, 19 nt, Artificial Sequence
  Synthetic
uggccggcggcggggccuc

SEQ ID NO: 6236 - RNA, 20 nt, Artificial Sequence
  Synthetic
cuggccggcggcggggccuc

SEQ ID NO: 6237 - RNA, 21 nt, Artificial Sequence
  Synthetic
ccuggccggcggcggggccuc

SEQ ID NO: 6238 - RNA, 22 nt, Artificial Sequence
  Synthetic
accuggccggcggcggggccuc

SEQ ID NO: 6239 - RNA, 23 nt, Artificial Sequence
  Synthetic
gaccuggccggcggcggggccuc

SEQ ID NO: 6240 - RNA, 24 nt, Artificial Sequence
  Synthetic
ggaccuggccggcggcggggccuc

SEQ ID NO: 6241 - RNA, 18 nt, Artificial Sequence
  Synthetic
cgcgccguggccgagcuc

SEQ ID NO: 6242 - RNA, 19 nt, Artificial Sequence
  Synthetic
gcgcgccguggccgagcuc

SEQ ID NO: 6243 - RNA, 20 nt, Artificial Sequence
  Synthetic
cgcgcgccguggccgagcuc

SEQ ID NO: 6244 - RNA, 21 nt, Artificial Sequence
  Synthetic
ccgcgcgccguggccgagcuc

SEQ ID NO: 6245 - RNA, 22 nt, Artificial Sequence
  Synthetic
cccgcgcgccguggccgagcuc

SEQ ID NO: 6246 - RNA, 23 nt, Artificial Sequence
  Synthetic
ccccgcgcgccguggccgagcuc

SEQ ID NO: 6247 - RNA, 24 nt, Artificial Sequence
  Synthetic
uccccgcgcgccguggccgagcuc

SEQ ID NO: 6248 - RNA, 18 nt, Artificial Sequence
  Synthetic
gaggccaugggguggcuc

SEQ ID NO: 6249 - RNA, 19 nt, Artificial Sequence
  Synthetic
ggaggccaugggguggcuc

SEQ ID NO: 6250 - RNA, 20 nt, Artificial Sequence
  Synthetic
cggaggccaugggguggcuc

SEQ ID NO: 6251 - RNA, 21 nt, Artificial Sequence
  Synthetic
gcggaggccaugggguggcuc

SEQ ID NO: 6252 - RNA, 22 nt, Artificial Sequence
  Synthetic
cgcggaggccaugggguggcuc

SEQ ID NO: 6253 - RNA, 23 nt, Artificial Sequence
  Synthetic
acgcggaggccaugggguggcuc

SEQ ID NO: 6254 - RNA, 24 nt, Artificial Sequence
  Synthetic
gacgcggaggccaugggguggcuc

SEQ ID NO: 6255 - RNA, 18 nt, Artificial Sequence
  Synthetic
ggcgaccuggcggccguc

SEQ ID NO: 6256 - RNA, 19 nt, Artificial Sequence
  Synthetic
cggcgaccuggcggccguc

SEQ ID NO: 6257 - RNA, 20 nt, Artificial Sequence
  Synthetic
acggcgaccuggcggccguc

SEQ ID NO: 6258 - RNA, 21 nt, Artificial Sequence
  Synthetic
gacggcgaccuggcggccguc

SEQ ID NO: 6259 - RNA, 22 nt, Artificial Sequence
  Synthetic
cgacggcgaccuggcggccguc

SEQ ID NO: 6260 - RNA, 23 nt, Artificial Sequence
  Synthetic
ucgacggcgaccuggcggccguc

SEQ ID NO: 6261 - RNA, 24 nt, Artificial Sequence
  Synthetic
uucgacggcgaccuggcggccguc

SEQ ID NO: 6262 - RNA, 18 nt, Artificial Sequence
  Synthetic
gacgacggcggcgcguuc

SEQ ID NO: 6263 - RNA, 19 nt, Artificial Sequence
  Synthetic
agacgacggcggcgcguuc

SEQ ID NO: 6264 - RNA, 20 nt, Artificial Sequence
  Synthetic
aagacgacggcggcgcguuc

SEQ ID NO: 6265 - RNA, 21 nt, Artificial Sequence
  Synthetic
gaagacgacggcggcgcguuc

SEQ ID NO: 6266 - RNA, 22 nt, Artificial Sequence
  Synthetic
cgaagacgacggcggcgcguuc

SEQ ID NO: 6267 - RNA, 23 nt, Artificial Sequence
  Synthetic
acgaagacgacggcggcgcguuc

SEQ ID NO: 6268 - RNA, 24 nt, Artificial Sequence
  Synthetic
gacgaagacgacggcggcgcguuc

SEQ ID NO: 6269 - RNA, 18 nt, Artificial Sequence
  Synthetic
ccggggccguggaguuuc

SEQ ID NO: 6270 - RNA, 19 nt, Artificial Sequence
  Synthetic
gccggggccguggaguuuc

SEQ ID NO: 6271 - RNA, 20 nt, Artificial Sequence
  Synthetic
cgccggggccguggaguuuc

SEQ ID NO: 6272 - RNA, 21 nt, Artificial Sequence
  Synthetic
ucgccggggccguggaguuuc

SEQ ID NO: 6273 - RNA, 22 nt, Artificial Sequence
  Synthetic
uucgccggggccguggaguuuc

SEQ ID NO: 6274 - RNA, 23 nt, Artificial Sequence
  Synthetic
cuucgccggggccguggaguuuc

SEQ ID NO: 6275 - RNA, 24 nt, Artificial Sequence
  Synthetic
ccuucgccggggccguggaguuuc

SEQ ID NO: 6276 - RNA, 18 nt, Artificial Sequence
  Synthetic
cgacccccgaagacgaag

SEQ ID NO: 6277 - RNA, 19 nt, Artificial Sequence
  Synthetic
gcgacccccgaagacgaag

SEQ ID NO: 6278 - RNA, 20 nt, Artificial Sequence
  Synthetic
cgcgacccccgaagacgaag

SEQ ID NO: 6279 - RNA, 21 nt, Artificial Sequence
  Synthetic
ccgcgacccccgaagacgaag

SEQ ID NO: 6280 - RNA, 22 nt, Artificial Sequence
  Synthetic
cccgcgacccccgaagacgaag

SEQ ID NO: 6281 - RNA, 23 nt, Artificial Sequence
  Synthetic
gcccgcgacccccgaagacgaag

SEQ ID NO: 6282 - RNA, 24 nt, Artificial Sequence
  Synthetic
ggcccgcgacccccgaagacgaag

SEQ ID NO: 6283 - RNA, 18 nt, Artificial Sequence
  Synthetic
ggcccgcgacccccgaag

SEQ ID NO: 6284 - RNA, 19 nt, Artificial Sequence
  Synthetic
cggcccgcgacccccgaag

SEQ ID NO: 6285 - RNA, 20 nt, Artificial Sequence
  Synthetic
gcggcccgcgacccccgaag

SEQ ID NO: 6286 - RNA, 21 nt, Artificial Sequence
  Synthetic
ggcggcccgcgacccccgaag

SEQ ID NO: 6287 - RNA, 22 nt, Artificial Sequence
  Synthetic
cggcggcccgcgacccccgaag

SEQ ID NO: 6288 - RNA, 23 nt, Artificial Sequence
  Synthetic
gcggcggcccgcgacccccgaag

SEQ ID NO: 6289 - RNA, 24 nt, Artificial Sequence
  Synthetic
ggcggcggcccgcgacccccgaag

SEQ ID NO: 6290 - RNA, 18 nt, Artificial Sequence
  Synthetic
cgauacgaccgcgcgcag

SEQ ID NO: 6291 - RNA, 19 nt, Artificial Sequence
  Synthetic
ccgauacgaccgcgcgcag

SEQ ID NO: 6292 - RNA, 20 nt, Artificial Sequence
  Synthetic
gccgauacgaccgcgcgcag

SEQ ID NO: 6293 - RNA, 21 nt, Artificial Sequence
  Synthetic
cgccgauacgaccgcgcgcag

SEQ ID NO: 6294 - RNA, 22 nt, Artificial Sequence
  Synthetic
ccgccgauacgaccgcgcgcag

SEQ ID NO: 6295 - RNA, 23 nt, Artificial Sequence
  Synthetic
gccgccgauacgaccgcgcgcag

SEQ ID NO: 6296 - RNA, 24 nt, Artificial Sequence
  Synthetic
agccgccgauacgaccgcgcgcag

SEQ ID NO: 6297 - RNA, 18 nt, Artificial Sequence
  Synthetic
ucgcgacggguacgucag

SEQ ID NO: 6298 - RNA, 19 nt, Artificial Sequence
  Synthetic
aucgcgacggguacgucag

SEQ ID NO: 6299 - RNA, 20 nt, Artificial Sequence
  Synthetic
uaucgcgacggguacgucag

SEQ ID NO: 6300 - RNA, 21 nt, Artificial Sequence
  Synthetic
cuaucgcgacggguacgucag

SEQ ID NO: 6301 - RNA, 22 nt, Artificial Sequence
  Synthetic
gcuaucgcgacggguacgucag

SEQ ID NO: 6302 - RNA, 23 nt, Artificial Sequence
  Synthetic
cgcuaucgcgacggguacgucag

SEQ ID NO: 6303 - RNA, 24 nt, Artificial Sequence
  Synthetic
gcgcuaucgcgacggguacgucag

SEQ ID NO: 6304 - RNA, 18 nt, Artificial Sequence
  Synthetic
cucuggggggcgcccgag

SEQ ID NO: 6305 - RNA, 19 nt, Artificial Sequence
  Synthetic
ccucuggggggcgcccgag

SEQ ID NO: 6306 - RNA, 20 nt, Artificial Sequence
  Synthetic
gccucuggggggcgcccgag

SEQ ID NO: 6307 - RNA, 21 nt, Artificial Sequence
  Synthetic
ggccucuggggggcgcccgag

SEQ ID NO: 6308 - RNA, 22 nt, Artificial Sequence
  Synthetic
gggccucuggggggcgcccgag

SEQ ID NO: 6309 - RNA, 23 nt, Artificial Sequence
  Synthetic
cgggccucuggggggcgcccgag

SEQ ID NO: 6310 - RNA, 24 nt, Artificial Sequence
  Synthetic
ccgggccucuggggggcgcccgag

SEQ ID NO: 6311 - RNA, 18 nt, Artificial Sequence
  Synthetic
gccgugugggcgcccgag

SEQ ID NO: 6312 - RNA, 19 nt, Artificial Sequence
  Synthetic
ggccgugugggcgcccgag

SEQ ID NO: 6313 - RNA, 20 nt, Artificial Sequence
  Synthetic
cggccgugugggcgcccgag

SEQ ID NO: 6314 - RNA, 21 nt, Artificial Sequence
  Synthetic
gcggccgugugggcgcccgag

SEQ ID NO: 6315 - RNA, 22 nt, Artificial Sequence
  Synthetic
ggcggccgugugggcgcccgag

SEQ ID NO: 6316 - RNA, 23 nt, Artificial Sequence
  Synthetic
cggcggccgugugggcgcccgag

SEQ ID NO: 6317 - RNA, 24 nt, Artificial Sequence
  Synthetic
ccggcggccgugugggcgcccgag

SEQ ID NO: 6318 - RNA, 18 nt, Artificial Sequence
  Synthetic
gcgccggacuucugcgag

SEQ ID NO: 6319 - RNA, 19 nt, Artificial Sequence
  Synthetic
cgcgccggacuucugcgag

SEQ ID NO: 6320 - RNA, 20 nt, Artificial Sequence
  Synthetic
gcgcgccggacuucugcgag

SEQ ID NO: 6321 - RNA, 21 nt, Artificial Sequence
  Synthetic
ggcgcgccggacuucugcgag

SEQ ID NO: 6322 - RNA, 22 nt, Artificial Sequence
  Synthetic
cggcgcgccggacuucugcgag

SEQ ID NO: 6323 - RNA, 23 nt, Artificial Sequence
  Synthetic
ccggcgcgccggacuucugcgag

SEQ ID NO: 6324 - RNA, 24 nt, Artificial Sequence
  Synthetic
cccggcgcgccggacuucugcgag

SEQ ID NO: 6325 - RNA, 18 nt, Artificial Sequence
  Synthetic
cagccccggcgggucgag

SEQ ID NO: 6326 - RNA, 19 nt, Artificial Sequence
  Synthetic
gcagccccggcgggucgag

SEQ ID NO: 6327 - RNA, 20 nt, Artificial Sequence
  Synthetic
ggcagccccggcgggucgag

SEQ ID NO: 6328 - RNA, 21 nt, Artificial Sequence
  Synthetic
gggcagccccggcgggucgag

SEQ ID NO: 6329 - RNA, 22 nt, Artificial Sequence
  Synthetic
cgggcagccccggcgggucgag

SEQ ID NO: 6330 - RNA, 23 nt, Artificial Sequence
  Synthetic
ccgggcagccccggcgggucgag

SEQ ID NO: 6331 - RNA, 24 nt, Artificial Sequence
  Synthetic
gccgggcagccccggcgggucgag

SEQ ID NO: 6332 - RNA, 18 nt, Artificial Sequence
  Synthetic
gacggcggcgcguucgag

SEQ ID NO: 6333 - RNA, 19 nt, Artificial Sequence
  Synthetic
cgacggcggcgcguucgag

SEQ ID NO: 6334 - RNA, 20 nt, Artificial Sequence
  Synthetic
acgacggcggcgcguucgag

SEQ ID NO: 6335 - RNA, 21 nt, Artificial Sequence
  Synthetic
gacgacggcggcgcguucgag

SEQ ID NO: 6336 - RNA, 22 nt, Artificial Sequence
  Synthetic
agacgacggcggcgcguucgag

SEQ ID NO: 6337 - RNA, 23 nt, Artificial Sequence
  Synthetic
aagacgacggcggcgcguucgag

SEQ ID NO: 6338 - RNA, 24 nt, Artificial Sequence
  Synthetic
gaagacgacggcggcgcguucgag

SEQ ID NO: 6339 - RNA, 18 nt, Artificial Sequence
  Synthetic
gaggugcugggggcggag

SEQ ID NO: 6340 - RNA, 19 nt, Artificial Sequence
  Synthetic
ggaggugcugggggcggag

SEQ ID NO: 6341 - RNA, 20 nt, Artificial Sequence
  Synthetic
uggaggugcugggggcggag

SEQ ID NO: 6342 - RNA, 21 nt, Artificial Sequence
  Synthetic
guggaggugcugggggcggag

SEQ ID NO: 6343 - RNA, 22 nt, Artificial Sequence
  Synthetic
cguggaggugcugggggcggag

SEQ ID NO: 6344 - RNA, 23 nt, Artificial Sequence
  Synthetic
ccguggaggugcugggggcggag

SEQ ID NO: 6345 - RNA, 24 nt, Artificial Sequence
  Synthetic
gccguggaggugcugggggcggag

SEQ ID NO: 6346 - RNA, 18 nt, Artificial Sequence
  Synthetic
gugcugcugcuguccacg

SEQ ID NO: 6347 - RNA, 19 nt, Artificial Sequence
  Synthetic
cgugcugcugcuguccacg

SEQ ID NO: 6348 - RNA, 20 nt, Artificial Sequence
  Synthetic
gcgugcugcugcuguccacg

SEQ ID NO: 6349 - RNA, 21 nt, Artificial Sequence
  Synthetic
ggcgugcugcugcuguccacg

SEQ ID NO: 6350 - RNA, 22 nt, Artificial Sequence
  Synthetic
gggcgugcugcugcuguccacg

SEQ ID NO: 6351 - RNA, 23 nt, Artificial Sequence
  Synthetic
agggcgugcugcugcuguccacg

SEQ ID NO: 6352 - RNA, 24 nt, Artificial Sequence
  Synthetic
cagggcgugcugcugcuguccacg

SEQ ID NO: 6353 - RNA, 18 nt, Artificial Sequence
  Synthetic
ccgcgacccccgaagacg

SEQ ID NO: 6354 - RNA, 19 nt, Artificial Sequence
  Synthetic
cccgcgacccccgaagacg

SEQ ID NO: 6355 - RNA, 20 nt, Artificial Sequence
  Synthetic
gcccgcgacccccgaagacg

SEQ ID NO: 6356 - RNA, 21 nt, Artificial Sequence
  Synthetic
ggcccgcgacccccgaagacg

SEQ ID NO: 6357 - RNA, 22 nt, Artificial Sequence
  Synthetic
cggcccgcgacccccgaagacg

SEQ ID NO: 6358 - RNA, 23 nt, Artificial Sequence
  Synthetic
gcggcccgcgacccccgaagacg

SEQ ID NO: 6359 - RNA, 24 nt, Artificial Sequence
  Synthetic
ggcggcccgcgacccccgaagacg

SEQ ID NO: 6360 - RNA, 18 nt, Artificial Sequence
  Synthetic
ccgacgccgacgacgacg

SEQ ID NO: 6361 - RNA, 19 nt, Artificial Sequence
  Synthetic
gccgacgccgacgacgacg

SEQ ID NO: 6362 - RNA, 20 nt, Artificial Sequence
  Synthetic
cgccgacgccgacgacgacg

SEQ ID NO: 6363 - RNA, 21 nt, Artificial Sequence
  Synthetic
acgccgacgccgacgacgacg

SEQ ID NO: 6364 - RNA, 22 nt, Artificial Sequence
  Synthetic
cacgccgacgccgacgacgacg

SEQ ID NO: 6365 - RNA, 23 nt, Artificial Sequence
  Synthetic
ccacgccgacgccgacgacgacg

SEQ ID NO: 6366 - RNA, 24 nt, Artificial Sequence
  Synthetic
gccacgccgacgccgacgacgacg

SEQ ID NO: 6367 - RNA, 18 nt, Artificial Sequence
  Synthetic
ugcuguacaccccggacg

SEQ ID NO: 6368 - RNA, 19 nt, Artificial Sequence
  Synthetic
cugcuguacaccccggacg

SEQ ID NO: 6369 - RNA, 20 nt, Artificial Sequence
  Synthetic
gcugcuguacaccccggacg

SEQ ID NO: 6370 - RNA, 21 nt, Artificial Sequence
  Synthetic
ggcugcuguacaccccggacg

SEQ ID NO: 6371 - RNA, 22 nt, Artificial Sequence
  Synthetic
cggcugcuguacaccccggacg

SEQ ID NO: 6372 - RNA, 23 nt, Artificial Sequence
  Synthetic
gcggcugcuguacaccccggacg

SEQ ID NO: 6373 - RNA, 24 nt, Artificial Sequence
  Synthetic
cgcggcugcuguacaccccggacg

SEQ ID NO: 6374 - RNA, 18 nt, Artificial Sequence
  Synthetic
gcgccggcgcagaugacg

SEQ ID NO: 6375 - RNA, 19 nt, Artificial Sequence
  Synthetic
ggcgccggcgcagaugacg

SEQ ID NO: 6376 - RNA, 20 nt, Artificial Sequence
  Synthetic
cggcgccggcgcagaugacg

SEQ ID NO: 6377 - RNA, 21 nt, Artificial Sequence
  Synthetic
ccggcgccggcgcagaugacg

SEQ ID NO: 6378 - RNA, 22 nt, Artificial Sequence
  Synthetic
cccggcgccggcgcagaugacg

SEQ ID NO: 6379 - RNA, 23 nt, Artificial Sequence
  Synthetic
ccccggcgccggcgcagaugacg

SEQ ID NO: 6380 - RNA, 24 nt, Artificial Sequence
  Synthetic
gccccggcgccggcgcagaugacg

SEQ ID NO: 6381 - RNA, 18 nt, Artificial Sequence
  Synthetic
guccccgcgcgaguaccg

SEQ ID NO: 6382 - RNA, 19 nt, Artificial Sequence
  Synthetic
uguccccgcgcgaguaccg

SEQ ID NO: 6383 - RNA, 20 nt, Artificial Sequence
  Synthetic
auguccccgcgcgaguaccg

SEQ ID NO: 6384 - RNA, 21 nt, Artificial Sequence
  Synthetic
cauguccccgcgcgaguaccg

SEQ ID NO: 6385 - RNA, 22 nt, Artificial Sequence
  Synthetic
ccauguccccgcgcgaguaccg

SEQ ID NO: 6386 - RNA, 23 nt, Artificial Sequence
  Synthetic
cccauguccccgcgcgaguaccg

SEQ ID NO: 6387 - RNA, 24 nt, Artificial Sequence
  Synthetic
gcccauguccccgcgcgaguaccg

SEQ ID NO: 6388 - RNA, 18 nt, Artificial Sequence
  Synthetic
ccgcgcccgccucccccg

SEQ ID NO: 6389 - RNA, 19 nt, Artificial Sequence
  Synthetic
gccgcgcccgccucccccg

SEQ ID NO: 6390 - RNA, 20 nt, Artificial Sequence
  Synthetic
cgccgcgcccgccucccccg

SEQ ID NO: 6391 - RNA, 21 nt, Artificial Sequence
  Synthetic
ccgccgcgcccgccucccccg

SEQ ID NO: 6392 - RNA, 22 nt, Artificial Sequence
  Synthetic
uccgccgcgcccgccucccccg

SEQ ID NO: 6393 - RNA, 23 nt, Artificial Sequence
  Synthetic
guccgccgcgcccgccucccccg

SEQ ID NO: 6394 - RNA, 24 nt, Artificial Sequence
  Synthetic
uguccgccgcgcccgccucccccg

SEQ ID NO: 6395 - RNA, 18 nt, Artificial Sequence
  Synthetic
ccgugucgcgccggcccg

SEQ ID NO: 6396 - RNA, 19 nt, Artificial Sequence
  Synthetic
gccgugucgcgccggcccg

SEQ ID NO: 6397 - RNA, 20 nt, Artificial Sequence
  Synthetic
ggccgugucgcgccggcccg

SEQ ID NO: 6398 - RNA, 21 nt, Artificial Sequence
  Synthetic
uggccgugucgcgccggcccg

SEQ ID NO: 6399 - RNA, 22 nt, Artificial Sequence
  Synthetic
guggccgugucgcgccggcccg

SEQ ID NO: 6400 - RNA, 23 nt, Artificial Sequence
  Synthetic
cguggccgugucgcgccggcccg

SEQ ID NO: 6401 - RNA, 24 nt, Artificial Sequence
  Synthetic
ccguggccgugucgcgccggcccg

SEQ ID NO: 6402 - RNA, 18 nt, Artificial Sequence
  Synthetic
ccugcgacuggcccgccg

SEQ ID NO: 6403 - RNA, 19 nt, Artificial Sequence
  Synthetic
gccugcgacuggcccgccg

SEQ ID NO: 6404 - RNA, 20 nt, Artificial Sequence
  Synthetic
cgccugcgacuggcccgccg

SEQ ID NO: 6405 - RNA, 21 nt, Artificial Sequence
  Synthetic
gcgccugcgacuggcccgccg

SEQ ID NO: 6406 - RNA, 22 nt, Artificial Sequence
  Synthetic
cgcgccugcgacuggcccgccg

SEQ ID NO: 6407 - RNA, 23 nt, Artificial Sequence
  Synthetic
gcgcgccugcgacuggcccgccg

SEQ ID NO: 6408 - RNA, 24 nt, Artificial Sequence
  Synthetic
ugcgcgccugcgacuggcccgccg

SEQ ID NO: 6409 - RNA, 18 nt, Artificial Sequence
  Synthetic
gggccgcaucgagcgccg

SEQ ID NO: 6410 - RNA, 19 nt, Artificial Sequence
  Synthetic
cgggccgcaucgagcgccg

SEQ ID NO: 6411 - RNA, 20 nt, Artificial Sequence
  Synthetic
gcgggccgcaucgagcgccg

SEQ ID NO: 6412 - RNA, 21 nt, Artificial Sequence
  Synthetic
cgcgggccgcaucgagcgccg

SEQ ID NO: 6413 - RNA, 22 nt, Artificial Sequence
  Synthetic
ccgcgggccgcaucgagcgccg

SEQ ID NO: 6414 - RNA, 23 nt, Artificial Sequence
  Synthetic
uccgcgggccgcaucgagcgccg

SEQ ID NO: 6415 - RNA, 24 nt, Artificial Sequence
  Synthetic
cuccgcgggccgcaucgagcgccg

SEQ ID NO: 6416 - RNA, 18 nt, Artificial Sequence
  Synthetic
gccgccuccgccgcgccg

SEQ ID NO: 6417 - RNA, 19 nt, Artificial Sequence
  Synthetic
cgccgccuccgccgcgccg

SEQ ID NO: 6418 - RNA, 20 nt, Artificial Sequence
  Synthetic
ccgccgccuccgccgcgccg

SEQ ID NO: 6419 - RNA, 21 nt, Artificial Sequence
  Synthetic
gccgccgccuccgccgcgccg

SEQ ID NO: 6420 - RNA, 22 nt, Artificial Sequence
  Synthetic
cgccgccgccuccgccgcgccg

SEQ ID NO: 6421 - RNA, 23 nt, Artificial Sequence
  Synthetic
ccgccgccgccuccgccgcgccg

SEQ ID NO: 6422 - RNA, 24 nt, Artificial Sequence
  Synthetic
gccgccgccgccuccgccgcgccg

SEQ ID NO: 6423 - RNA, 18 nt, Artificial Sequence
  Synthetic
ccgccggguacggcgccg

SEQ ID NO: 6424 - RNA, 19 nt, Artificial Sequence
  Synthetic
cccgccggguacggcgccg

SEQ ID NO: 6425 - RNA, 20 nt, Artificial Sequence
  Synthetic
gcccgccggguacggcgccg

SEQ ID NO: 6426 - RNA, 21 nt, Artificial Sequence
  Synthetic
ugcccgccggguacggcgccg

SEQ ID NO: 6427 - RNA, 22 nt, Artificial Sequence
  Synthetic
gugcccgccggguacggcgccg

SEQ ID NO: 6428 - RNA, 23 nt, Artificial Sequence
  Synthetic
ggugcccgccggguacggcgccg

SEQ ID NO: 6429 - RNA, 24 nt, Artificial Sequence
  Synthetic
cggugcccgccggguacggcgccg

SEQ ID NO: 6430 - RNA, 18 nt, Artificial Sequence
  Synthetic
gccagccccccgcggccg

SEQ ID NO: 6431 - RNA, 19 nt, Artificial Sequence
  Synthetic
cgccagccccccgcggccg

SEQ ID NO: 6432 - RNA, 20 nt, Artificial Sequence
  Synthetic
ccgccagccccccgcggccg

SEQ ID NO: 6433 - RNA, 21 nt, Artificial Sequence
  Synthetic
cccgccagccccccgcggccg

SEQ ID NO: 6434 - RNA, 22 nt, Artificial Sequence
  Synthetic
gcccgccagccccccgcggccg

SEQ ID NO: 6435 - RNA, 23 nt, Artificial Sequence
  Synthetic
ggcccgccagccccccgcggccg

SEQ ID NO: 6436 - RNA, 24 nt, Artificial Sequence
  Synthetic
cggcccgccagccccccgcggccg

SEQ ID NO: 6437 - RNA, 18 nt, Artificial Sequence
  Synthetic
cacgcgaggcgcgggccg

SEQ ID NO: 6438 - RNA, 19 nt, Artificial Sequence
  Synthetic
gcacgcgaggcgcgggccg

SEQ ID NO: 6439 - RNA, 20 nt, Artificial Sequence
  Synthetic
cgcacgcgaggcgcgggccg

SEQ ID NO: 6440 - RNA, 21 nt, Artificial Sequence
  Synthetic
acgcacgcgaggcgcgggccg

SEQ ID NO: 6441 - RNA, 22 nt, Artificial Sequence
  Synthetic
cacgcacgcgaggcgcgggccg

SEQ ID NO: 6442 - RNA, 23 nt, Artificial Sequence
  Synthetic
ccacgcacgcgaggcgcgggccg

SEQ ID NO: 6443 - RNA, 24 nt, Artificial Sequence
  Synthetic
accacgcacgcgaggcgcgggccg

SEQ ID NO: 6444 - RNA, 18 nt, Artificial Sequence
  Synthetic
gcccgguggcgcgggccg

SEQ ID NO: 6445 - RNA, 19 nt, Artificial Sequence
  Synthetic
ggcccgguggcgcgggccg

SEQ ID NO: 6446 - RNA, 20 nt, Artificial Sequence
  Synthetic
cggcccgguggcgcgggccg

SEQ ID NO: 6447 - RNA, 21 nt, Artificial Sequence
  Synthetic
ccggcccgguggcgcgggccg

SEQ ID NO: 6448 - RNA, 22 nt, Artificial Sequence
  Synthetic
cccggcccgguggcgcgggccg

SEQ ID NO: 6449 - RNA, 23 nt, Artificial Sequence
  Synthetic
gcccggcccgguggcgcgggccg

SEQ ID NO: 6450 - RNA, 24 nt, Artificial Sequence
  Synthetic
ggcccggcccgguggcgcgggccg

SEQ ID NO: 6451 - RNA, 18 nt, Artificial Sequence
  Synthetic
cccacccccacggggccg

SEQ ID NO: 6452 - RNA, 19 nt, Artificial Sequence
  Synthetic
ccccacccccacggggccg

SEQ ID NO: 6453 - RNA, 20 nt, Artificial Sequence
  Synthetic
cccccacccccacggggccg

SEQ ID NO: 6454 - RNA, 21 nt, Artificial Sequence
  Synthetic
acccccacccccacggggccg

SEQ ID NO: 6455 - RNA, 22 nt, Artificial Sequence
  Synthetic
aacccccacccccacggggccg

SEQ ID NO: 6456 - RNA, 23 nt, Artificial Sequence
  Synthetic
uaacccccacccccacggggccg

SEQ ID NO: 6457 - RNA, 24 nt, Artificial Sequence
  Synthetic
auaacccccacccccacggggccg

SEQ ID NO: 6458 - RNA, 18 nt, Artificial Sequence
  Synthetic
cggcgcugacgggggccg

SEQ ID NO: 6459 - RNA, 19 nt, Artificial Sequence
  Synthetic
gcggcgcugacgggggccg

SEQ ID NO: 6460 - RNA, 20 nt, Artificial Sequence
  Synthetic
cgcggcgcugacgggggccg

SEQ ID NO: 6461 - RNA, 21 nt, Artificial Sequence
  Synthetic
acgcggcgcugacgggggccg

SEQ ID NO: 6462 - RNA, 22 nt, Artificial Sequence
  Synthetic
aacgcggcgcugacgggggccg

SEQ ID NO: 6463 - RNA, 23 nt, Artificial Sequence
  Synthetic
gaacgcggcgcugacgggggccg

SEQ ID NO: 6464 - RNA, 24 nt, Artificial Sequence
  Synthetic
agaacgcggcgcugacgggggccg

SEQ ID NO: 6465 - RNA, 18 nt, Artificial Sequence
  Synthetic
uggcggcggcgggggccg

SEQ ID NO: 6466 - RNA, 19 nt, Artificial Sequence
  Synthetic
cuggcggcggcgggggccg

SEQ ID NO: 6467 - RNA, 20 nt, Artificial Sequence
  Synthetic
gcuggcggcggcgggggccg

SEQ ID NO: 6468 - RNA, 21 nt, Artificial Sequence
  Synthetic
ugcuggcggcggcgggggccg

SEQ ID NO: 6469 - RNA, 22 nt, Artificial Sequence
  Synthetic
gugcuggcggcggcgggggccg

SEQ ID NO: 6470 - RNA, 23 nt, Artificial Sequence
  Synthetic
cgugcuggcggcggcgggggccg

SEQ ID NO: 6471 - RNA, 24 nt, Artificial Sequence
  Synthetic
ccgugcuggcggcggcgggggccg

SEQ ID NO: 6472 - RNA, 18 nt, Artificial Sequence
  Synthetic
ggggccucgggggggccg

SEQ ID NO: 6473 - RNA, 19 nt, Artificial Sequence
  Synthetic
cggggccucgggggggccg

SEQ ID NO: 6474 - RNA, 20 nt, Artificial Sequence
  Synthetic
gcggggccucgggggggccg

SEQ ID NO: 6475 - RNA, 21 nt, Artificial Sequence
  Synthetic
ggcggggccucgggggggccg

SEQ ID NO: 6476 - RNA, 22 nt, Artificial Sequence
  Synthetic
cggcggggccucgggggggccg

SEQ ID NO: 6477 - RNA, 23 nt, Artificial Sequence
  Synthetic
gcggcggggccucgggggggccg

SEQ ID NO: 6478 - RNA, 24 nt, Artificial Sequence
  Synthetic
ggcggcggggccucgggggggccg

SEQ ID NO: 6479 - RNA, 18 nt, Artificial Sequence
  Synthetic
cugggccccgcgcugccg

SEQ ID NO: 6480 - RNA, 19 nt, Artificial Sequence
  Synthetic
ccugggccccgcgcugccg

SEQ ID NO: 6481 - RNA, 20 nt, Artificial Sequence
  Synthetic
cccugggccccgcgcugccg

SEQ ID NO: 6482 - RNA, 21 nt, Artificial Sequence
  Synthetic
gcccugggccccgcgcugccg

SEQ ID NO: 6483 - RNA, 22 nt, Artificial Sequence
  Synthetic
ggcccugggccccgcgcugccg

SEQ ID NO: 6484 - RNA, 23 nt, Artificial Sequence
  Synthetic
gggcccugggccccgcgcugccg

SEQ ID NO: 6485 - RNA, 24 nt, Artificial Sequence
  Synthetic
ggggcccugggccccgcgcugccg

SEQ ID NO: 6486 - RNA, 18 nt, Artificial Sequence
  Synthetic
cuucguccucgucguccg

SEQ ID NO: 6487 - RNA, 19 nt, Artificial Sequence
  Synthetic
ucuucguccucgucguccg

SEQ ID NO: 6488 - RNA, 20 nt, Artificial Sequence
  Synthetic
cucuucguccucgucguccg

SEQ ID NO: 6489 - RNA, 21 nt, Artificial Sequence
  Synthetic
ccucuucguccucgucguccg

SEQ ID NO: 6490 - RNA, 22 nt, Artificial Sequence
  Synthetic
uccucuucguccucgucguccg

SEQ ID NO: 6491 - RNA, 23 nt, Artificial Sequence
  Synthetic
auccucuucguccucgucguccg

SEQ ID NO: 6492 - RNA, 24 nt, Artificial Sequence
  Synthetic
cauccucuucguccucgucguccg

SEQ ID NO: 6493 - RNA, 18 nt, Artificial Sequence
  Synthetic
gccgucgggcgggguccg

SEQ ID NO: 6494 - RNA, 19 nt, Artificial Sequence
  Synthetic
ggccgucgggcgggguccg

SEQ ID NO: 6495 - RNA, 20 nt, Artificial Sequence
  Synthetic
gggccgucgggcgggguccg

SEQ ID NO: 6496 - RNA, 21 nt, Artificial Sequence
  Synthetic
cgggccgucgggcgggguccg

SEQ ID NO: 6497 - RNA, 22 nt, Artificial Sequence
  Synthetic
gcgggccgucgggcgggguccg

SEQ ID NO: 6498 - RNA, 23 nt, Artificial Sequence
  Synthetic
cgcgggccgucgggcgggguccg

SEQ ID NO: 6499 - RNA, 24 nt, Artificial Sequence
  Synthetic
gcgcgggccgucgggcgggguccg

SEQ ID NO: 6500 - RNA, 18 nt, Artificial Sequence
  Synthetic
ggccgccggagugguccg

SEQ ID NO: 6501 - RNA, 19 nt, Artificial Sequence
  Synthetic
gggccgccggagugguccg

SEQ ID NO: 6502 - RNA, 20 nt, Artificial Sequence
  Synthetic
ggggccgccggagugguccg

SEQ ID NO: 6503 - RNA, 21 nt, Artificial Sequence
  Synthetic
gggggccgccggagugguccg

SEQ ID NO: 6504 - RNA, 22 nt, Artificial Sequence
  Synthetic
ggggggccgccggagugguccg

SEQ ID NO: 6505 - RNA, 23 nt, Artificial Sequence
  Synthetic
gggggggccgccggagugguccg

SEQ ID NO: 6506 - RNA, 24 nt, Artificial Sequence
  Synthetic
cgggggggccgccggagugguccg

SEQ ID NO: 6507 - RNA, 18 nt, Artificial Sequence
  Synthetic
gcgacggguacgucagcg

SEQ ID NO: 6508 - RNA, 19 nt, Artificial Sequence
  Synthetic
cgcgacggguacgucagcg

SEQ ID NO: 6509 - RNA, 20 nt, Artificial Sequence
  Synthetic
ucgcgacggguacgucagcg

SEQ ID NO: 6510 - RNA, 21 nt, Artificial Sequence
  Synthetic
aucgcgacggguacgucagcg

SEQ ID NO: 6511 - RNA, 22 nt, Artificial Sequence
  Synthetic
uaucgcgacggguacgucagcg

SEQ ID NO: 6512 - RNA, 23 nt, Artificial Sequence
  Synthetic
cuaucgcgacggguacgucagcg

SEQ ID NO: 6513 - RNA, 24 nt, Artificial Sequence
  Synthetic
gcuaucgcgacggguacgucagcg

SEQ ID NO: 6514 - RNA, 18 nt, Artificial Sequence
  Synthetic
cuuggccacgcccccgcg

SEQ ID NO: 6515 - RNA, 19 nt, Artificial Sequence
  Synthetic
gcuuggccacgcccccgcg

SEQ ID NO: 6516 - RNA, 20 nt, Artificial Sequence
  Synthetic
ggcuuggccacgcccccgcg

SEQ ID NO: 6517 - RNA, 21 nt, Artificial Sequence
  Synthetic
gggcuuggccacgcccccgcg

SEQ ID NO: 6518 - RNA, 22 nt, Artificial Sequence
  Synthetic
cgggcuuggccacgcccccgcg

SEQ ID NO: 6519 - RNA, 23 nt, Artificial Sequence
  Synthetic
gcgggcuuggccacgcccccgcg

SEQ ID NO: 6520 - RNA, 24 nt, Artificial Sequence
  Synthetic
ggcgggcuuggccacgcccccgcg

SEQ ID NO: 6521 - RNA, 18 nt, Artificial Sequence
  Synthetic
gcgcccgccucccccgcg

SEQ ID NO: 6522 - RNA, 19 nt, Artificial Sequence
  Synthetic
cgcgcccgccucccccgcg

SEQ ID NO: 6523 - RNA, 20 nt, Artificial Sequence
  Synthetic
ccgcgcccgccucccccgcg

SEQ ID NO: 6524 - RNA, 21 nt, Artificial Sequence
  Synthetic
gccgcgcccgccucccccgcg

SEQ ID NO: 6525 - RNA, 22 nt, Artificial Sequence
  Synthetic
cgccgcgcccgccucccccgcg

SEQ ID NO: 6526 - RNA, 23 nt, Artificial Sequence
  Synthetic
ccgccgcgcccgccucccccgcg

SEQ ID NO: 6527 - RNA, 24 nt, Artificial Sequence
  Synthetic
uccgccgcgcccgccucccccgcg

SEQ ID NO: 6528 - RNA, 18 nt, Artificial Sequence
  Synthetic
ccgguggcgcgggccgcg

SEQ ID NO: 6529 - RNA, 19 nt, Artificial Sequence
  Synthetic
cccgguggcgcgggccgcg

SEQ ID NO: 6530 - RNA, 20 nt, Artificial Sequence
  Synthetic
gcccgguggcgcgggccgcg

SEQ ID NO: 6531 - RNA, 21 nt, Artificial Sequence
  Synthetic
ggcccgguggcgcgggccgcg

SEQ ID NO: 6532 - RNA, 22 nt, Artificial Sequence
  Synthetic
cggcccgguggcgcgggccgcg

SEQ ID NO: 6533 - RNA, 23 nt, Artificial Sequence
  Synthetic
ccggcccgguggcgcgggccgcg

SEQ ID NO: 6534 - RNA, 24 nt, Artificial Sequence
  Synthetic
cccggcccgguggcgcgggccgcg

SEQ ID NO: 6535 - RNA, 18 nt, Artificial Sequence
  Synthetic
gcgcugacgggggccgcg

SEQ ID NO: 6536 - RNA, 19 nt, Artificial Sequence
  Synthetic
ggcgcugacgggggccgcg

SEQ ID NO: 6537 - RNA, 20 nt, Artificial Sequence
  Synthetic
cggcgcugacgggggccgcg

SEQ ID NO: 6538 - RNA, 21 nt, Artificial Sequence
  Synthetic
gcggcgcugacgggggccgcg

SEQ ID NO: 6539 - RNA, 22 nt, Artificial Sequence
  Synthetic
cgcggcgcugacgggggccgcg

SEQ ID NO: 6540 - RNA, 23 nt, Artificial Sequence
  Synthetic
acgcggcgcugacgggggccgcg

SEQ ID NO: 6541 - RNA, 24 nt, Artificial Sequence
  Synthetic
aacgcggcgcugacgggggccgcg

SEQ ID NO: 6542 - RNA, 18 nt, Artificial Sequence
  Synthetic
agugguccgccgagcgcg

SEQ ID NO: 6543 - RNA, 19 nt, Artificial Sequence
  Synthetic
gagugguccgccgagcgcg

SEQ ID NO: 6544 - RNA, 20 nt, Artificial Sequence
  Synthetic
ggagugguccgccgagcgcg

SEQ ID NO: 6545 - RNA, 21 nt, Artificial Sequence
  Synthetic
cggagugguccgccgagcgcg

SEQ ID NO: 6546 - RNA, 22 nt, Artificial Sequence
  Synthetic
ccggagugguccgccgagcgcg

SEQ ID NO: 6547 - RNA, 23 nt, Artificial Sequence
  Synthetic
gccggagugguccgccgagcgcg

SEQ ID NO: 6548 - RNA, 24 nt, Artificial Sequence
  Synthetic
cgccggagugguccgccgagcgcg

SEQ ID NO: 6549 - RNA, 18 nt, Artificial Sequence
  Synthetic
cgccgauacgaccgcgcg

SEQ ID NO: 6550 - RNA, 19 nt, Artificial Sequence
  Synthetic
ccgccgauacgaccgcgcg

SEQ ID NO: 6551 - RNA, 20 nt, Artificial Sequence
  Synthetic
gccgccgauacgaccgcgcg

SEQ ID NO: 6552 - RNA, 21 nt, Artificial Sequence
  Synthetic
agccgccgauacgaccgcgcg

SEQ ID NO: 6553 - RNA, 22 nt, Artificial Sequence
  Synthetic
gagccgccgauacgaccgcgcg

SEQ ID NO: 6554 - RNA, 23 nt, Artificial Sequence
  Synthetic
ugagccgccgauacgaccgcgcg

SEQ ID NO: 6555 - RNA, 24 nt, Artificial Sequence
  Synthetic
augagccgccgauacgaccgcgcg

SEQ ID NO: 6556 - RNA, 18 nt, Artificial Sequence
  Synthetic
cgggggucuucgcgcgcg

SEQ ID NO: 6557 - RNA, 19 nt, Artificial Sequence
  Synthetic
ccgggggucuucgcgcgcg

SEQ ID NO: 6558 - RNA, 20 nt, Artificial Sequence
  Synthetic
cccgggggucuucgcgcgcg

SEQ ID NO: 6559 - RNA, 21 nt, Artificial Sequence
  Synthetic
gcccgggggucuucgcgcgcg

SEQ ID NO: 6560 - RNA, 22 nt, Artificial Sequence
  Synthetic
ggcccgggggucuucgcgcgcg

SEQ ID NO: 6561 - RNA, 23 nt, Artificial Sequence
  Synthetic
cggcccgggggucuucgcgcgcg

SEQ ID NO: 6562 - RNA, 24 nt, Artificial Sequence
  Synthetic
ucggcccgggggucuucgcgcgcg

SEQ ID NO: 6563 - RNA, 18 nt, Artificial Sequence
  Synthetic
gcacgccgccugcgcgcg

SEQ ID NO: 6564 - RNA, 19 nt, Artificial Sequence
  Synthetic
cgcacgccgccugcgcgcg

SEQ ID NO: 6565 - RNA, 20 nt, Artificial Sequence
  Synthetic
ucgcacgccgccugcgcgcg

SEQ ID NO: 6566 - RNA, 21 nt, Artificial Sequence
  Synthetic
cucgcacgccgccugcgcgcg

SEQ ID NO: 6567 - RNA, 22 nt, Artificial Sequence
  Synthetic
acucgcacgccgccugcgcgcg

SEQ ID NO: 6568 - RNA, 23 nt, Artificial Sequence
  Synthetic
cacucgcacgccgccugcgcgcg

SEQ ID NO: 6569 - RNA, 24 nt, Artificial Sequence
  Synthetic
ccacucgcacgccgccugcgcgcg

SEQ ID NO: 6570 - RNA, 18 nt, Artificial Sequence
  Synthetic
gccauggcgcccggcgcg

SEQ ID NO: 6571 - RNA, 19 nt, Artificial Sequence
  Synthetic
cgccauggcgcccggcgcg

SEQ ID NO: 6572 - RNA, 20 nt, Artificial Sequence
  Synthetic
acgccauggcgcccggcgcg

SEQ ID NO: 6573 - RNA, 21 nt, Artificial Sequence
  Synthetic
gacgccauggcgcccggcgcg

SEQ ID NO: 6574 - RNA, 22 nt, Artificial Sequence
  Synthetic
cgacgccauggcgcccggcgcg

SEQ ID NO: 6575 - RNA, 23 nt, Artificial Sequence
  Synthetic
ccgacgccauggcgcccggcgcg

SEQ ID NO: 6576 - RNA, 24 nt, Artificial Sequence
  Synthetic
accgacgccauggcgcccggcgcg

SEQ ID NO: 6577 - RNA, 18 nt, Artificial Sequence
  Synthetic
uggggggcgcccgaggcg

SEQ ID NO: 6578 - RNA, 19 nt, Artificial Sequence
  Synthetic
cuggggggcgcccgaggcg

SEQ ID NO: 6579 - RNA, 20 nt, Artificial Sequence
  Synthetic
ucuggggggcgcccgaggcg

SEQ ID NO: 6580 - RNA, 21 nt, Artificial Sequence
  Synthetic
cucuggggggcgcccgaggcg

SEQ ID NO: 6581 - RNA, 22 nt, Artificial Sequence
  Synthetic
ccucuggggggcgcccgaggcg

SEQ ID NO: 6582 - RNA, 23 nt, Artificial Sequence
  Synthetic
gccucuggggggcgcccgaggcg

SEQ ID NO: 6583 - RNA, 24 nt, Artificial Sequence
  Synthetic
ggccucuggggggcgcccgaggcg

SEQ ID NO: 6584 - RNA, 18 nt, Artificial Sequence
  Synthetic
gggagccguggcccggcg

SEQ ID NO: 6585 - RNA, 19 nt, Artificial Sequence
  Synthetic
ggggagccguggcccggcg

SEQ ID NO: 6586 - RNA, 20 nt, Artificial Sequence
  Synthetic
cggggagccguggcccggcg

SEQ ID NO: 6587 - RNA, 21 nt, Artificial Sequence
  Synthetic
gcggggagccguggcccggcg

SEQ ID NO: 6588 - RNA, 22 nt, Artificial Sequence
  Synthetic
agcggggagccguggcccggcg

SEQ ID NO: 6589 - RNA, 23 nt, Artificial Sequence
  Synthetic
cagcggggagccguggcccggcg

SEQ ID NO: 6590 - RNA, 24 nt, Artificial Sequence
  Synthetic
ucagcggggagccguggcccggcg

SEQ ID NO: 6591 - RNA, 18 nt, Artificial Sequence
  Synthetic
gcgaggaccuggccggcg

SEQ ID NO: 6592 - RNA, 19 nt, Artificial Sequence
  Synthetic
ggcgaggaccuggccggcg

SEQ ID NO: 6593 - RNA, 20 nt, Artificial Sequence
  Synthetic
gggcgaggaccuggccggcg

SEQ ID NO: 6594 - RNA, 21 nt, Artificial Sequence
  Synthetic
cgggcgaggaccuggccggcg

SEQ ID NO: 6595 - RNA, 22 nt, Artificial Sequence
  Synthetic
ccgggcgaggaccuggccggcg

SEQ ID NO: 6596 - RNA, 23 nt, Artificial Sequence
  Synthetic
gccgggcgaggaccuggccggcg

SEQ ID NO: 6597 - RNA, 24 nt, Artificial Sequence
  Synthetic
ugccgggcgaggaccuggccggcg

SEQ ID NO: 6598 - RNA, 18 nt, Artificial Sequence
  Synthetic
cgggccgugcugccggcg

SEQ ID NO: 6599 - RNA, 19 nt, Artificial Sequence
  Synthetic
ccgggccgugcugccggcg

SEQ ID NO: 6600 - RNA, 20 nt, Artificial Sequence
  Synthetic
gccgggccgugcugccggcg

SEQ ID NO: 6601 - RNA, 21 nt, Artificial Sequence
  Synthetic
cgccgggccgugcugccggcg

SEQ ID NO: 6602 - RNA, 22 nt, Artificial Sequence
  Synthetic
ccgccgggccgugcugccggcg

SEQ ID NO: 6603 - RNA, 23 nt, Artificial Sequence
  Synthetic
accgccgggccgugcugccggcg

SEQ ID NO: 6604 - RNA, 24 nt, Artificial Sequence
  Synthetic
uaccgccgggccgugcugccggcg

SEQ ID NO: 6605 - RNA, 18 nt, Artificial Sequence
  Synthetic
gugcgcuggccggcggcg

SEQ ID NO: 6606 - RNA, 19 nt, Artificial Sequence
  Synthetic
cgugcgcuggccggcggcg

SEQ ID NO: 6607 - RNA, 20 nt, Artificial Sequence
  Synthetic
ccgugcgcuggccggcggcg

SEQ ID NO: 6608 - RNA, 21 nt, Artificial Sequence
  Synthetic
gccgugcgcuggccggcggcg

SEQ ID NO: 6609 - RNA, 22 nt, Artificial Sequence
  Synthetic
cgccgugcgcuggccggcggcg

SEQ ID NO: 6610 - RNA, 23 nt, Artificial Sequence
  Synthetic
gcgccgugcgcuggccggcggcg

SEQ ID NO: 6611 - RNA, 24 nt, Artificial Sequence
  Synthetic
ugcgccgugcgcuggccggcggcg

SEQ ID NO: 6612 - RNA, 18 nt, Artificial Sequence
  Synthetic
cccaagccccgggcggcg

SEQ ID NO: 6613 - RNA, 19 nt, Artificial Sequence
  Synthetic
gcccaagccccgggcggcg

SEQ ID NO: 6614 - RNA, 20 nt, Artificial Sequence
  Synthetic
cgcccaagccccgggcggcg

SEQ ID NO: 6615 - RNA, 21 nt, Artificial Sequence
  Synthetic
gcgcccaagccccgggcggcg

SEQ ID NO: 6616 - RNA, 22 nt, Artificial Sequence
  Synthetic
cgcgcccaagccccgggcggcg

SEQ ID NO: 6617 - RNA, 23 nt, Artificial Sequence
  Synthetic
ccgcgcccaagccccgggcggcg

SEQ ID NO: 6618 - RNA, 24 nt, Artificial Sequence
  Synthetic
gccgcgcccaagccccgggcggcg

SEQ ID NO: 6619 - RNA, 18 nt, Artificial Sequence
  Synthetic
ggcaccgugcuggcggcg

SEQ ID NO: 6620 - RNA, 19 nt, Artificial Sequence
  Synthetic
cggcaccgugcuggcggcg

SEQ ID NO: 6621 - RNA, 20 nt, Artificial Sequence
  Synthetic
gcggcaccgugcuggcggcg

SEQ ID NO: 6622 - RNA, 21 nt, Artificial Sequence
  Synthetic
agcggcaccgugcuggcggcg

SEQ ID NO: 6623 - RNA, 22 nt, Artificial Sequence
  Synthetic
cagcggcaccgugcuggcggcg

SEQ ID NO: 6624 - RNA, 23 nt, Artificial Sequence
  Synthetic
gcagcggcaccgugcuggcggcg

SEQ ID NO: 6625 - RNA, 24 nt, Artificial Sequence
  Synthetic
cgcagcggcaccgugcuggcggcg

SEQ ID NO: 6626 - RNA, 18 nt, Artificial Sequence
  Synthetic
gcccccgacgugucggcg

SEQ ID NO: 6627 - RNA, 19 nt, Artificial Sequence
  Synthetic
cgcccccgacgugucggcg

SEQ ID NO: 6628 - RNA, 20 nt, Artificial Sequence
  Synthetic
gcgcccccgacgugucggcg

SEQ ID NO: 6629 - RNA, 21 nt, Artificial Sequence
  Synthetic
ggcgcccccgacgugucggcg

SEQ ID NO: 6630 - RNA, 22 nt, Artificial Sequence
  Synthetic
cggcgcccccgacgugucggcg

SEQ ID NO: 6631 - RNA, 23 nt, Artificial Sequence
  Synthetic
ccggcgcccccgacgugucggcg

SEQ ID NO: 6632 - RNA, 24 nt, Artificial Sequence
  Synthetic
accggcgcccccgacgugucggcg

SEQ ID NO: 6633 - RNA, 18 nt, Artificial Sequence
  Synthetic
guccccggggacguggcg

SEQ ID NO: 6634 - RNA, 19 nt, Artificial Sequence
  Synthetic
gguccccggggacguggcg

SEQ ID NO: 6635 - RNA, 20 nt, Artificial Sequence
  Synthetic
ugguccccggggacguggcg

SEQ ID NO: 6636 - RNA, 21 nt, Artificial Sequence
  Synthetic
gugguccccggggacguggcg

SEQ ID NO: 6637 - RNA, 22 nt, Artificial Sequence
  Synthetic
cgugguccccggggacguggcg

SEQ ID NO: 6638 - RNA, 23 nt, Artificial Sequence
  Synthetic
gcgugguccccggggacguggcg

SEQ ID NO: 6639 - RNA, 24 nt, Artificial Sequence
  Synthetic
cgcgugguccccggggacguggcg

SEQ ID NO: 6640 - RNA, 18 nt, Artificial Sequence
  Synthetic
cggcccguguacguggcg

SEQ ID NO: 6641 - RNA, 19 nt, Artificial Sequence
  Synthetic
gcggcccguguacguggcg

SEQ ID NO: 6642 - RNA, 20 nt, Artificial Sequence
  Synthetic
ugcggcccguguacguggcg

SEQ ID NO: 6643 - RNA, 21 nt, Artificial Sequence
  Synthetic
cugcggcccguguacguggcg

SEQ ID NO: 6644 - RNA, 22 nt, Artificial Sequence
  Synthetic
gcugcggcccguguacguggcg

SEQ ID NO: 6645 - RNA, 23 nt, Artificial Sequence
  Synthetic
cgcugcggcccguguacguggcg

SEQ ID NO: 6646 - RNA, 24 nt, Artificial Sequence
  Synthetic
ccgcugcggcccguguacguggcg

SEQ ID NO: 6647 - RNA, 18 nt, Artificial Sequence
  Synthetic
ggugcucaugcgccugcg

SEQ ID NO: 6648 - RNA, 19 nt, Artificial Sequence
  Synthetic
uggugcucaugcgccugcg

SEQ ID NO: 6649 - RNA, 20 nt, Artificial Sequence
  Synthetic
cuggugcucaugcgccugcg

SEQ ID NO: 6650 - RNA, 21 nt, Artificial Sequence
  Synthetic
gcuggugcucaugcgccugcg

SEQ ID NO: 6651 - RNA, 22 nt, Artificial Sequence
  Synthetic
cgcuggugcucaugcgccugcg

SEQ ID NO: 6652 - RNA, 23 nt, Artificial Sequence
  Synthetic
gcgcuggugcucaugcgccugcg

SEQ ID NO: 6653 - RNA, 24 nt, Artificial Sequence
  Synthetic
cgcgcuggugcucaugcgccugcg

SEQ ID NO: 6654 - RNA, 18 nt, Artificial Sequence
  Synthetic
gcgcgccggacuucugcg

SEQ ID NO: 6655 - RNA, 19 nt, Artificial Sequence
  Synthetic
ggcgcgccggacuucugcg

SEQ ID NO: 6656 - RNA, 20 nt, Artificial Sequence
  Synthetic
cggcgcgccggacuucugcg

SEQ ID NO: 6657 - RNA, 21 nt, Artificial Sequence
  Synthetic
ccggcgcgccggacuucugcg

SEQ ID NO: 6658 - RNA, 22 nt, Artificial Sequence
  Synthetic
cccggcgcgccggacuucugcg

SEQ ID NO: 6659 - RNA, 23 nt, Artificial Sequence
  Synthetic
gcccggcgcgccggacuucugcg

SEQ ID NO: 6660 - RNA, 24 nt, Artificial Sequence
  Synthetic
cgcccggcgcgccggacuucugcg

SEQ ID NO: 6661 - RNA, 18 nt, Artificial Sequence
  Synthetic
cgaucgccgcgcggugcg

SEQ ID NO: 6662 - RNA, 19 nt, Artificial Sequence
  Synthetic
ucgaucgccgcgcggugcg

SEQ ID NO: 6663 - RNA, 20 nt, Artificial Sequence
  Synthetic
cucgaucgccgcgcggugcg

SEQ ID NO: 6664 - RNA, 21 nt, Artificial Sequence
  Synthetic
ccucgaucgccgcgcggugcg

SEQ ID NO: 6665 - RNA, 22 nt, Artificial Sequence
  Synthetic
gccucgaucgccgcgcggugcg

SEQ ID NO: 6666 - RNA, 23 nt, Artificial Sequence
  Synthetic
ggccucgaucgccgcgcggugcg

SEQ ID NO: 6667 - RNA, 24 nt, Artificial Sequence
  Synthetic
uggccucgaucgccgcgcggugcg

SEQ ID NO: 6668 - RNA, 18 nt, Artificial Sequence
  Synthetic
ucggcgucaucgaccucg

SEQ ID NO: 6669 - RNA, 19 nt, Artificial Sequence
  Synthetic
aucggcgucaucgaccucg

SEQ ID NO: 6670 - RNA, 20 nt, Artificial Sequence
  Synthetic
caucggcgucaucgaccucg

SEQ ID NO: 6671 - RNA, 21 nt, Artificial Sequence
  Synthetic
ccaucggcgucaucgaccucg

SEQ ID NO: 6672 - RNA, 22 nt, Artificial Sequence
  Synthetic
gccaucggcgucaucgaccucg

SEQ ID NO: 6673 - RNA, 23 nt, Artificial Sequence
  Synthetic
ggccaucggcgucaucgaccucg

SEQ ID NO: 6674 - RNA, 24 nt, Artificial Sequence
  Synthetic
cggccaucggcgucaucgaccucg

SEQ ID NO: 6675 - RNA, 18 nt, Artificial Sequence
  Synthetic
gccggcggcggggccucg

SEQ ID NO: 6676 - RNA, 19 nt, Artificial Sequence
  Synthetic
ggccggcggcggggccucg

SEQ ID NO: 6677 - RNA, 20 nt, Artificial Sequence
  Synthetic
uggccggcggcggggccucg

SEQ ID NO: 6678 - RNA, 21 nt, Artificial Sequence
  Synthetic
cuggccggcggcggggccucg

SEQ ID NO: 6679 - RNA, 22 nt, Artificial Sequence
  Synthetic
ccuggccggcggcggggccucg

SEQ ID NO: 6680 - RNA, 23 nt, Artificial Sequence
  Synthetic
accuggccggcggcggggccucg

SEQ ID NO: 6681 - RNA, 24 nt, Artificial Sequence
  Synthetic
gaccuggccggcggcggggccucg

SEQ ID NO: 6682 - RNA, 18 nt, Artificial Sequence
  Synthetic
gcgccgugagccuggucg

SEQ ID NO: 6683 - RNA, 19 nt, Artificial Sequence
  Synthetic
cgcgccgugagccuggucg

SEQ ID NO: 6684 - RNA, 20 nt, Artificial Sequence
  Synthetic
gcgcgccgugagccuggucg

SEQ ID NO: 6685 - RNA, 21 nt, Artificial Sequence
  Synthetic
ugcgcgccgugagccuggucg

SEQ ID NO: 6686 - RNA, 22 nt, Artificial Sequence
  Synthetic
gugcgcgccgugagccuggucg

SEQ ID NO: 6687 - RNA, 23 nt, Artificial Sequence
  Synthetic
cgugcgcgccgugagccuggucg

SEQ ID NO: 6688 - RNA, 24 nt, Artificial Sequence
  Synthetic
ccgugcgcgccgugagccuggucg

SEQ ID NO: 6689 - RNA, 18 nt, Artificial Sequence
  Synthetic
ggcgccgcccgggauucg

SEQ ID NO: 6690 - RNA, 19 nt, Artificial Sequence
  Synthetic
cggcgccgcccgggauucg

SEQ ID NO: 6691 - RNA, 20 nt, Artificial Sequence
  Synthetic
ccggcgccgcccgggauucg

SEQ ID NO: 6692 - RNA, 21 nt, Artificial Sequence
  Synthetic
gccggcgccgcccgggauucg

SEQ ID NO: 6693 - RNA, 22 nt, Artificial Sequence
  Synthetic
cgccggcgccgcccgggauucg

SEQ ID NO: 6694 - RNA, 23 nt, Artificial Sequence
  Synthetic
ccgccggcgccgcccgggauucg

SEQ ID NO: 6695 - RNA, 24 nt, Artificial Sequence
  Synthetic
gccgccggcgccgcccgggauucg

SEQ ID NO: 6696 - RNA, 18 nt, Artificial Sequence
  Synthetic
cgcgggaccuggccuucg

SEQ ID NO: 6697 - RNA, 19 nt, Artificial Sequence
  Synthetic
acgcgggaccuggccuucg

SEQ ID NO: 6698 - RNA, 20 nt, Artificial Sequence
  Synthetic
cacgcgggaccuggccuucg

SEQ ID NO: 6699 - RNA, 21 nt, Artificial Sequence
  Synthetic
ccacgcgggaccuggccuucg

SEQ ID NO: 6700 - RNA, 22 nt, Artificial Sequence
  Synthetic
uccacgcgggaccuggccuucg

SEQ ID NO: 6701 - RNA, 23 nt, Artificial Sequence
  Synthetic
guccacgcgggaccuggccuucg

SEQ ID NO: 6702 - RNA, 24 nt, Artificial Sequence
  Synthetic
uguccacgcgggaccuggccuucg

SEQ ID NO: 6703 - RNA, 18 nt, Artificial Sequence
  Synthetic
acgacggcggcgcguucg

SEQ ID NO: 6704 - RNA, 19 nt, Artificial Sequence
  Synthetic
gacgacggcggcgcguucg

SEQ ID NO: 6705 - RNA, 20 nt, Artificial Sequence
  Synthetic
agacgacggcggcgcguucg

SEQ ID NO: 6706 - RNA, 21 nt, Artificial Sequence
  Synthetic
aagacgacggcggcgcguucg

SEQ ID NO: 6707 - RNA, 22 nt, Artificial Sequence
  Synthetic
gaagacgacggcggcgcguucg

SEQ ID NO: 6708 - RNA, 23 nt, Artificial Sequence
  Synthetic
cgaagacgacggcggcgcguucg

SEQ ID NO: 6709 - RNA, 24 nt, Artificial Sequence
  Synthetic
acgaagacgacggcggcgcguucg

SEQ ID NO: 6710 - RNA, 18 nt, Artificial Sequence
  Synthetic
ccucgucguccgacgagg

SEQ ID NO: 6711 - RNA, 19 nt, Artificial Sequence
  Synthetic
uccucgucguccgacgagg

SEQ ID NO: 6712 - RNA, 20 nt, Artificial Sequence
  Synthetic
guccucgucguccgacgagg

SEQ ID NO: 6713 - RNA, 21 nt, Artificial Sequence
  Synthetic
cguccucgucguccgacgagg

SEQ ID NO: 6714 - RNA, 22 nt, Artificial Sequence
  Synthetic
ucguccucgucguccgacgagg

SEQ ID NO: 6715 - RNA, 23 nt, Artificial Sequence
  Synthetic
uucguccucgucguccgacgagg

SEQ ID NO: 6716 - RNA, 24 nt, Artificial Sequence
  Synthetic
cuucguccucgucguccgacgagg

SEQ ID NO: 6717 - RNA, 18 nt, Artificial Sequence
  Synthetic
ucuggggggcgcccgagg

SEQ ID NO: 6718 - RNA, 19 nt, Artificial Sequence
  Synthetic
cucuggggggcgcccgagg

SEQ ID NO: 6719 - RNA, 20 nt, Artificial Sequence
  Synthetic
ccucuggggggcgcccgagg

SEQ ID NO: 6720 - RNA, 21 nt, Artificial Sequence
  Synthetic
gccucuggggggcgcccgagg

SEQ ID NO: 6721 - RNA, 22 nt, Artificial Sequence
  Synthetic
ggccucuggggggcgcccgagg

SEQ ID NO: 6722 - RNA, 23 nt, Artificial Sequence
  Synthetic
gggccucuggggggcgcccgagg

SEQ ID NO: 6723 - RNA, 24 nt, Artificial Sequence
  Synthetic
cgggccucuggggggcgcccgagg

SEQ ID NO: 6724 - RNA, 18 nt, Artificial Sequence
  Synthetic
cgccggacuucugcgagg

SEQ ID NO: 6725 - RNA, 19 nt, Artificial Sequence
  Synthetic
gcgccggacuucugcgagg

SEQ ID NO: 6726 - RNA, 20 nt, Artificial Sequence
  Synthetic
cgcgccggacuucugcgagg

SEQ ID NO: 6727 - RNA, 21 nt, Artificial Sequence
  Synthetic
gcgcgccggacuucugcgagg

SEQ ID NO: 6728 - RNA, 22 nt, Artificial Sequence
  Synthetic
ggcgcgccggacuucugcgagg

SEQ ID NO: 6729 - RNA, 23 nt, Artificial Sequence
  Synthetic
cggcgcgccggacuucugcgagg

SEQ ID NO: 6730 - RNA, 24 nt, Artificial Sequence
  Synthetic
ccggcgcgccggacuucugcgagg

SEQ ID NO: 6731 - RNA, 18 nt, Artificial Sequence
  Synthetic
ccacgggccgcuucacgg

SEQ ID NO: 6732 - RNA, 19 nt, Artificial Sequence
  Synthetic
gccacgggccgcuucacgg

SEQ ID NO: 6733 - RNA, 20 nt, Artificial Sequence
  Synthetic
cgccacgggccgcuucacgg

SEQ ID NO: 6734 - RNA, 21 nt, Artificial Sequence
  Synthetic
acgccacgggccgcuucacgg

SEQ ID NO: 6735 - RNA, 22 nt, Artificial Sequence
  Synthetic
gacgccacgggccgcuucacgg

SEQ ID NO: 6736 - RNA, 23 nt, Artificial Sequence
  Synthetic
cgacgccacgggccgcuucacgg

SEQ ID NO: 6737 - RNA, 24 nt, Artificial Sequence
  Synthetic
gcgacgccacgggccgcuucacgg

SEQ ID NO: 6738 - RNA, 18 nt, Artificial Sequence
  Synthetic
gcugccggcgcuggacgg

SEQ ID NO: 6739 - RNA, 19 nt, Artificial Sequence
  Synthetic
ugcugccggcgcuggacgg

SEQ ID NO: 6740 - RNA, 20 nt, Artificial Sequence
  Synthetic
gugcugccggcgcuggacgg

SEQ ID NO: 6741 - RNA, 21 nt, Artificial Sequence
  Synthetic
cgugcugccggcgcuggacgg

SEQ ID NO: 6742 - RNA, 22 nt, Artificial Sequence
  Synthetic
ccgugcugccggcgcuggacgg

SEQ ID NO: 6743 - RNA, 23 nt, Artificial Sequence
  Synthetic
gccgugcugccggcgcuggacgg

SEQ ID NO: 6744 - RNA, 24 nt, Artificial Sequence
  Synthetic
ggccgugcugccggcgcuggacgg

SEQ ID NO: 6745 - RNA, 18 nt, Artificial Sequence
  Synthetic
ucgccgccgccgcaccgg

SEQ ID NO: 6746 - RNA, 19 nt, Artificial Sequence
  Synthetic
gucgccgccgccgcaccgg

SEQ ID NO: 6747 - RNA, 20 nt, Artificial Sequence
  Synthetic
cgucgccgccgccgcaccgg

SEQ ID NO: 6748 - RNA, 21 nt, Artificial Sequence
  Synthetic
ccgucgccgccgccgcaccgg

SEQ ID NO: 6749 - RNA, 22 nt, Artificial Sequence
  Synthetic
gccgucgccgccgccgcaccgg

SEQ ID NO: 6750 - RNA, 23 nt, Artificial Sequence
  Synthetic
cgccgucgccgccgccgcaccgg

SEQ ID NO: 6751 - RNA, 24 nt, Artificial Sequence
  Synthetic
ccgccgucgccgccgccgcaccgg

SEQ ID NO: 6752 - RNA, 18 nt, Artificial Sequence
  Synthetic
ggcgccggcagcccccgg

SEQ ID NO: 6753 - RNA, 19 nt, Artificial Sequence
  Synthetic
cggcgccggcagcccccgg

SEQ ID NO: 6754 - RNA, 20 nt, Artificial Sequence
  Synthetic
gcggcgccggcagcccccgg

SEQ ID NO: 6755 - RNA, 21 nt, Artificial Sequence
  Synthetic
cgcggcgccggcagcccccgg

SEQ ID NO: 6756 - RNA, 22 nt, Artificial Sequence
  Synthetic
gcgcggcgccggcagcccccgg

SEQ ID NO: 6757 - RNA, 23 nt, Artificial Sequence
  Synthetic
agcgcggcgccggcagcccccgg

SEQ ID NO: 6758 - RNA, 24 nt, Artificial Sequence
  Synthetic
gagcgcggcgccggcagcccccgg

SEQ ID NO: 6759 - RNA, 18 nt, Artificial Sequence
  Synthetic
ccagccccccgcggccgg

SEQ ID NO: 6760 - RNA, 19 nt, Artificial Sequence
  Synthetic
gccagccccccgcggccgg

SEQ ID NO: 6761 - RNA, 20 nt, Artificial Sequence
  Synthetic
cgccagccccccgcggccgg

SEQ ID NO: 6762 - RNA, 21 nt, Artificial Sequence
  Synthetic
ccgccagccccccgcggccgg

SEQ ID NO: 6763 - RNA, 22 nt, Artificial Sequence
  Synthetic
cccgccagccccccgcggccgg

SEQ ID NO: 6764 - RNA, 23 nt, Artificial Sequence
  Synthetic
gcccgccagccccccgcggccgg

SEQ ID NO: 6765 - RNA, 24 nt, Artificial Sequence
  Synthetic
ggcccgccagccccccgcggccgg

SEQ ID NO: 6766 - RNA, 18 nt, Artificial Sequence
  Synthetic
uguacucgccgcugccgg

SEQ ID NO: 6767 - RNA, 19 nt, Artificial Sequence
  Synthetic
cuguacucgccgcugccgg

SEQ ID NO: 6768 - RNA, 20 nt, Artificial Sequence
  Synthetic
gcuguacucgccgcugccgg

SEQ ID NO: 6769 - RNA, 21 nt, Artificial Sequence
  Synthetic
ugcuguacucgccgcugccgg

SEQ ID NO: 6770 - RNA, 22 nt, Artificial Sequence
  Synthetic
gugcuguacucgccgcugccgg

SEQ ID NO: 6771 - RNA, 23 nt, Artificial Sequence
  Synthetic
ggugcuguacucgccgcugccgg

SEQ ID NO: 6772 - RNA, 24 nt, Artificial Sequence
  Synthetic
uggugcuguacucgccgcugccgg

SEQ ID NO: 6773 - RNA, 18 nt, Artificial Sequence
  Synthetic
cccgccagccccccgcgg

SEQ ID NO: 6774 - RNA, 19 nt, Artificial Sequence
  Synthetic
gcccgccagccccccgcgg

SEQ ID NO: 6775 - RNA, 20 nt, Artificial Sequence
  Synthetic
ggcccgccagccccccgcgg

SEQ ID NO: 6776 - RNA, 21 nt, Artificial Sequence
  Synthetic
cggcccgccagccccccgcgg

SEQ ID NO: 6777 - RNA, 22 nt, Artificial Sequence
  Synthetic
ccggcccgccagccccccgcgg

SEQ ID NO: 6778 - RNA, 23 nt, Artificial Sequence
  Synthetic
cccggcccgccagccccccgcgg

SEQ ID NO: 6779 - RNA, 24 nt, Artificial Sequence
  Synthetic
gcccggcccgccagccccccgcgg

SEQ ID NO: 6780 - RNA, 18 nt, Artificial Sequence
  Synthetic
uuggccacgcccccgcgg

SEQ ID NO: 6781 - RNA, 19 nt, Artificial Sequence
  Synthetic
cuuggccacgcccccgcgg

SEQ ID NO: 6782 - RNA, 20 nt, Artificial Sequence
  Synthetic
gcuuggccacgcccccgcgg

SEQ ID NO: 6783 - RNA, 21 nt, Artificial Sequence
  Synthetic
ggcuuggccacgcccccgcgg

SEQ ID NO: 6784 - RNA, 22 nt, Artificial Sequence
  Synthetic
gggcuuggccacgcccccgcgg

SEQ ID NO: 6785 - RNA, 23 nt, Artificial Sequence
  Synthetic
cgggcuuggccacgcccccgcgg

SEQ ID NO: 6786 - RNA, 24 nt, Artificial Sequence
  Synthetic
gcgggcuuggccacgcccccgcgg

SEQ ID NO: 6787 - RNA, 18 nt, Artificial Sequence
  Synthetic
gccuccgccgcgccgcgg

SEQ ID NO: 6788 - RNA, 19 nt, Artificial Sequence
  Synthetic
cgccuccgccgcgccgcgg

SEQ ID NO: 6789 - RNA, 20 nt, Artificial Sequence
  Synthetic
ccgccuccgccgcgccgcgg

SEQ ID NO: 6790 - RNA, 21 nt, Artificial Sequence
  Synthetic
gccgccuccgccgcgccgcgg

SEQ ID NO: 6791 - RNA, 22 nt, Artificial Sequence
  Synthetic
cgccgccuccgccgcgccgcgg

SEQ ID NO: 6792 - RNA, 23 nt, Artificial Sequence
  Synthetic
ccgccgccuccgccgcgccgcgg

SEQ ID NO: 6793 - RNA, 24 nt, Artificial Sequence
  Synthetic
gccgccgccuccgccgcgccgcgg

SEQ ID NO: 6794 - RNA, 18 nt, Artificial Sequence
  Synthetic
cgguggcgcgggccgcgg

SEQ ID NO: 6795 - RNA, 19 nt, Artificial Sequence
  Synthetic
ccgguggcgcgggccgcgg

SEQ ID NO: 6796 - RNA, 20 nt, Artificial Sequence
  Synthetic
cccgguggcgcgggccgcgg

SEQ ID NO: 6797 - RNA, 21 nt, Artificial Sequence
  Synthetic
gcccgguggcgcgggccgcgg

SEQ ID NO: 6798 - RNA, 22 nt, Artificial Sequence
  Synthetic
ggcccgguggcgcgggccgcgg

SEQ ID NO: 6799 - RNA, 23 nt, Artificial Sequence
  Synthetic
cggcccgguggcgcgggccgcgg

SEQ ID NO: 6800 - RNA, 24 nt, Artificial Sequence
  Synthetic
ccggcccgguggcgcgggccgcgg

SEQ ID NO: 6801 - RNA, 18 nt, Artificial Sequence
  Synthetic
ggggggcgcccgaggcgg

SEQ ID NO: 6802 - RNA, 19 nt, Artificial Sequence
  Synthetic
uggggggcgcccgaggcgg

SEQ ID NO: 6803 - RNA, 20 nt, Artificial Sequence
  Synthetic
cuggggggcgcccgaggcgg

SEQ ID NO: 6804 - RNA, 21 nt, Artificial Sequence
  Synthetic
ucuggggggcgcccgaggcgg

SEQ ID NO: 6805 - RNA, 22 nt, Artificial Sequence
  Synthetic
cucuggggggcgcccgaggcgg

SEQ ID NO: 6806 - RNA, 23 nt, Artificial Sequence
  Synthetic
ccucuggggggcgcccgaggcgg

SEQ ID NO: 6807 - RNA, 24 nt, Artificial Sequence
  Synthetic
gccucuggggggcgcccgaggcgg

SEQ ID NO: 6808 - RNA, 18 nt, Artificial Sequence
  Synthetic
cgaggaccuggccggcgg

SEQ ID NO: 6809 - RNA, 19 nt, Artificial Sequence
  Synthetic
gcgaggaccuggccggcgg

SEQ ID NO: 6810 - RNA, 20 nt, Artificial Sequence
  Synthetic
ggcgaggaccuggccggcgg

SEQ ID NO: 6811 - RNA, 21 nt, Artificial Sequence
  Synthetic
gggcgaggaccuggccggcgg

SEQ ID NO: 6812 - RNA, 22 nt, Artificial Sequence
  Synthetic
cgggcgaggaccuggccggcgg

SEQ ID NO: 6813 - RNA, 23 nt, Artificial Sequence
  Synthetic
ccgggcgaggaccuggccggcgg

SEQ ID NO: 6814 - RNA, 24 nt, Artificial Sequence
  Synthetic
gccgggcgaggaccuggccggcgg

SEQ ID NO: 6815 - RNA, 18 nt, Artificial Sequence
  Synthetic
gcaccgugcuggcggcgg

SEQ ID NO: 6816 - RNA, 19 nt, Artificial Sequence
  Synthetic
ggcaccgugcuggcggcgg

SEQ ID NO: 6817 - RNA, 20 nt, Artificial Sequence
  Synthetic
cggcaccgugcuggcggcgg

SEQ ID NO: 6818 - RNA, 21 nt, Artificial Sequence
  Synthetic
gcggcaccgugcuggcggcgg

SEQ ID NO: 6819 - RNA, 22 nt, Artificial Sequence
  Synthetic
agcggcaccgugcuggcggcgg

SEQ ID NO: 6820 - RNA, 23 nt, Artificial Sequence
  Synthetic
cagcggcaccgugcuggcggcgg

SEQ ID NO: 6821 - RNA, 24 nt, Artificial Sequence
  Synthetic
gcagcggcaccgugcuggcggcgg

SEQ ID NO: 6822 - RNA, 18 nt, Artificial Sequence
  Synthetic
ccggcggcggggccucgg

SEQ ID NO: 6823 - RNA, 19 nt, Artificial Sequence
  Synthetic
gccggcggcggggccucgg

SEQ ID NO: 6824 - RNA, 20 nt, Artificial Sequence
  Synthetic
ggccggcggcggggccucgg

SEQ ID NO: 6825 - RNA, 21 nt, Artificial Sequence
  Synthetic
uggccggcggcggggccucgg

SEQ ID NO: 6826 - RNA, 22 nt, Artificial Sequence
  Synthetic
cuggccggcggcggggccucgg

SEQ ID NO: 6827 - RNA, 23 nt, Artificial Sequence
  Synthetic
ccuggccggcggcggggccucgg

SEQ ID NO: 6828 - RNA, 24 nt, Artificial Sequence
  Synthetic
accuggccggcggcggggccucgg

SEQ ID NO: 6829 - RNA, 18 nt, Artificial Sequence
  Synthetic
cgaggcgcgggccgucgg

SEQ ID NO: 6830 - RNA, 19 nt, Artificial Sequence
  Synthetic
gcgaggcgcgggccgucgg

SEQ ID NO: 6831 - RNA, 20 nt, Artificial Sequence
  Synthetic
cgcgaggcgcgggccgucgg

SEQ ID NO: 6832 - RNA, 21 nt, Artificial Sequence
  Synthetic
acgcgaggcgcgggccgucgg

SEQ ID NO: 6833 - RNA, 22 nt, Artificial Sequence
  Synthetic
cacgcgaggcgcgggccgucgg

SEQ ID NO: 6834 - RNA, 23 nt, Artificial Sequence
  Synthetic
gcacgcgaggcgcgggccgucgg

SEQ ID NO: 6835 - RNA, 24 nt, Artificial Sequence
  Synthetic
cgcacgcgaggcgcgggccgucgg

SEQ ID NO: 6836 - RNA, 18 nt, Artificial Sequence
  Synthetic
ggcggccggccgcuucgg

SEQ ID NO: 6837 - RNA, 19 nt, Artificial Sequence
  Synthetic
uggcggccggccgcuucgg

SEQ ID NO: 6838 - RNA, 20 nt, Artificial Sequence
  Synthetic
auggcggccggccgcuucgg

SEQ ID NO: 6839 - RNA, 21 nt, Artificial Sequence
  Synthetic
cauggcggccggccgcuucgg

SEQ ID NO: 6840 - RNA, 22 nt, Artificial Sequence
  Synthetic
ccauggcggccggccgcuucgg

SEQ ID NO: 6841 - RNA, 23 nt, Artificial Sequence
  Synthetic
gccauggcggccggccgcuucgg

SEQ ID NO: 6842 - RNA, 24 nt, Artificial Sequence
  Synthetic
cgccauggcggccggccgcuucgg

SEQ ID NO: 6843 - RNA, 18 nt, Artificial Sequence
  Synthetic
ccuccgccgcgccgcggg

SEQ ID NO: 6844 - RNA, 19 nt, Artificial Sequence
  Synthetic
gccuccgccgcgccgcggg

SEQ ID NO: 6845 - RNA, 20 nt, Artificial Sequence
  Synthetic
cgccuccgccgcgccgcggg

SEQ ID NO: 6846 - RNA, 21 nt, Artificial Sequence
  Synthetic
ccgccuccgccgcgccgcggg

SEQ ID NO: 6847 - RNA, 22 nt, Artificial Sequence
  Synthetic
gccgccuccgccgcgccgcggg

SEQ ID NO: 6848 - RNA, 23 nt, Artificial Sequence
  Synthetic
cgccgccuccgccgcgccgcggg

SEQ ID NO: 6849 - RNA, 24 nt, Artificial Sequence
  Synthetic
ccgccgccuccgccgcgccgcggg

SEQ ID NO: 6850 - RNA, 18 nt, Artificial Sequence
  Synthetic
ccgggcagccccggcggg

SEQ ID NO: 6851 - RNA, 19 nt, Artificial Sequence
  Synthetic
gccgggcagccccggcggg

SEQ ID NO: 6852 - RNA, 20 nt, Artificial Sequence
  Synthetic
ggccgggcagccccggcggg

SEQ ID NO: 6853 - RNA, 21 nt, Artificial Sequence
  Synthetic
cggccgggcagccccggcggg

SEQ ID NO: 6854 - RNA, 22 nt, Artificial Sequence
  Synthetic
acggccgggcagccccggcggg

SEQ ID NO: 6855 - RNA, 23 nt, Artificial Sequence
  Synthetic
cacggccgggcagccccggcggg

SEQ ID NO: 6856 - RNA, 24 nt, Artificial Sequence
  Synthetic
ucacggccgggcagccccggcggg

SEQ ID NO: 6857 - RNA, 18 nt, Artificial Sequence
  Synthetic
gccaaccggcugugcggg

SEQ ID NO: 6858 - RNA, 19 nt, Artificial Sequence
  Synthetic
ggccaaccggcugugcggg

SEQ ID NO: 6859 - RNA, 20 nt, Artificial Sequence
  Synthetic
uggccaaccggcugugcggg

SEQ ID NO: 6860 - RNA, 21 nt, Artificial Sequence
  Synthetic
cuggccaaccggcugugcggg

SEQ ID NO: 6861 - RNA, 22 nt, Artificial Sequence
  Synthetic
ccuggccaaccggcugugcggg

SEQ ID NO: 6862 - RNA, 23 nt, Artificial Sequence
  Synthetic
cccuggccaaccggcugugcggg

SEQ ID NO: 6863 - RNA, 24 nt, Artificial Sequence
  Synthetic
gcccuggccaaccggcugugcggg

SEQ ID NO: 6864 - RNA, 18 nt, Artificial Sequence
  Synthetic
gcggcgcguucgaggggg

SEQ ID NO: 6865 - RNA, 19 nt, Artificial Sequence
  Synthetic
ggcggcgcguucgaggggg

SEQ ID NO: 6866 - RNA, 20 nt, Artificial Sequence
  Synthetic
cggcggcgcguucgaggggg

SEQ ID NO: 6867 - RNA, 21 nt, Artificial Sequence
  Synthetic
acggcggcgcguucgaggggg

SEQ ID NO: 6868 - RNA, 22 nt, Artificial Sequence
  Synthetic
gacggcggcgcguucgaggggg

SEQ ID NO: 6869 - RNA, 23 nt, Artificial Sequence
  Synthetic
cgacggcggcgcguucgaggggg

SEQ ID NO: 6870 - RNA, 24 nt, Artificial Sequence
  Synthetic
acgacggcggcgcguucgaggggg

SEQ ID NO: 6871 - RNA, 18 nt, Artificial Sequence
  Synthetic
ccguggaggugcuggggg

SEQ ID NO: 6872 - RNA, 19 nt, Artificial Sequence
  Synthetic
gccguggaggugcuggggg

SEQ ID NO: 6873 - RNA, 20 nt, Artificial Sequence
  Synthetic
ggccguggaggugcuggggg

SEQ ID NO: 6874 - RNA, 21 nt, Artificial Sequence
  Synthetic
gggccguggaggugcuggggg

SEQ ID NO: 6875 - RNA, 22 nt, Artificial Sequence
  Synthetic
ggggccguggaggugcuggggg

SEQ ID NO: 6876 - RNA, 23 nt, Artificial Sequence
  Synthetic
gggggccguggaggugcuggggg

SEQ ID NO: 6877 - RNA, 24 nt, Artificial Sequence
  Synthetic
cgggggccguggaggugcuggggg

SEQ ID NO: 6878 - RNA, 18 nt, Artificial Sequence
  Synthetic
gccguggaggugcugggg

SEQ ID NO: 6879 - RNA, 19 nt, Artificial Sequence
  Synthetic
ggccguggaggugcugggg

SEQ ID NO: 6880 - RNA, 20 nt, Artificial Sequence
  Synthetic
gggccguggaggugcugggg

SEQ ID NO: 6881 - RNA, 21 nt, Artificial Sequence
  Synthetic
ggggccguggaggugcugggg

SEQ ID NO: 6882 - RNA, 22 nt, Artificial Sequence
  Synthetic
gggggccguggaggugcugggg

SEQ ID NO: 6883 - RNA, 23 nt, Artificial Sequence
  Synthetic
cgggggccguggaggugcugggg

SEQ ID NO: 6884 - RNA, 24 nt, Artificial Sequence
  Synthetic
gcgggggccguggaggugcugggg

SEQ ID NO: 6885 - RNA, 18 nt, Artificial Sequence
  Synthetic
acugggaaggcgccuggg

SEQ ID NO: 6886 - RNA, 19 nt, Artificial Sequence
  Synthetic
gacugggaaggcgccuggg

SEQ ID NO: 6887 - RNA, 20 nt, Artificial Sequence
  Synthetic
ggacugggaaggcgccuggg

SEQ ID NO: 6888 - RNA, 21 nt, Artificial Sequence
  Synthetic
uggacugggaaggcgccuggg

SEQ ID NO: 6889 - RNA, 22 nt, Artificial Sequence
  Synthetic
guggacugggaaggcgccuggg

SEQ ID NO: 6890 - RNA, 23 nt, Artificial Sequence
  Synthetic
uguggacugggaaggcgccuggg

SEQ ID NO: 6891 - RNA, 24 nt, Artificial Sequence
  Synthetic
uuguggacugggaaggcgccuggg

SEQ ID NO: 6892 - RNA, 18 nt, Artificial Sequence
  Synthetic
ccggacacggccgccugg

SEQ ID NO: 6893 - RNA, 19 nt, Artificial Sequence
  Synthetic
gccggacacggccgccugg

SEQ ID NO: 6894 - RNA, 20 nt, Artificial Sequence
  Synthetic
ggccggacacggccgccugg

SEQ ID NO: 6895 - RNA, 21 nt, Artificial Sequence
  Synthetic
gggccggacacggccgccugg

SEQ ID NO: 6896 - RNA, 22 nt, Artificial Sequence
  Synthetic
cgggccggacacggccgccugg

SEQ ID NO: 6897 - RNA, 23 nt, Artificial Sequence
  Synthetic
gcgggccggacacggccgccugg

SEQ ID NO: 6898 - RNA, 24 nt, Artificial Sequence
  Synthetic
ugcgggccggacacggccgccugg

SEQ ID NO: 6899 - RNA, 18 nt, Artificial Sequence
  Synthetic
ggauccuggaggcgcugg

SEQ ID NO: 6900 - RNA, 19 nt, Artificial Sequence
  Synthetic
gggauccuggaggcgcugg

SEQ ID NO: 6901 - RNA, 20 nt, Artificial Sequence
  Synthetic
cgggauccuggaggcgcugg

SEQ ID NO: 6902 - RNA, 21 nt, Artificial Sequence
  Synthetic
gcgggauccuggaggcgcugg

SEQ ID NO: 6903 - RNA, 22 nt, Artificial Sequence
  Synthetic
cgcgggauccuggaggcgcugg

SEQ ID NO: 6904 - RNA, 23 nt, Artificial Sequence
  Synthetic
ccgcgggauccuggaggcgcugg

SEQ ID NO: 6905 - RNA, 24 nt, Artificial Sequence
  Synthetic
gccgcgggauccuggaggcgcugg

SEQ ID NO: 6906 - RNA, 18 nt, Artificial Sequence
  Synthetic
cggccgucccggggcugg

SEQ ID NO: 6907 - RNA, 19 nt, Artificial Sequence
  Synthetic
gcggccgucccggggcugg

SEQ ID NO: 6908 - RNA, 20 nt, Artificial Sequence
  Synthetic
ggcggccgucccggggcugg

SEQ ID NO: 6909 - RNA, 21 nt, Artificial Sequence
  Synthetic
uggcggccgucccggggcugg

SEQ ID NO: 6910 - RNA, 22 nt, Artificial Sequence
  Synthetic
cuggcggccgucccggggcugg

SEQ ID NO: 6911 - RNA, 23 nt, Artificial Sequence
  Synthetic
ccuggcggccgucccggggcugg

SEQ ID NO: 6912 - RNA, 24 nt, Artificial Sequence
  Synthetic
accuggcggccgucccggggcugg

SEQ ID NO: 6913 - RNA, 18 nt, Artificial Sequence
  Synthetic
gcuccccgcgcgccgugg

SEQ ID NO: 6914 - RNA, 19 nt, Artificial Sequence
  Synthetic
ugcuccccgcgcgccgugg

SEQ ID NO: 6915 - RNA, 20 nt, Artificial Sequence
  Synthetic
cugcuccccgcgcgccgugg

SEQ ID NO: 6916 - RNA, 21 nt, Artificial Sequence
  Synthetic
acugcuccccgcgcgccgugg

SEQ ID NO: 6917 - RNA, 22 nt, Artificial Sequence
  Synthetic
uacugcuccccgcgcgccgugg

SEQ ID NO: 6918 - RNA, 23 nt, Artificial Sequence
  Synthetic
cuacugcuccccgcgcgccgugg

SEQ ID NO: 6919 - RNA, 24 nt, Artificial Sequence
  Synthetic
ccuacugcuccccgcgcgccgugg

SEQ ID NO: 6920 - RNA, 18 nt, Artificial Sequence
  Synthetic
ccggcgccggcgcagaug

SEQ ID NO: 6921 - RNA, 19 nt, Artificial Sequence
  Synthetic
cccggcgccggcgcagaug

SEQ ID NO: 6922 - RNA, 20 nt, Artificial Sequence
  Synthetic
ccccggcgccggcgcagaug

SEQ ID NO: 6923 - RNA, 21 nt, Artificial Sequence
  Synthetic
gccccggcgccggcgcagaug

SEQ ID NO: 6924 - RNA, 22 nt, Artificial Sequence
  Synthetic
agccccggcgccggcgcagaug

SEQ ID NO: 6925 - RNA, 23 nt, Artificial Sequence
  Synthetic
gagccccggcgccggcgcagaug

SEQ ID NO: 6926 - RNA, 24 nt, Artificial Sequence
  Synthetic
ggagccccggcgccggcgcagaug

SEQ ID NO: 6927 - RNA, 18 nt, Artificial Sequence
  Synthetic
uuuugcgcccgcgcccug

SEQ ID NO: 6928 - RNA, 19 nt, Artificial Sequence
  Synthetic
cuuuugcgcccgcgcccug

SEQ ID NO: 6929 - RNA, 20 nt, Artificial Sequence
  Synthetic
acuuuugcgcccgcgcccug

SEQ ID NO: 6930 - RNA, 21 nt, Artificial Sequence
  Synthetic
gacuuuugcgcccgcgcccug

SEQ ID NO: 6931 - RNA, 22 nt, Artificial Sequence
  Synthetic
ggacuuuugcgcccgcgcccug

SEQ ID NO: 6932 - RNA, 23 nt, Artificial Sequence
  Synthetic
gggacuuuugcgcccgcgcccug

SEQ ID NO: 6933 - RNA, 24 nt, Artificial Sequence
  Synthetic
agggacuuuugcgcccgcgcccug

SEQ ID NO: 6934 - RNA, 18 nt, Artificial Sequence
  Synthetic
ccgcgggacccgcgccug

SEQ ID NO: 6935 - RNA, 19 nt, Artificial Sequence
  Synthetic
gccgcgggacccgcgccug

SEQ ID NO: 6936 - RNA, 20 nt, Artificial Sequence
  Synthetic
ugccgcgggacccgcgccug

SEQ ID NO: 6937 - RNA, 21 nt, Artificial Sequence
  Synthetic
cugccgcgggacccgcgccug

SEQ ID NO: 6938 - RNA, 22 nt, Artificial Sequence
  Synthetic
gcugccgcgggacccgcgccug

SEQ ID NO: 6939 - RNA, 23 nt, Artificial Sequence
  Synthetic
cgcugccgcgggacccgcgccug

SEQ ID NO: 6940 - RNA, 24 nt, Artificial Sequence
  Synthetic
gcgcugccgcgggacccgcgccug

SEQ ID NO: 6941 - RNA, 18 nt, Artificial Sequence
  Synthetic
gugcuguacucgccgcug

SEQ ID NO: 6942 - RNA, 19 nt, Artificial Sequence
  Synthetic
ggugcuguacucgccgcug

SEQ ID NO: 6943 - RNA, 20 nt, Artificial Sequence
  Synthetic
uggugcuguacucgccgcug

SEQ ID NO: 6944 - RNA, 21 nt, Artificial Sequence
  Synthetic
guggugcuguacucgccgcug

SEQ ID NO: 6945 - RNA, 22 nt, Artificial Sequence
  Synthetic
gguggugcuguacucgccgcug

SEQ ID NO: 6946 - RNA, 23 nt, Artificial Sequence
  Synthetic
ugguggugcuguacucgccgcug

SEQ ID NO: 6947 - RNA, 24 nt, Artificial Sequence
  Synthetic
gugguggugcuguacucgccgcug

SEQ ID NO: 6948 - RNA, 18 nt, Artificial Sequence
  Synthetic
cgcgagaacgcggcgcug

SEQ ID NO: 6949 - RNA, 19 nt, Artificial Sequence
  Synthetic
gcgcgagaacgcggcgcug

SEQ ID NO: 6950 - RNA, 20 nt, Artificial Sequence
  Synthetic
cgcgcgagaacgcggcgcug

SEQ ID NO: 6951 - RNA, 21 nt, Artificial Sequence
  Synthetic
gcgcgcgagaacgcggcgcug

SEQ ID NO: 6952 - RNA, 22 nt, Artificial Sequence
  Synthetic
ggcgcgcgagaacgcggcgcug

SEQ ID NO: 6953 - RNA, 23 nt, Artificial Sequence
  Synthetic
uggcgcgcgagaacgcggcgcug

SEQ ID NO: 6954 - RNA, 24 nt, Artificial Sequence
  Synthetic
uuggcgcgcgagaacgcggcgcug

SEQ ID NO: 6955 - RNA, 18 nt, Artificial Sequence
  Synthetic
cagccgcccgggccucug

SEQ ID NO: 6956 - RNA, 19 nt, Artificial Sequence
  Synthetic
acagccgcccgggccucug

SEQ ID NO: 6957 - RNA, 20 nt, Artificial Sequence
  Synthetic
gacagccgcccgggccucug

SEQ ID NO: 6958 - RNA, 21 nt, Artificial Sequence
  Synthetic
cgacagccgcccgggccucug

SEQ ID NO: 6959 - RNA, 22 nt, Artificial Sequence
  Synthetic
gcgacagccgcccgggccucug

SEQ ID NO: 6960 - RNA, 23 nt, Artificial Sequence
  Synthetic
ggcgacagccgcccgggccucug

SEQ ID NO: 6961 - RNA, 24 nt, Artificial Sequence
  Synthetic
gggcgacagccgcccgggccucug

SEQ ID NO: 6962 - RNA, 18 nt, Artificial Sequence
  Synthetic
gcgggggccguggaggug

SEQ ID NO: 6963 - RNA, 19 nt, Artificial Sequence
  Synthetic
ggcgggggccguggaggug

SEQ ID NO: 6964 - RNA, 20 nt, Artificial Sequence
  Synthetic
cggcgggggccguggaggug

SEQ ID NO: 6965 - RNA, 21 nt, Artificial Sequence
  Synthetic
gcggcgggggccguggaggug

SEQ ID NO: 6966 - RNA, 22 nt, Artificial Sequence
  Synthetic
ggcggcgggggccguggaggug

SEQ ID NO: 6967 - RNA, 23 nt, Artificial Sequence
  Synthetic
cggcggcgggggccguggaggug

SEQ ID NO: 6968 - RNA, 24 nt, Artificial Sequence
  Synthetic
gcggcggcgggggccguggaggug

SEQ ID NO: 6969 - RNA, 18 nt, Artificial Sequence
  Synthetic
ggcgggaaguuguggacu

SEQ ID NO: 6970 - RNA, 19 nt, Artificial Sequence
  Synthetic
cggcgggaaguuguggacu

SEQ ID NO: 6971 - RNA, 20 nt, Artificial Sequence
  Synthetic
gcggcgggaaguuguggacu

SEQ ID NO: 6972 - RNA, 21 nt, Artificial Sequence
  Synthetic
cgcggcgggaaguuguggacu

SEQ ID NO: 6973 - RNA, 22 nt, Artificial Sequence
  Synthetic
ccgcggcgggaaguuguggacu

SEQ ID NO: 6974 - RNA, 23 nt, Artificial Sequence
  Synthetic
cccgcggcgggaaguuguggacu

SEQ ID NO: 6975 - RNA, 24 nt, Artificial Sequence
  Synthetic
ccccgcggcgggaaguuguggacu

SEQ ID NO: 6976 - RNA, 18 nt, Artificial Sequence
  Synthetic
acggccgggcggcggccu

SEQ ID NO: 6977 - RNA, 19 nt, Artificial Sequence
  Synthetic
gacggccgggcggcggccu

SEQ ID NO: 6978 - RNA, 20 nt, Artificial Sequence
  Synthetic
ggacggccgggcggcggccu

SEQ ID NO: 6979 - RNA, 21 nt, Artificial Sequence
  Synthetic
uggacggccgggcggcggccu

SEQ ID NO: 6980 - RNA, 22 nt, Artificial Sequence
  Synthetic
cuggacggccgggcggcggccu

SEQ ID NO: 6981 - RNA, 23 nt, Artificial Sequence
  Synthetic
gcuggacggccgggcggcggccu

SEQ ID NO: 6982 - RNA, 24 nt, Artificial Sequence
  Synthetic
cgcuggacggccgggcggcggccu

SEQ ID NO: 6983 - RNA, 18 nt, Artificial Sequence
  Synthetic
cgacagccgcccgggccu

SEQ ID NO: 6984 - RNA, 19 nt, Artificial Sequence
  Synthetic
gcgacagccgcccgggccu

SEQ ID NO: 6985 - RNA, 20 nt, Artificial Sequence
  Synthetic
ggcgacagccgcccgggccu

SEQ ID NO: 6986 - RNA, 21 nt, Artificial Sequence
  Synthetic
gggcgacagccgcccgggccu

SEQ ID NO: 6987 - RNA, 22 nt, Artificial Sequence
  Synthetic
ugggcgacagccgcccgggccu

SEQ ID NO: 6988 - RNA, 23 nt, Artificial Sequence
  Synthetic
cugggcgacagccgcccgggccu

SEQ ID NO: 6989 - RNA, 24 nt, Artificial Sequence
  Synthetic
ccugggcgacagccgcccgggccu

SEQ ID NO: 6990 - RNA, 18 nt, Artificial Sequence
  Synthetic
uggccggcggcggggccu

SEQ ID NO: 6991 - RNA, 19 nt, Artificial Sequence
  Synthetic
cuggccggcggcggggccu

SEQ ID NO: 6992 - RNA, 20 nt, Artificial Sequence
  Synthetic
ccuggccggcggcggggccu

SEQ ID NO: 6993 - RNA, 21 nt, Artificial Sequence
  Synthetic
accuggccggcggcggggccu

SEQ ID NO: 6994 - RNA, 22 nt, Artificial Sequence
  Synthetic
gaccuggccggcggcggggccu

SEQ ID NO: 6995 - RNA, 23 nt, Artificial Sequence
  Synthetic
ggaccuggccggcggcggggccu

SEQ ID NO: 6996 - RNA, 24 nt, Artificial Sequence
  Synthetic
aggaccuggccggcggcggggccu

SEQ ID NO: 6997 - RNA, 18 nt, Artificial Sequence
  Synthetic
gggggccguggaggugcu

SEQ ID NO: 6998 - RNA, 19 nt, Artificial Sequence
  Synthetic
cgggggccguggaggugcu

SEQ ID NO: 6999 - RNA, 20 nt, Artificial Sequence
  Synthetic
gcgggggccguggaggugcu

SEQ ID NO: 7000 - RNA, 21 nt, Artificial Sequence
  Synthetic
ggcgggggccguggaggugcu

SEQ ID NO: 7001 - RNA, 22 nt, Artificial Sequence
  Synthetic
cggcgggggccguggaggugcu

SEQ ID NO: 7002 - RNA, 23 nt, Artificial Sequence
  Synthetic
gcggcgggggccguggaggugcu

SEQ ID NO: 7003 - RNA, 24 nt, Artificial Sequence
  Synthetic
ggcggcgggggccguggaggugcu

SEQ ID NO: 7004 - RNA, 18 nt, Artificial Sequence
  Synthetic
ccgggccacccccccucu

SEQ ID NO: 7005 - RNA, 19 nt, Artificial Sequence
  Synthetic
cccgggccacccccccucu

SEQ ID NO: 7006 - RNA, 20 nt, Artificial Sequence
  Synthetic
gcccgggccacccccccucu

SEQ ID NO: 7007 - RNA, 21 nt, Artificial Sequence
  Synthetic
cgcccgggccacccccccucu

SEQ ID NO: 7008 - RNA, 22 nt, Artificial Sequence
  Synthetic
ccgcccgggccacccccccucu

SEQ ID NO: 7009 - RNA, 23 nt, Artificial Sequence
  Synthetic
cccgcccgggccacccccccucu

SEQ ID NO: 7010 - RNA, 24 nt, Artificial Sequence
  Synthetic
ccccgcccgggccacccccccucu

SEQ ID NO: 7011 - RNA, 18 nt, Artificial Sequence
  Synthetic
acagccgcccgggccucu

SEQ ID NO: 7012 - RNA, 19 nt, Artificial Sequence
  Synthetic
gacagccgcccgggccucu

SEQ ID NO: 7013 - RNA, 20 nt, Artificial Sequence
  Synthetic
cgacagccgcccgggccucu

SEQ ID NO: 7014 - RNA, 21 nt, Artificial Sequence
  Synthetic
gcgacagccgcccgggccucu

SEQ ID NO: 7015 - RNA, 22 nt, Artificial Sequence
  Synthetic
ggcgacagccgcccgggccucu

SEQ ID NO: 7016 - RNA, 23 nt, Artificial Sequence
  Synthetic
gggcgacagccgcccgggccucu

SEQ ID NO: 7017 - RNA, 24 nt, Artificial Sequence
  Synthetic
ugggcgacagccgcccgggccucu

SEQ ID NO: 7018 - RNA, 18 nt, Artificial Sequence
  Synthetic
ccggcgcgccggacuucu

SEQ ID NO: 7019 - RNA, 19 nt, Artificial Sequence
  Synthetic
cccggcgcgccggacuucu

SEQ ID NO: 7020 - RNA, 20 nt, Artificial Sequence
  Synthetic
gcccggcgcgccggacuucu

SEQ ID NO: 7021 - RNA, 21 nt, Artificial Sequence
  Synthetic
cgcccggcgcgccggacuucu

SEQ ID NO: 7022 - RNA, 22 nt, Artificial Sequence
  Synthetic
gcgcccggcgcgccggacuucu

SEQ ID NO: 7023 - RNA, 23 nt, Artificial Sequence
  Synthetic
ggcgcccggcgcgccggacuucu

SEQ ID NO: 7024 - RNA, 24 nt, Artificial Sequence
  Synthetic
uggcgcccggcgcgccggacuucu

SEQ ID NO: 7025 - RNA, 18 nt, Artificial Sequence
  Synthetic
gggcgccccggcggccgu

SEQ ID NO: 7026 - RNA, 19 nt, Artificial Sequence
  Synthetic
cgggcgccccggcggccgu

SEQ ID NO: 7027 - RNA, 20 nt, Artificial Sequence
  Synthetic
ucgggcgccccggcggccgu

SEQ ID NO: 7028 - RNA, 21 nt, Artificial Sequence
  Synthetic
cucgggcgccccggcggccgu

SEQ ID NO: 7029 - RNA, 22 nt, Artificial Sequence
  Synthetic
ccucgggcgccccggcggccgu

SEQ ID NO: 7030 - RNA, 23 nt, Artificial Sequence
  Synthetic
gccucgggcgccccggcggccgu

SEQ ID NO: 7031 - RNA, 24 nt, Artificial Sequence
  Synthetic
ggccucgggcgccccggcggccgu

SEQ ID NO: 7032 - RNA, 18 nt, Artificial Sequence
  Synthetic
aagacgacggcggcgcgu

SEQ ID NO: 7033 - RNA, 19 nt, Artificial Sequence
  Synthetic
gaagacgacggcggcgcgu

SEQ ID NO: 7034 - RNA, 20 nt, Artificial Sequence
  Synthetic
cgaagacgacggcggcgcgu

SEQ ID NO: 7035 - RNA, 21 nt, Artificial Sequence
  Synthetic
acgaagacgacggcggcgcgu

SEQ ID NO: 7036 - RNA, 22 nt, Artificial Sequence
  Synthetic
gacgaagacgacggcggcgcgu

SEQ ID NO: 7037 - RNA, 23 nt, Artificial Sequence
  Synthetic
ggacgaagacgacggcggcgcgu

SEQ ID NO: 7038 - RNA, 24 nt, Artificial Sequence
  Synthetic
gggacgaagacgacggcggcgcgu

SEQ ID NO: 7039 - RNA, 18 nt, Artificial Sequence
  Synthetic
agcacgccuaccuggcgu

SEQ ID NO: 7040 - RNA, 19 nt, Artificial Sequence
  Synthetic
cagcacgccuaccuggcgu

SEQ ID NO: 7041 - RNA, 20 nt, Artificial Sequence
  Synthetic
gcagcacgccuaccuggcgu

SEQ ID NO: 7042 - RNA, 21 nt, Artificial Sequence
  Synthetic
ggcagcacgccuaccuggcgu

SEQ ID NO: 7043 - RNA, 22 nt, Artificial Sequence
  Synthetic
cggcagcacgccuaccuggcgu

SEQ ID NO: 7044 - RNA, 23 nt, Artificial Sequence
  Synthetic
gcggcagcacgccuaccuggcgu

SEQ ID NO: 7045 - RNA, 24 nt, Artificial Sequence
  Synthetic
cgcggcagcacgccuaccuggcgu

SEQ ID NO: 7046 - RNA, 18 nt, Artificial Sequence
  Synthetic
aggaggcgcgacgccggu

SEQ ID NO: 7047 - RNA, 19 nt, Artificial Sequence
  Synthetic
gaggaggcgcgacgccggu

SEQ ID NO: 7048 - RNA, 20 nt, Artificial Sequence
  Synthetic
ggaggaggcgcgacgccggu

SEQ ID NO: 7049 - RNA, 21 nt, Artificial Sequence
  Synthetic
cggaggaggcgcgacgccggu

SEQ ID NO: 7050 - RNA, 22 nt, Artificial Sequence
  Synthetic
gcggaggaggcgcgacgccggu

SEQ ID NO: 7051 - RNA, 23 nt, Artificial Sequence
  Synthetic
ggcggaggaggcgcgacgccggu

SEQ ID NO: 7052 - RNA, 24 nt, Artificial Sequence
  Synthetic
aggcggaggaggcgcgacgccggu

SEQ ID NO: 7053 - RNA, 18 nt, Artificial Sequence
  Synthetic
cccuggccaaccggcugu

SEQ ID NO: 7054 - RNA, 19 nt, Artificial Sequence
  Synthetic
gcccuggccaaccggcugu

SEQ ID NO: 7055 - RNA, 20 nt, Artificial Sequence
  Synthetic
ggcccuggccaaccggcugu

SEQ ID NO: 7056 - RNA, 21 nt, Artificial Sequence
  Synthetic
cggcccuggccaaccggcugu

SEQ ID NO: 7057 - RNA, 22 nt, Artificial Sequence
  Synthetic
gcggcccuggccaaccggcugu

SEQ ID NO: 7058 - RNA, 23 nt, Artificial Sequence
  Synthetic
ggcggcccuggccaaccggcugu

SEQ ID NO: 7059 - RNA, 24 nt, Artificial Sequence
  Synthetic
uggcggcccuggccaaccggcugu

SEQ ID NO: 7060 - RNA, 18 nt, Artificial Sequence
  Synthetic
cccccgcggcgggaaguu

SEQ ID NO: 7061 - RNA, 19 nt, Artificial Sequence
  Synthetic
gcccccgcggcgggaaguu

SEQ ID NO: 7062 - RNA, 20 nt, Artificial Sequence
  Synthetic
cgcccccgcggcgggaaguu

SEQ ID NO: 7063 - RNA, 21 nt, Artificial Sequence
  Synthetic
acgcccccgcggcgggaaguu

SEQ ID NO: 7064 - RNA, 22 nt, Artificial Sequence
  Synthetic
cacgcccccgcggcgggaaguu

SEQ ID NO: 7065 - RNA, 23 nt, Artificial Sequence
  Synthetic
ccacgcccccgcggcgggaaguu

SEQ ID NO: 7066 - RNA, 24 nt, Artificial Sequence
  Synthetic
gccacgcccccgcggcgggaaguu

SEQ ID NO: 7067 - RNA, 18 nt, Artificial Sequence
  Synthetic
gccggggccguggaguuu

SEQ ID NO: 7068 - RNA, 19 nt, Artificial Sequence
  Synthetic
cgccggggccguggaguuu

SEQ ID NO: 7069 - RNA, 20 nt, Artificial Sequence
  Synthetic
ucgccggggccguggaguuu

SEQ ID NO: 7070 - RNA, 21 nt, Artificial Sequence
  Synthetic
uucgccggggccguggaguuu

SEQ ID NO: 7071 - RNA, 22 nt, Artificial Sequence
  Synthetic
cuucgccggggccguggaguuu

SEQ ID NO: 7072 - RNA, 23 nt, Artificial Sequence
  Synthetic
ccuucgccggggccguggaguuu

SEQ ID NO: 7073 - RNA, 24 nt, Artificial Sequence
  Synthetic
gccuucgccggggccguggaguuu

SEQ ID NO: 7074 - RNA, 17 nt, Artificial Sequence
  Synthetic
ggcccggggagccgggg

SEQ ID NO: 7075 - RNA, 20 nt, Artificial Sequence
  Synthetic
uggggcccggggagccgggg

SEQ ID NO: 7076 - RNA, 17 nt, Artificial Sequence
  Synthetic
ggguccucgccgccgcc

SEQ ID NO: 7077 - RNA, 17 nt, Artificial Sequence
  Synthetic
gcuacgccauggcggcc

SEQ ID NO: 7078 - RNA, 17 nt, Artificial Sequence
  Synthetic
uccuggaggcgcuggcc

SEQ ID NO: 7079 - RNA, 17 nt, Artificial Sequence
  Synthetic
ccugccgccggcgccgc

SEQ ID NO: 7080 - RNA, 17 nt, Artificial Sequence
  Synthetic
ugcgcuaccgcgugcgc

SEQ ID NO: 7081 - RNA, 17 nt, Artificial Sequence
  Synthetic
gggccgggccgggacuc

SEQ ID NO: 7082 - RNA, 17 nt, Artificial Sequence
  Synthetic
acguggcgcuggaccag

SEQ ID NO: 7083 - RNA, 17 nt, Artificial Sequence
  Synthetic
gauacgaccgcgcgcag

SEQ ID NO: 7084 - RNA, 17 nt, Artificial Sequence
  Synthetic
aggugcugggggcggag

SEQ ID NO: 7085 - RNA, 17 nt, Artificial Sequence
  Synthetic
ccggccgcgacgccacg

SEQ ID NO: 7086 - RNA, 17 nt, Artificial Sequence
  Synthetic
ccggagggacccgcggg

SEQ ID NO: 7087 - RNA, 20 nt, Artificial Sequence
  Synthetic
cggggguccucgccgccgcc

SEQ ID NO: 7088 - RNA, 20 nt, Artificial Sequence
  Synthetic
ugggcuacgccauggcggcc

SEQ ID NO: 7089 - RNA, 20 nt, Artificial Sequence
  Synthetic
ggauccuggaggcgcuggcc

SEQ ID NO: 7090 - RNA, 20 nt, Artificial Sequence
  Synthetic
ggcccugccgccggcgccgc

SEQ ID NO: 7091 - RNA, 20 nt, Artificial Sequence
  Synthetic
acgugcgcuaccgcgugcgc

SEQ ID NO: 7092 - RNA, 20 nt, Artificial Sequence
  Synthetic
gccgggccgggccgggacuc

SEQ ID NO: 7093 - RNA, 20 nt, Artificial Sequence
  Synthetic
gggacguggcgcuggaccag

SEQ ID NO: 7094 - RNA, 20 nt, Artificial Sequence
  Synthetic
gccgauacgaccgcgcgcag

SEQ ID NO: 7095 - RNA, 20 nt, Artificial Sequence
  Synthetic
uggaggugcugggggcggag

SEQ ID NO: 7096 - RNA, 20 nt, Artificial Sequence
  Synthetic
uggccggccgcgacgccacg

SEQ ID NO: 7097 - RNA, 20 nt, Artificial Sequence
  Synthetic
cggccggagggacccgcggg

SEQ ID NO: 7098 - RNA, 17 nt, Artificial Sequence
  Synthetic
gccauaaucggcgcgca

SEQ ID NO: 7099 - RNA, 17 nt, Artificial Sequence
  Synthetic
gcgauggcggacgagga

SEQ ID NO: 7100 - RNA, 17 nt, Artificial Sequence
  Synthetic
gacgagccugccgcgga

SEQ ID NO: 7101 - RNA, 17 nt, Artificial Sequence
  Synthetic
gaucccgucgccccccc

SEQ ID NO: 7102 - RNA, 17 nt, Artificial Sequence
  Synthetic
gagacgaccggcggccc

SEQ ID NO: 7103 - RNA, 17 nt, Artificial Sequence
  Synthetic
gcuggauccggagaucc

SEQ ID NO: 7104 - RNA, 17 nt, Artificial Sequence
  Synthetic
ggacgggggacgucucc

SEQ ID NO: 7105 - RNA, 17 nt, Artificial Sequence
  Synthetic
ggcggcgguccgucggc

SEQ ID NO: 7106 - RNA, 17 nt, Artificial Sequence
  Synthetic
gguccgucggcuggauc

SEQ ID NO: 7107 - RNA, 17 nt, Artificial Sequence
  Synthetic
ggcgacgguccggguuc

SEQ ID NO: 7108 - RNA, 17 nt, Artificial Sequence
  Synthetic
gauggcggacgaggacg

SEQ ID NO: 7109 - RNA, 17 nt, Artificial Sequence
  Synthetic
ggucgcgauggcggacg

SEQ ID NO: 7110 - RNA, 17 nt, Artificial Sequence
  Synthetic
gcucgccuucuccgccg

SEQ ID NO: 7111 - RNA, 17 nt, Artificial Sequence
  Synthetic
gggacgucuccgggccg

SEQ ID NO: 7112 - RNA, 17 nt, Artificial Sequence
  Synthetic
gacgacgcagggccgcg

SEQ ID NO: 7113 - RNA, 17 nt, Artificial Sequence
  Synthetic
gcgcgccgauuauggcg

SEQ ID NO: 7114 - RNA, 17 nt, Artificial Sequence
  Synthetic
ggccucguccaccaucg

SEQ ID NO: 7115 - RNA, 17 nt, Artificial Sequence
  Synthetic
gcgacgguccggguucg

SEQ ID NO: 7116 - RNA, 17 nt, Artificial Sequence
  Synthetic
ggguucggguggcacgg

SEQ ID NO: 7117 - RNA, 17 nt, Artificial Sequence
  Synthetic
gcggcggagacgaccgg

SEQ ID NO: 7118 - RNA, 17 nt, Artificial Sequence
  Synthetic
gcgccgucgcgcuccgg

SEQ ID NO: 7119 - RNA, 17 nt, Artificial Sequence
  Synthetic
gaacccgggccgcgcgg

SEQ ID NO: 7120 - RNA, 17 nt, Artificial Sequence
  Synthetic
gccgucgcgcuccgggg

SEQ ID NO: 7121 - RNA, 17 nt, Artificial Sequence
  Synthetic
guucuccucgccauaau

SEQ ID NO: 7122 - RNA, 17 nt, Artificial Sequence
  Synthetic
ggccgccucgucggcau

SEQ ID NO: 7123 - RNA, 17 nt, Artificial Sequence
  Synthetic
guccgccaucgcgaccu

SEQ ID NO: 7124 - RNA, 17 nt, Artificial Sequence
  Synthetic
ggugggcggcgguccgu

SEQ ID NO: 7125 - RNA, 17 nt, Artificial Sequence
  Synthetic
gguucggguggcacggu

SEQ ID NO: 7126 - RNA, 17 nt, Artificial Sequence
  Synthetic
gccgcgcggcccggguu

SEQ ID NO: 7127 - RNA, 17 nt, Artificial Sequence
  Synthetic
gggcgacgguccggguu

SEQ ID NO: 7128 - RNA, 20 nt, Artificial Sequence
  Synthetic
gggcgacgggaucgugcgaa

SEQ ID NO: 7129 - RNA, 20 nt, Artificial Sequence
  Synthetic
ggaucuccggauccagccga

SEQ ID NO: 7130 - RNA, 20 nt, Artificial Sequence
  Synthetic
guccgcggcaggcucgucga

SEQ ID NO: 7131 - RNA, 20 nt, Artificial Sequence
  Synthetic
gucgcgauggcggacgagga

SEQ ID NO: 7132 - RNA, 20 nt, Artificial Sequence
  Synthetic
gucgacgagccugccgcgga

SEQ ID NO: 7133 - RNA, 20 nt, Artificial Sequence
  Synthetic
gcggagacgaccggcggccc

SEQ ID NO: 7134 - RNA, 20 nt, Artificial Sequence
  Synthetic
gagacgacgccguccgcggc

SEQ ID NO: 7135 - RNA, 20 nt, Artificial Sequence
  Synthetic
guucggguggcacggugggc

SEQ ID NO: 7136 - RNA, 20 nt, Artificial Sequence
  Synthetic
gucggcuggauccggagauc

SEQ ID NO: 7137 - RNA, 20 nt, Artificial Sequence
  Synthetic
ggcgguccgucggcuggauc

SEQ ID NO: 7138 - RNA, 20 nt, Artificial Sequence
  Synthetic
gccucgucuucguucuccuc

SEQ ID NO: 7139 - RNA, 20 nt, Artificial Sequence
  Synthetic
gaccggcggccccggaucuc

SEQ ID NO: 7140 - RNA, 20 nt, Artificial Sequence
  Synthetic
gacgaggcggccccggcguc

SEQ ID NO: 7141 - RNA, 20 nt, Artificial Sequence
  Synthetic
gacggccuccccggacgccg

SEQ ID NO: 7142 - RNA, 20 nt, Artificial Sequence
  Synthetic
ggccgucgacgagccugccg

SEQ ID NO: 7143 - RNA, 20 nt, Artificial Sequence
  Synthetic
gacgacgacgcagggccgcg

SEQ ID NO: 7144 - RNA, 20 nt, Artificial Sequence
  Synthetic
gggacgucuccgggccgcgg

SEQ ID NO: 7145 - RNA, 20 nt, Artificial Sequence
  Synthetic
gccauaaucggcgcgcaugg

SEQ ID NO: 7146 - RNA, 20 nt, Artificial Sequence
  Synthetic
gucguucuccucgccauaau

SEQ ID NO: 7147 - RNA, 20 nt, Artificial Sequence
  Synthetic
ggacgccggggccgccucgu

SEQ ID NO: 7148 - RNA, 20 nt, Artificial Sequence
  Synthetic
gcggggcgacgguccggguu

SEQ ID NO: 7149 - RNA, 17 nt, Artificial Sequence
  Synthetic
cgacgggaucgugcgaa

SEQ ID NO: 7150 - RNA, 17 nt, Artificial Sequence
  Synthetic
acgacgacgacgacgca

SEQ ID NO: 7151 - RNA, 17 nt, Artificial Sequence
  Synthetic
cccggguucggguggca

SEQ ID NO: 7152 - RNA, 17 nt, Artificial Sequence
  Synthetic
ucuccggauccagccga

SEQ ID NO: 7153 - RNA, 17 nt, Artificial Sequence
  Synthetic
ccccccccggagcgcga

SEQ ID NO: 7154 - RNA, 17 nt, Artificial Sequence
  Synthetic
cggggccgaggucgcga

SEQ ID NO: 7155 - RNA, 17 nt, Artificial Sequence
  Synthetic
cgcuccggggggggcga

SEQ ID NO: 7156 - RNA, 17 nt, Artificial Sequence
  Synthetic
cgcggcaggcucgucga

SEQ ID NO: 7157 - RNA, 17 nt, Artificial Sequence
  Synthetic
uaaucggcgcgcaugga

SEQ ID NO: 7158 - RNA, 17 nt, Artificial Sequence
  Synthetic
uccaugcgcgccgauua

SEQ ID NO: 7159 - RNA, 17 nt, Artificial Sequence
  Synthetic
accgugccacccgaacc

SEQ ID NO: 7160 - RNA, 17 nt, Artificial Sequence
  Synthetic
ugccgacgaggcggccc

SEQ ID NO: 7161 - RNA, 17 nt, Artificial Sequence
  Synthetic
cucgucgacggccuccc

SEQ ID NO: 7162 - RNA, 17 nt, Artificial Sequence
  Synthetic
cggcggagaaggcgagc

SEQ ID NO: 7163 - RNA, 17 nt, Artificial Sequence
  Synthetic
cgacgacgcagggccgc

SEQ ID NO: 7164 - RNA, 17 nt, Artificial Sequence
  Synthetic
cggagauccggggccgc

SEQ ID NO: 7165 - RNA, 17 nt, Artificial Sequence
  Synthetic
acgacgccguccgcggc

SEQ ID NO: 7166 - RNA, 17 nt, Artificial Sequence
  Synthetic
ucgucuucguucuccuc

SEQ ID NO: 7167 - RNA, 17 nt, Artificial Sequence
  Synthetic
ugcgcgccgucgcgcuc

SEQ ID NO: 7168 - RNA, 17 nt, Artificial Sequence
  Synthetic
aggacgggggacgucuc

SEQ ID NO: 7169 - RNA, 17 nt, Artificial Sequence
  Synthetic
cggcgcgcaagaagaag

SEQ ID NO: 7170 - RNA, 17 nt, Artificial Sequence
  Synthetic
aaucggcgcgcauggag

SEQ ID NO: 7171 - RNA, 17 nt, Artificial Sequence
  Synthetic
cgaugccgaugccgacg

SEQ ID NO: 7172 - RNA, 17 nt, Artificial Sequence
  Synthetic
ucgcgaccucggccccg

SEQ ID NO: 7173 - RNA, 17 nt, Artificial Sequence
  Synthetic
acggcgucgucucgccg

SEQ ID NO: 7174 - RNA, 17 nt, Artificial Sequence
  Synthetic
acgacgacgcagggccg

SEQ ID NO: 7175 - RNA, 17 nt, Artificial Sequence
  Synthetic
cgucgacgagccugccg

SEQ ID NO: 7176 - RNA, 17 nt, Artificial Sequence
  Synthetic
cgagacgacgccguccg

SEQ ID NO: 7177 - RNA, 17 nt, Artificial Sequence
  Synthetic
cgcauggaggggguccg

SEQ ID NO: 7178 - RNA, 17 nt, Artificial Sequence
  Synthetic
accgucgccccgccgcg

SEQ ID NO: 7179 - RNA, 17 nt, Artificial Sequence
  Synthetic
ugccgaugccgacgagg

SEQ ID NO: 7180 - RNA, 17 nt, Artificial Sequence
  Synthetic
aucggcgcgcauggagg

SEQ ID NO: 7181 - RNA, 17 nt, Artificial Sequence
  Synthetic
acgucuccgggccgcgg

SEQ ID NO: 7182 - RNA, 17 nt, Artificial Sequence
  Synthetic
cgccgucgcgcuccggg

SEQ ID NO: 7183 - RNA, 17 nt, Artificial Sequence
  Synthetic
acgguccggguucgggg

SEQ ID NO: 7184 - RNA, 17 nt, Artificial Sequence
  Synthetic
auaaucggcgcgcaugg

SEQ ID NO: 7185 - RNA, 17 nt, Artificial Sequence
  Synthetic
cucgucggcaucggcau

SEQ ID NO: 7186 - RNA, 17 nt, Artificial Sequence
  Synthetic
aucggcggcggcgucgu

SEQ ID NO: 7187 - RNA, 17 nt, Artificial Sequence
  Synthetic
cgguccggguucggggu

SEQ ID NO: 7188 - RNA, 20 nt, Artificial Sequence
  Synthetic
cucgccauaaucggcgcgca

SEQ ID NO: 7189 - RNA, 20 nt, Artificial Sequence
  Synthetic
ucgccccccccggagcgcga

SEQ ID NO: 7190 - RNA, 20 nt, Artificial Sequence
  Synthetic
ccgcggggccgaggucgcga

SEQ ID NO: 7191 - RNA, 20 nt, Artificial Sequence
  Synthetic
ccauaaucggcgcgcaugga

SEQ ID NO: 7192 - RNA, 20 nt, Artificial Sequence
  Synthetic
cccuccaugcgcgccgauua

SEQ ID NO: 7193 - RNA, 20 nt, Artificial Sequence
  Synthetic
cgcgcuccggggggggcgac

SEQ ID NO: 7194 - RNA, 20 nt, Artificial Sequence
  Synthetic
ucgcgauggcggacgaggac

SEQ ID NO: 7195 - RNA, 20 nt, Artificial Sequence
  Synthetic
cccaccgugccacccgaacc

SEQ ID NO: 7196 - RNA, 20 nt, Artificial Sequence
  Synthetic
ccaccgugccacccgaaccc

SEQ ID NO: 7197 - RNA, 20 nt, Artificial Sequence
  Synthetic
cacgaucccgucgccccccc

SEQ ID NO: 7198 - RNA, 20 nt, Artificial Sequence
  Synthetic
cgaugccgacgaggcggccc

SEQ ID NO: 7199 - RNA, 20 nt, Artificial Sequence
  Synthetic
aggcucgucgacggccuccc

SEQ ID NO: 7200 - RNA, 20 nt, Artificial Sequence
  Synthetic
cgacggccuccccggacgcc

SEQ ID NO: 7201 - RNA, 20 nt, Artificial Sequence
  Synthetic
cuugcgcgccgucgcgcucc

SEQ ID NO: 7202 - RNA, 20 nt, Artificial Sequence
  Synthetic
cgaggacgggggacgucucc

SEQ ID NO: 7203 - RNA, 20 nt, Artificial Sequence
  Synthetic
cguccaccaucgaggccagc

SEQ ID NO: 7204 - RNA, 20 nt, Artificial Sequence
  Synthetic
cgucgucucgccgcggcagc

SEQ ID NO: 7205 - RNA, 20 nt, Artificial Sequence
  Synthetic
ucgacggccuccccggacgc

SEQ ID NO: 7206 - RNA, 20 nt, Artificial Sequence
  Synthetic
cgacgacgacgcagggccgc

SEQ ID NO: 7207 - RNA, 20 nt, Artificial Sequence
  Synthetic
auccggagauccggggccgc

SEQ ID NO: 7208 - RNA, 20 nt, Artificial Sequence
  Synthetic
acgaggacgggggacgucuc

SEQ ID NO: 7209 - RNA, 20 nt, Artificial Sequence
  Synthetic
cgcgcggcggggcgacgguc

SEQ ID NO: 7210 - RNA, 20 nt, Artificial Sequence
  Synthetic
cgacggcgcgcaagaagaag

SEQ ID NO: 7211 - RNA, 20 nt, Artificial Sequence
  Synthetic
cauaaucggcgcgcauggag

SEQ ID NO: 7212 - RNA, 20 nt, Artificial Sequence
  Synthetic
cgccgaugccgaugccgacg

SEQ ID NO: 7213 - RNA, 20 nt, Artificial Sequence
  Synthetic
cgaggucgcgauggcggacg

SEQ ID NO: 7214 - RNA, 20 nt, Artificial Sequence
  Synthetic
ccaucgcgaccucggccccg

SEQ ID NO: 7215 - RNA, 20 nt, Artificial Sequence
  Synthetic
cccgcucgccuucuccgccg

SEQ ID NO: 7216 - RNA, 20 nt, Artificial Sequence
  Synthetic
cggacggcgucgucucgccg

SEQ ID NO: 7217 - RNA, 20 nt, Artificial Sequence
  Synthetic
acgacgacgacgcagggccg

SEQ ID NO: 7218 - RNA, 20 nt, Artificial Sequence
  Synthetic
cgggggacgucuccgggccg

SEQ ID NO: 7219 - RNA, 20 nt, Artificial Sequence
  Synthetic
cggcuggauccggagauccg

SEQ ID NO: 7220 - RNA, 20 nt, Artificial Sequence
  Synthetic
uugcgcgccgucgcgcuccg

SEQ ID NO: 7221 - RNA, 20 nt, Artificial Sequence
  Synthetic
cggcgagacgacgccguccg

SEQ ID NO: 7222 - RNA, 20 nt, Artificial Sequence
  Synthetic
cggaccgucgccccgccgcg

SEQ ID NO: 7223 - RNA, 20 nt, Artificial Sequence
  Synthetic
caugcgcgccgauuauggcg

SEQ ID NO: 7224 - RNA, 20 nt, Artificial Sequence
  Synthetic
aacggccucguccaccaucg

SEQ ID NO: 7225 - RNA, 20 nt, Artificial Sequence
  Synthetic
cgaugccgaugccgacgagg

SEQ ID NO: 7226 - RNA, 20 nt, Artificial Sequence
  Synthetic
auaaucggcgcgcauggagg

SEQ ID NO: 7227 - RNA, 20 nt, Artificial Sequence
  Synthetic
cccggguucggguggcacgg

SEQ ID NO: 7228 - RNA, 20 nt, Artificial Sequence
  Synthetic
ugcgcgccgucgcgcuccgg

SEQ ID NO: 7229 - RNA, 20 nt, Artificial Sequence
  Synthetic
cgcauggaggggguccgcgg

SEQ ID NO: 7230 - RNA, 20 nt, Artificial Sequence
  Synthetic
cucgucggcaucggcaucgg

SEQ ID NO: 7231 - RNA, 20 nt, Artificial Sequence
  Synthetic
cggggccgaggucgcgaugg

SEQ ID NO: 7232 - RNA, 20 nt, Artificial Sequence
  Synthetic
cgccucgucggcaucggcau

SEQ ID NO: 7233 - RNA, 20 nt, Artificial Sequence
  Synthetic
cggggccgccucgucggcau

SEQ ID NO: 7234 - RNA, 20 nt, Artificial Sequence
  Synthetic
cucguccgccaucgcgaccu

SEQ ID NO: 7235 - RNA, 20 nt, Artificial Sequence
  Synthetic
cggggugggcggcgguccgu

SEQ ID NO: 7236 - RNA, 20 nt, Artificial Sequence
  Synthetic
ccggguucggguggcacggu

SEQ ID NO: 7237 - RNA, 17 nt, Artificial Sequence
  Synthetic
gggguccgcggcggaga

SEQ ID NO: 7238 - RNA, 17 nt, Artificial Sequence
  Synthetic
gccgcgcggcggggcga

SEQ ID NO: 7239 - RNA, 17 nt, Artificial Sequence
  Synthetic
ggcccugcuggccucga

SEQ ID NO: 7240 - RNA, 17 nt, Artificial Sequence
  Synthetic
gccgcggcggagacgac

SEQ ID NO: 7241 - RNA, 17 nt, Artificial Sequence
  Synthetic
gcuccggggggggcgac

SEQ ID NO: 7242 - RNA, 17 nt, Artificial Sequence
  Synthetic
gccgcccaccccgaacc

SEQ ID NO: 7243 - RNA, 17 nt, Artificial Sequence
  Synthetic
gccccgccgcgcggccc

SEQ ID NO: 7244 - RNA, 17 nt, Artificial Sequence
  Synthetic
gcgcgccgucgcgcucc

SEQ ID NO: 7245 - RNA, 17 nt, Artificial Sequence
  Synthetic
gacgacgacgacgacgc

SEQ ID NO: 7246 - RNA, 17 nt, Artificial Sequence
  Synthetic
gcggcagcuggcccugc

SEQ ID NO: 7247 - RNA, 17 nt, Artificial Sequence
  Synthetic
ggcuggauccggagauc

SEQ ID NO: 7248 - RNA, 17 nt, Artificial Sequence
  Synthetic
gaggcggccccggcguc

SEQ ID NO: 7249 - RNA, 17 nt, Artificial Sequence
  Synthetic
gcggcggggcgacgguc

SEQ ID NO: 7250 - RNA, 17 nt, Artificial Sequence
  Synthetic
gcggcggagaaggcgag

SEQ ID NO: 7251 - RNA, 17 nt, Artificial Sequence
  Synthetic
ggaggagaacgaagacg

SEQ ID NO: 7252 - RNA, 17 nt, Artificial Sequence
  Synthetic
ggccucgaugguggacg

SEQ ID NO: 7253 - RNA, 17 nt, Artificial Sequence
  Synthetic
ggccuccccggacgccg

SEQ ID NO: 7254 - RNA, 17 nt, Artificial Sequence
  Synthetic
gccggucgucuccgccg

SEQ ID NO: 7255 - RNA, 17 nt, Artificial Sequence
  Synthetic
gcagggccgcggggccg

SEQ ID NO: 7256 - RNA, 17 nt, Artificial Sequence
  Synthetic
ggcggccccggcguccg

SEQ ID NO: 7257 - RNA, 17 nt, Artificial Sequence
  Synthetic
guggcacggugggccgg

SEQ ID NO: 7258 - RNA, 17 nt, Artificial Sequence
  Synthetic
ggcaucggcaucggcgg

SEQ ID NO: 7259 - RNA, 17 nt, Artificial Sequence
  Synthetic
ggguucggggugggcgg

SEQ ID NO: 7260 - RNA, 17 nt, Artificial Sequence
  Synthetic
gucggcaucggcaucgg

SEQ ID NO: 7261 - RNA, 17 nt, Artificial Sequence
  Synthetic
ggccccggcguccgggg

SEQ ID NO: 7262 - RNA, 17 nt, Artificial Sequence
  Synthetic
ggccgaggucgcgaugg

SEQ ID NO: 7263 - RNA, 20 nt, Artificial Sequence
  Synthetic
guccaccaucgaggccagca

SEQ ID NO: 7264 - RNA, 20 nt, Artificial Sequence
  Synthetic
gaggggguccgcggcggaga

SEQ ID NO: 7265 - RNA, 20 nt, Artificial Sequence
  Synthetic
gcuggcccugcuggccucga

SEQ ID NO: 7266 - RNA, 20 nt, Artificial Sequence
  Synthetic
gucgccccgccgcgcggccc

SEQ ID NO: 7267 - RNA, 20 nt, Artificial Sequence
  Synthetic
gcgcggcggggcgacggucc

SEQ ID NO: 7268 - RNA, 20 nt, Artificial Sequence
  Synthetic
gaagacgacgacgacgacgc

SEQ ID NO: 7269 - RNA, 20 nt, Artificial Sequence
  Synthetic
gugggcggcgguccgucggc

SEQ ID NO: 7270 - RNA, 20 nt, Artificial Sequence
  Synthetic
gccgcggcagcuggcccugc

SEQ ID NO: 7271 - RNA, 20 nt, Artificial Sequence
  Synthetic
gccggaggagaacgaagacg

SEQ ID NO: 7272 - RNA, 20 nt, Artificial Sequence
  Synthetic
gcuggccucgaugguggacg

SEQ ID NO: 7273 - RNA, 20 nt, Artificial Sequence
  Synthetic
gccgccggucgucuccgccg

SEQ ID NO: 7274 - RNA, 20 nt, Artificial Sequence
  Synthetic
gacgcagggccgcggggccg

SEQ ID NO: 7275 - RNA, 20 nt, Artificial Sequence
  Synthetic
gccagcagggccagcugccg

SEQ ID NO: 7276 - RNA, 20 nt, Artificial Sequence
  Synthetic
gcgcgcauggaggggguccg

SEQ ID NO: 7277 - RNA, 20 nt, Artificial Sequence
  Synthetic
ggggcgacgguccggguucg

SEQ ID NO: 7278 - RNA, 20 nt, Artificial Sequence
  Synthetic
gcgauggcggacgaggacgg

SEQ ID NO: 7279 - RNA, 20 nt, Artificial Sequence
  Synthetic
gccgcggcggagacgaccgg

SEQ ID NO: 7280 - RNA, 20 nt, Artificial Sequence
  Synthetic
gucggcaucggcaucggcgg

SEQ ID NO: 7281 - RNA, 20 nt, Artificial Sequence
  Synthetic
gcgcgccgucgcgcuccggg

SEQ ID NO: 7282 - RNA, 20 nt, Artificial Sequence
  Synthetic
ggcggccccggcguccgggg

SEQ ID NO: 7283 - RNA, 20 nt, Artificial Sequence
  Synthetic
gcgacgguccggguucgggg

SEQ ID NO: 7284 - RNA, 20 nt, Artificial Sequence
  Synthetic
gcgccgucgcgcuccggggg

SEQ ID NO: 7285 - RNA, 20 nt, Artificial Sequence
  Synthetic
ggcccugcuggccucgaugg

SEQ ID NO: 7286 - RNA, 20 nt, Artificial Sequence
  Synthetic
ggcaucggcggcggcgucgu

SEQ ID NO: 7287 - RNA, 17 nt, Artificial Sequence
  Synthetic
caccaucgaggccagca

SEQ ID NO: 7288 - RNA, 17 nt, Artificial Sequence
  Synthetic
cgauggcggacgaggac

SEQ ID NO: 7289 - RNA, 17 nt, Artificial Sequence
  Synthetic
ccgugccacccgaaccc

SEQ ID NO: 7290 - RNA, 17 nt, Artificial Sequence
  Synthetic
cggccuccccggacgcc

SEQ ID NO: 7291 - RNA, 17 nt, Artificial Sequence
  Synthetic
ucgucuccgccgcggcc

SEQ ID NO: 7292 - RNA, 17 nt, Artificial Sequence
  Synthetic
cgccccgccgcgcggcc

SEQ ID NO: 7293 - RNA, 17 nt, Artificial Sequence
  Synthetic
aggcggccccggcgucc

SEQ ID NO: 7294 - RNA, 17 nt, Artificial Sequence
  Synthetic
cggcggggcgacggucc

SEQ ID NO: 7295 - RNA, 17 nt, Artificial Sequence
  Synthetic
ccaccaucgaggccagc

SEQ ID NO: 7296 - RNA, 17 nt, Artificial Sequence
  Synthetic
cgucucgccgcggcagc

SEQ ID NO: 7297 - RNA, 17 nt, Artificial Sequence
  Synthetic
acggccuccccggacgc

SEQ ID NO: 7298 - RNA, 17 nt, Artificial Sequence
  Synthetic
aacccgggccgcgcggc

SEQ ID NO: 7299 - RNA, 17 nt, Artificial Sequence
  Synthetic
cggguggcacggugggc

SEQ ID NO: 7300 - RNA, 17 nt, Artificial Sequence
  Synthetic
cggcggccccggaucuc

SEQ ID NO: 7301 - RNA, 17 nt, Artificial Sequence
  Synthetic
ccgcgcggcccggguuc

SEQ ID NO: 7302 - RNA, 17 nt, Artificial Sequence
  Synthetic
agcagggccagcugccg

SEQ ID NO: 7303 - RNA, 17 nt, Artificial Sequence
  Synthetic
cuggauccggagauccg

SEQ ID NO: 7304 - RNA, 17 nt, Artificial Sequence
  Synthetic
cgcgccgucgcgcuccg

SEQ ID NO: 7305 - RNA, 17 nt, Artificial Sequence
  Synthetic
cccgaacccgggccgcg

SEQ ID NO: 7306 - RNA, 17 nt, Artificial Sequence
  Synthetic
acccgggccgcgcggcg

SEQ ID NO: 7307 - RNA, 17 nt, Artificial Sequence
  Synthetic
auggcggacgaggacgg

SEQ ID NO: 7308 - RNA, 17 nt, Artificial Sequence
  Synthetic
auggaggggguccgcgg

SEQ ID NO: 7309 - RNA, 17 nt, Artificial Sequence
  Synthetic
cgcggcccggguucggg

SEQ ID NO: 7310 - RNA, 17 nt, Artificial Sequence
  Synthetic
ccgucgcgcuccggggg

SEQ ID NO: 7311 - RNA, 17 nt, Artificial Sequence
  Synthetic
uccggguucgggguggg

SEQ ID NO: 7312 - RNA, 17 nt, Artificial Sequence
  Synthetic
ccugcuggccucgaugg

SEQ ID NO: 7313 - RNA, 17 nt, Artificial Sequence
  Synthetic
cgccggggccgccucgu

SEQ ID NO: 7314 - RNA, 20 nt, Artificial Sequence
  Synthetic
aagacgacgacgacgacgca

SEQ ID NO: 7315 - RNA, 20 nt, Artificial Sequence
  Synthetic
cggcccggguucggguggca

SEQ ID NO: 7316 - RNA, 20 nt, Artificial Sequence
  Synthetic
cgggccgcgcggcggggcga

SEQ ID NO: 7317 - RNA, 20 nt, Artificial Sequence
  Synthetic
ucgcgcuccggggggggcga

SEQ ID NO: 7318 - RNA, 20 nt, Artificial Sequence
  Synthetic
cgggccgcggcggagacgac

SEQ ID NO: 7319 - RNA, 20 nt, Artificial Sequence
  Synthetic
accgccgcccaccccgaacc

SEQ ID NO: 7320 - RNA, 20 nt, Artificial Sequence
  Synthetic
cggucgucuccgccgcggcc

SEQ ID NO: 7321 - RNA, 20 nt, Artificial Sequence
  Synthetic
cgucgccccgccgcgcggcc

SEQ ID NO: 7322 - RNA, 20 nt, Artificial Sequence
  Synthetic
ucggcuggauccggagaucc

SEQ ID NO: 7323 - RNA, 20 nt, Artificial Sequence
  Synthetic
acgaggcggccccggcgucc

SEQ ID NO: 7324 - RNA, 20 nt, Artificial Sequence
  Synthetic
ccgcggcggagaaggcgagc

SEQ ID NO: 7325 - RNA, 20 nt, Artificial Sequence
  Synthetic
ccgaacccgggccgcgcggc

SEQ ID NO: 7326 - RNA, 20 nt, Artificial Sequence
  Synthetic
ucuugcgcgccgucgcgcuc

SEQ ID NO: 7327 - RNA, 20 nt, Artificial Sequence
  Synthetic
ccgccgcgcggcccggguuc

SEQ ID NO: 7328 - RNA, 20 nt, Artificial Sequence
  Synthetic
cggggcgacgguccggguuc

SEQ ID NO: 7329 - RNA, 20 nt, Artificial Sequence
  Synthetic
uccgcggcggagaaggcgag

SEQ ID NO: 7330 - RNA, 20 nt, Artificial Sequence
  Synthetic
cgcgauggcggacgaggacg

SEQ ID NO: 7331 - RNA, 20 nt, Artificial Sequence
  Synthetic
cgaggcggccccggcguccg

SEQ ID NO: 7332 - RNA, 20 nt, Artificial Sequence
  Synthetic
ccacccgaacccgggccgcg

SEQ ID NO: 7333 - RNA, 20 nt, Artificial Sequence
  Synthetic
cgaacccgggccgcgcggcg

SEQ ID NO: 7334 - RNA, 20 nt, Artificial Sequence
  Synthetic
cggguggcacggugggccgg

SEQ ID NO: 7335 - RNA, 20 nt, Artificial Sequence
  Synthetic
cccgaacccgggccgcgcgg

SEQ ID NO: 7336 - RNA, 20 nt, Artificial Sequence
  Synthetic
uccggguucggggugggcgg

SEQ ID NO: 7337 - RNA, 20 nt, Artificial Sequence
  Synthetic
ccgcgcggcccggguucggg

SEQ ID NO: 7338 - RNA, 20 nt, Artificial Sequence
  Synthetic
cgcgccgucgcgcuccgggg

SEQ ID NO: 7339 - RNA, 20 nt, Artificial Sequence
  Synthetic
cgguccggguucgggguggg

SEQ ID NO: 7340 - RNA, 20 nt, Artificial Sequence
  Synthetic
cgacgguccggguucggggu

SEQ ID NO: 7341 - RNA, 20 nt, Artificial Sequence
  Synthetic
cccgccgcgcggcccggguu

SEQ ID NO: 7342 - RNA, 17 nt, Artificial Sequence
  Synthetic
gccgccgccgacggcaa

SEQ ID NO: 7343 - RNA, 17 nt, Artificial Sequence
  Synthetic
uacgaccgcgcgcagaa

SEQ ID NO: 7344 - RNA, 17 nt, Artificial Sequence
  Synthetic
cagcucgggcgcccaca

SEQ ID NO: 7345 - RNA, 17 nt, Artificial Sequence
  Synthetic
guacucgcgcggggaca

SEQ ID NO: 7346 - RNA, 17 nt, Artificial Sequence
  Synthetic
gcgcgagcccguggaca

SEQ ID NO: 7347 - RNA, 17 nt, Artificial Sequence
  Synthetic
gugcugccgcgagacca

SEQ ID NO: 7348 - RNA, 17 nt, Artificial Sequence
  Synthetic
ggcguacccggacccca

SEQ ID NO: 7349 - RNA, 17 nt, Artificial Sequence
  Synthetic
ggcgcucaggcgcccca

SEQ ID NO: 7350 - RNA, 17 nt, Artificial Sequence
  Synthetic
ccggccgagcccgccca

SEQ ID NO: 7351 - RNA, 17 nt, Artificial Sequence
  Synthetic
cggcagcgccgggccca

SEQ ID NO: 7352 - RNA, 17 nt, Artificial Sequence
  Synthetic
gcagagccgguugccca

SEQ ID NO: 7353 - RNA, 17 nt, Artificial Sequence
  Synthetic
ggccggccgcgacgcca

SEQ ID NO: 7354 - RNA, 17 nt, Artificial Sequence
  Synthetic
gggcgcgggcgacgcca

SEQ ID NO: 7355 - RNA, 17 nt, Artificial Sequence
  Synthetic
ccaccugggguacgcca

SEQ ID NO: 7356 - RNA, 17 nt, Artificial Sequence
  Synthetic
gcucugcgggcccgcca

SEQ ID NO: 7357 - RNA, 17 nt, Artificial Sequence
  Synthetic
gaagcggcccgccgcca

SEQ ID NO: 7358 - RNA, 17 nt, Artificial Sequence
  Synthetic
cggcgcgccgggcgcca

SEQ ID NO: 7359 - RNA, 17 nt, Artificial Sequence
  Synthetic
augagggccgggcgcca

SEQ ID NO: 7360 - RNA, 17 nt, Artificial Sequence
  Synthetic
gagccccgccccggcca

SEQ ID NO: 7361 - RNA, 17 nt, Artificial Sequence
  Synthetic
ggcgcgcacggcggcca

SEQ ID NO: 7362 - RNA, 17 nt, Artificial Sequence
  Synthetic
guccgugagcucggcca

SEQ ID NO: 7363 - RNA, 17 nt, Artificial Sequence
  Synthetic
gggccggccccgggcca

SEQ ID NO: 7364 - RNA, 17 nt, Artificial Sequence
  Synthetic
gcggcggcucauggcca

SEQ ID NO: 7365 - RNA, 17 nt, Artificial Sequence
  Synthetic
cggcgacaggcuggcca

SEQ ID NO: 7366 - RNA, 17 nt, Artificial Sequence
  Synthetic
cagccccaggaacucca

SEQ ID NO: 7367 - RNA, 17 nt, Artificial Sequence
  Synthetic
ggcggccaggcacucca

SEQ ID NO: 7368 - RNA, 17 nt, Artificial Sequence
  Synthetic
ggcgcaguaggccucca

SEQ ID NO: 7369 - RNA, 17 nt, Artificial Sequence
  Synthetic
cuccgcguccaugucca

SEQ ID NO: 7370 - RNA, 17 nt, Artificial Sequence
  Synthetic
guucucgcgcgccagca

SEQ ID NO: 7371 - RNA, 17 nt, Artificial Sequence
  Synthetic
gcggccggaggccagca

SEQ ID NO: 7372 - RNA, 17 nt, Artificial Sequence
  Synthetic
gacggugucggccagca

SEQ ID NO: 7373 - RNA, 17 nt, Artificial Sequence
  Synthetic
guccagcgccgggagca

SEQ ID NO: 7374 - RNA, 17 nt, Artificial Sequence
  Synthetic
gagggccccgacccgca

SEQ ID NO: 7375 - RNA, 17 nt, Artificial Sequence
  Synthetic
cgccgccggccagcgca

SEQ ID NO: 7376 - RNA, 17 nt, Artificial Sequence
  Synthetic
cgccgggccgccgcgca

SEQ ID NO: 7377 - RNA, 17 nt, Artificial Sequence
  Synthetic
caggcucacggcgcgca

SEQ ID NO: 7378 - RNA, 17 nt, Artificial Sequence
  Synthetic
ccaguccgcggcgcgca

SEQ ID NO: 7379 - RNA, 17 nt, Artificial Sequence
  Synthetic
ucggcgcugggcgcgca

SEQ ID NO: 7380 - RNA, 17 nt, Artificial Sequence
  Synthetic
uccggccagccccggca

SEQ ID NO: 7381 - RNA, 17 nt, Artificial Sequence
  Synthetic
guaccccagguggggca

SEQ ID NO: 7382 - RNA, 17 nt, Artificial Sequence
  Synthetic
gcgcacggcgcacugca

SEQ ID NO: 7383 - RNA, 17 nt, Artificial Sequence
  Synthetic
cagcagccgcgugauca

SEQ ID NO: 7384 - RNA, 17 nt, Artificial Sequence
  Synthetic
ggccguggccgagcuca

SEQ ID NO: 7385 - RNA, 17 nt, Artificial Sequence
  Synthetic
cccggcgaccaggcuca

SEQ ID NO: 7386 - RNA, 17 nt, Artificial Sequence
  Synthetic
gucguagcggcggcuca

SEQ ID NO: 7387 - RNA, 17 nt, Artificial Sequence
  Synthetic
cgccacgggccgcuuca

SEQ ID NO: 7388 - RNA, 17 nt, Artificial Sequence
  Synthetic
cuacgaccgcgcgcaga

SEQ ID NO: 7389 - RNA, 17 nt, Artificial Sequence
  Synthetic
ccccagcgccacguaga

SEQ ID NO: 7390 - RNA, 17 nt, Artificial Sequence
  Synthetic
gcgguagcgcgcguaga

SEQ ID NO: 7391 - RNA, 17 nt, Artificial Sequence
  Synthetic
gacgccaaccgccacga

SEQ ID NO: 7392 - RNA, 17 nt, Artificial Sequence
  Synthetic
gacgacgacgacgacga

SEQ ID NO: 7393 - RNA, 17 nt, Artificial Sequence
  Synthetic
cuggaggacgacgacga

SEQ ID NO: 7394 - RNA, 17 nt, Artificial Sequence
  Synthetic
gcgcgaacccccgacga

SEQ ID NO: 7395 - RNA, 17 nt, Artificial Sequence
  Synthetic
gcgcugcucgagcccga

SEQ ID NO: 7396 - RNA, 17 nt, Artificial Sequence
  Synthetic
acccgccggcccgccga

SEQ ID NO: 7397 - RNA, 17 nt, Artificial Sequence
  Synthetic
gcggacuggcccgccga

SEQ ID NO: 7398 - RNA, 17 nt, Artificial Sequence
  Synthetic
ggcgacgccgccgccga

SEQ ID NO: 7399 - RNA, 17 nt, Artificial Sequence
  Synthetic
cucgucguccgcgccga

SEQ ID NO: 7400 - RNA, 17 nt, Artificial Sequence
  Synthetic
uccagggcggcggccga

SEQ ID NO: 7401 - RNA, 17 nt, Artificial Sequence
  Synthetic
ggcgcgcagcgggccga

SEQ ID NO: 7402 - RNA, 17 nt, Artificial Sequence
  Synthetic
uacgcgcgcuaccgcga

SEQ ID NO: 7403 - RNA, 17 nt, Artificial Sequence
  Synthetic
ggcgggggugcccgcga

SEQ ID NO: 7404 - RNA, 17 nt, Artificial Sequence
  Synthetic
gccggacgcggaggcga

SEQ ID NO: 7405 - RNA, 17 nt, Artificial Sequence
  Synthetic
cuccacggcgccggcga

SEQ ID NO: 7406 - RNA, 17 nt, Artificial Sequence
  Synthetic
cgagucggccgcggcga

SEQ ID NO: 7407 - RNA, 17 nt, Artificial Sequence
  Synthetic
cuggcggagggcuucga

SEQ ID NO: 7408 - RNA, 17 nt, Artificial Sequence
  Synthetic
cuggaggcgcuggcgga

SEQ ID NO: 7409 - RNA, 17 nt, Artificial Sequence
  Synthetic
gcgcggcccccgcggga

SEQ ID NO: 7410 - RNA, 17 nt, Artificial Sequence
  Synthetic
cgcgggccgcgcgggga

SEQ ID NO: 7411 - RNA, 17 nt, Artificial Sequence
  Synthetic
gugcucccggcgcugga

SEQ ID NO: 7412 - RNA, 17 nt, Artificial Sequence
  Synthetic
gcgcgggucgaacauga

SEQ ID NO: 7413 - RNA, 17 nt, Artificial Sequence
  Synthetic
cacgcugccggagauga

SEQ ID NO: 7414 - RNA, 17 nt, Artificial Sequence
  Synthetic
gcggugcccgccggcua

SEQ ID NO: 7415 - RNA, 17 nt, Artificial Sequence
  Synthetic
ccggggcgcgugcugua

SEQ ID NO: 7416 - RNA, 17 nt, Artificial Sequence
  Synthetic
ccgccgccgacggcaac

SEQ ID NO: 7417 - RNA, 17 nt, Artificial Sequence
  Synthetic
ccgccugggcgggcaac

SEQ ID NO: 7418 - RNA, 17 nt, Artificial Sequence
  Synthetic
uggcggcccugggcaac

SEQ ID NO: 7419 - RNA, 17 nt, Artificial Sequence
  Synthetic
cgcccgaggccucgaac

SEQ ID NO: 7420 - RNA, 17 nt, Artificial Sequence
  Synthetic
agcucgggcgcccacac

SEQ ID NO: 7421 - RNA, 17 nt, Artificial Sequence
  Synthetic
ugcugccgcgagaccac

SEQ ID NO: 7422 - RNA, 17 nt, Artificial Sequence
  Synthetic
gccggccgcgacgccac

SEQ ID NO: 7423 - RNA, 17 nt, Artificial Sequence
  Synthetic
uccgcguccauguccac

SEQ ID NO: 7424 - RNA, 17 nt, Artificial Sequence
  Synthetic
cccagcgccacguagac

SEQ ID NO: 7425 - RNA, 17 nt, Artificial Sequence
  Synthetic
cggacuggcccgccgac

SEQ ID NO: 7426 - RNA, 17 nt, Artificial Sequence
  Synthetic
acgcgcgcuaccgcgac

SEQ ID NO: 7427 - RNA, 17 nt, Artificial Sequence
  Synthetic
ccgggggucgcggcgac

SEQ ID NO: 7428 - RNA, 17 nt, Artificial Sequence
  Synthetic
ccgugcgcgccgcggac

SEQ ID NO: 7429 - RNA, 17 nt, Artificial Sequence
  Synthetic
ccgcuggguccgcggac

SEQ ID NO: 7430 - RNA, 17 nt, Artificial Sequence
  Synthetic
ugggcgggcaacuggac

SEQ ID NO: 7431 - RNA, 17 nt, Artificial Sequence
  Synthetic
gagaacgcggcgcugac

SEQ ID NO: 7432 - RNA, 17 nt, Artificial Sequence
  Synthetic
gcggcgcgucgggguac

SEQ ID NO: 7433 - RNA, 17 nt, Artificial Sequence
  Synthetic
gcccgaggccucgaacc

SEQ ID NO: 7434 - RNA, 17 nt, Artificial Sequence
  Synthetic
gcgggccgugccccacc

SEQ ID NO: 7435 - RNA, 17 nt, Artificial Sequence
  Synthetic
ccuccgggucgggcacc

SEQ ID NO: 7436 - RNA, 17 nt, Artificial Sequence
  Synthetic
gcgccaggugcccgacc

SEQ ID NO: 7437 - RNA, 17 nt, Artificial Sequence
  Synthetic
gggcuucgacggcgacc

SEQ ID NO: 7438 - RNA, 17 nt, Artificial Sequence
  Synthetic
ccagggccccggcgacc

SEQ ID NO: 7439 - RNA, 17 nt, Artificial Sequence
  Synthetic
gcugccgggcgaggacc

SEQ ID NO: 7440 - RNA, 17 nt, Artificial Sequence
  Synthetic
gcuguccacgcgggacc

SEQ ID NO: 7441 - RNA, 17 nt, Artificial Sequence
  Synthetic
ggacguggcgcuggacc

SEQ ID NO: 7442 - RNA, 17 nt, Artificial Sequence
  Synthetic
agaacgcggcgcugacc

SEQ ID NO: 7443 - RNA, 17 nt, Artificial Sequence
  Synthetic
gcggcagcacgccuacc

SEQ ID NO: 7444 - RNA, 17 nt, Artificial Sequence
  Synthetic
gguccgcggggcguacc

SEQ ID NO: 7445 - RNA, 17 nt, Artificial Sequence
  Synthetic
acgcgcgcgaagacccc

SEQ ID NO: 7446 - RNA, 17 nt, Artificial Sequence
  Synthetic
ccugucgccgcgacccc

SEQ ID NO: 7447 - RNA, 17 nt, Artificial Sequence
  Synthetic
ccgccauggcguacccc

SEQ ID NO: 7448 - RNA, 17 nt, Artificial Sequence
  Synthetic
cgggggcgggccccccc

SEQ ID NO: 7449 - RNA, 17 nt, Artificial Sequence
  Synthetic
gccggccccccgccccc

SEQ ID NO: 7450 - RNA, 17 nt, Artificial Sequence
  Synthetic
ugcgccgccccgccccc

SEQ ID NO: 7451 - RNA, 17 nt, Artificial Sequence
  Synthetic
gccggggcgccgccccc

SEQ ID NO: 7452 - RNA, 17 nt, Artificial Sequence
  Synthetic
cgccggccagcagcccc

SEQ ID NO: 7453 - RNA, 17 nt, Artificial Sequence
  Synthetic
ggccggccccccgcccc

SEQ ID NO: 7454 - RNA, 17 nt, Artificial Sequence
  Synthetic
cggggggggcccgcccc

SEQ ID NO: 7455 - RNA, 17 nt, Artificial Sequence
  Synthetic
ggccggggcgccgcccc

SEQ ID NO: 7456 - RNA, 17 nt, Artificial Sequence
  Synthetic
cguacagcacgcgcccc

SEQ ID NO: 7457 - RNA, 17 nt, Artificial Sequence
  Synthetic
cggcgcucaggcgcccc

SEQ ID NO: 7458 - RNA, 17 nt, Artificial Sequence
  Synthetic
ggcggggggccggcccc

SEQ ID NO: 7459 - RNA, 17 nt, Artificial Sequence
  Synthetic
gugcccgcgagggcccc

SEQ ID NO: 7460 - RNA, 17 nt, Artificial Sequence
  Synthetic
ccgcgcccgcgggcccc

SEQ ID NO: 7461 - RNA, 17 nt, Artificial Sequence
  Synthetic
uccagcgccacgucccc

SEQ ID NO: 7462 - RNA, 17 nt, Artificial Sequence
  Synthetic
cgggcuccggccagccc

SEQ ID NO: 7463 - RNA, 17 nt, Artificial Sequence
  Synthetic
gcgcaagagccccgccc

SEQ ID NO: 7464 - RNA, 17 nt, Artificial Sequence
  Synthetic
cccggccgagcccgccc

SEQ ID NO: 7465 - RNA, 17 nt, Artificial Sequence
  Synthetic
cagggccgagcccgccc

SEQ ID NO: 7466 - RNA, 17 nt, Artificial Sequence
  Synthetic
gguccaguugcccgccc

SEQ ID NO: 7467 - RNA, 17 nt, Artificial Sequence
  Synthetic
cugggcgacagccgccc

SEQ ID NO: 7468 - RNA, 17 nt, Artificial Sequence
  Synthetic
gcccucggccgccgccc

SEQ ID NO: 7469 - RNA, 17 nt, Artificial Sequence
  Synthetic
gggggugcucgccgccc

SEQ ID NO: 7470 - RNA, 17 nt, Artificial Sequence
  Synthetic
ccguacagcacgcgccc

SEQ ID NO: 7471 - RNA, 17 nt, Artificial Sequence
  Synthetic
gccgcgcccccgcgccc

SEQ ID NO: 7472 - RNA, 17 nt, Artificial Sequence
  Synthetic
gccgcagcggcgcgccc

SEQ ID NO: 7473 - RNA, 17 nt, Artificial Sequence
  Synthetic
gucggggguucgcgccc

SEQ ID NO: 7474 - RNA, 17 nt, Artificial Sequence
  Synthetic
gccgcccggcggcgccc

SEQ ID NO: 7475 - RNA, 17 nt, Artificial Sequence
  Synthetic
ccccgggggcggcgccc

SEQ ID NO: 7476 - RNA, 17 nt, Artificial Sequence
  Synthetic
cgaggccucgggcgccc

SEQ ID NO: 7477 - RNA, 17 nt, Artificial Sequence
  Synthetic
acccgcgcguggcgccc

SEQ ID NO: 7478 - RNA, 17 nt, Artificial Sequence
  Synthetic
gggcggggggccggccc

SEQ ID NO: 7479 - RNA, 17 nt, Artificial Sequence
  Synthetic
ucacggccgggcggccc

SEQ ID NO: 7480 - RNA, 17 nt, Artificial Sequence
  Synthetic
cugccugcuggcggccc

SEQ ID NO: 7481 - RNA, 17 nt, Artificial Sequence
  Synthetic
cggggcgggcucggccc

SEQ ID NO: 7482 - RNA, 17 nt, Artificial Sequence
  Synthetic
gucgucgucgucggccc

SEQ ID NO: 7483 - RNA, 17 nt, Artificial Sequence
  Synthetic
cgccgggcccagggccc

SEQ ID NO: 7484 - RNA, 17 nt, Artificial Sequence
  Synthetic
ggugcccgcgagggccc

SEQ ID NO: 7485 - RNA, 17 nt, Artificial Sequence
  Synthetic
gcggcagcgccgggccc

SEQ ID NO: 7486 - RNA, 17 nt, Artificial Sequence
  Synthetic
gccgcgcccgcgggccc

SEQ ID NO: 7487 - RNA, 17 nt, Artificial Sequence
  Synthetic
ccuggucgccggggccc

SEQ ID NO: 7488 - RNA, 17 nt, Artificial Sequence
  Synthetic
ggcguguggcugggccc

SEQ ID NO: 7489 - RNA, 17 nt, Artificial Sequence
  Synthetic
gcggggagccguggccc

SEQ ID NO: 7490 - RNA, 17 nt, Artificial Sequence
  Synthetic
cgcagagccgguugccc

SEQ ID NO: 7491 - RNA, 17 nt, Artificial Sequence
  Synthetic
guccagcgccacguccc

SEQ ID NO: 7492 - RNA, 17 nt, Artificial Sequence
  Synthetic
ccgcagcucgcgcagcc

SEQ ID NO: 7493 - RNA, 17 nt, Artificial Sequence
  Synthetic
cggggcuggccggagcc

SEQ ID NO: 7494 - RNA, 17 nt, Artificial Sequence
  Synthetic
cgugcgcgccgugagcc

SEQ ID NO: 7495 - RNA, 17 nt, Artificial Sequence
  Synthetic
guccagcucgacccgcc

SEQ ID NO: 7496 - RNA, 17 nt, Artificial Sequence
  Synthetic
uggcgccgccagccgcc

SEQ ID NO: 7497 - RNA, 17 nt, Artificial Sequence
  Synthetic
ccgccuggagcgccgcc

SEQ ID NO: 7498 - RNA, 17 nt, Artificial Sequence
  Synthetic
gcggcgggcgcgccgcc

SEQ ID NO: 7499 - RNA, 17 nt, Artificial Sequence
  Synthetic
ccggccagggcgccgcc

SEQ ID NO: 7500 - RNA, 17 nt, Artificial Sequence
  Synthetic
gggcgcggggcgccgcc

SEQ ID NO: 7501 - RNA, 17 nt, Artificial Sequence
  Synthetic
ggcccgccacggccgcc

SEQ ID NO: 7502 - RNA, 17 nt, Artificial Sequence
  Synthetic
gccccggcacggccgcc

SEQ ID NO: 7503 - RNA, 17 nt, Artificial Sequence
  Synthetic
ggcgaccgcgggccgcc

SEQ ID NO: 7504 - RNA, 17 nt, Artificial Sequence
  Synthetic
gacccgccggggccgcc

SEQ ID NO: 7505 - RNA, 17 nt, Artificial Sequence
  Synthetic
gcccgcgcagcuccgcc

SEQ ID NO: 7506 - RNA, 17 nt, Artificial Sequence
  Synthetic
cccggccguccagcgcc

SEQ ID NO: 7507 - RNA, 17 nt, Artificial Sequence
  Synthetic
ggcuccgcggcagcgcc

SEQ ID NO: 7508 - RNA, 17 nt, Artificial Sequence
  Synthetic
cgccgcgcccccgcgcc

SEQ ID NO: 7509 - RNA, 17 nt, Artificial Sequence
  Synthetic
uggccgcgggccgcgcc

SEQ ID NO: 7510 - RNA, 17 nt, Artificial Sequence
  Synthetic
cagaaguccggcgcgcc

SEQ ID NO: 7511 - RNA, 17 nt, Artificial Sequence
  Synthetic
cgccccgccugcgcgcc

SEQ ID NO: 7512 - RNA, 17 nt, Artificial Sequence
  Synthetic
gcgcccacacgggcgcc

SEQ ID NO: 7513 - RNA, 17 nt, Artificial Sequence
  Synthetic
ggugucggcggggcgcc

SEQ ID NO: 7514 - RNA, 17 nt, Artificial Sequence
  Synthetic
ggcgacgccauggcgcc

SEQ ID NO: 7515 - RNA, 17 nt, Artificial Sequence
  Synthetic
ccccgcgccguggcgcc

SEQ ID NO: 7516 - RNA, 17 nt, Artificial Sequence
  Synthetic
aacccgcgcguggcgcc

SEQ ID NO: 7517 - RNA, 17 nt, Artificial Sequence
  Synthetic
ggcggccuggaugcgcc

SEQ ID NO: 7518 - RNA, 17 nt, Artificial Sequence
  Synthetic
cggccgccacgugcgcc

SEQ ID NO: 7519 - RNA, 17 nt, Artificial Sequence
  Synthetic
gcggccagguccucgcc

SEQ ID NO: 7520 - RNA, 17 nt, Artificial Sequence
  Synthetic
ccgugagccuggucgcc

SEQ ID NO: 7521 - RNA, 17 nt, Artificial Sequence
  Synthetic
cggcgccggcgaaggcc

SEQ ID NO: 7522 - RNA, 17 nt, Artificial Sequence
  Synthetic
agauccggaagcaggcc

SEQ ID NO: 7523 - RNA, 17 nt, Artificial Sequence
  Synthetic
gcagcaccucgcaggcc

SEQ ID NO: 7524 - RNA, 17 nt, Artificial Sequence
  Synthetic
ggcgccccccagaggcc

SEQ ID NO: 7525 - RNA, 17 nt, Artificial Sequence
  Synthetic
cgggccgcuucacggcc

SEQ ID NO: 7526 - RNA, 17 nt, Artificial Sequence
  Synthetic
cccggcgcuggacggcc

SEQ ID NO: 7527 - RNA, 17 nt, Artificial Sequence
  Synthetic
agagccccgccccggcc

SEQ ID NO: 7528 - RNA, 17 nt, Artificial Sequence
  Synthetic
ccgagcccgccccggcc

SEQ ID NO: 7529 - RNA, 17 nt, Artificial Sequence
  Synthetic
ccgccuccgcgccggcc

SEQ ID NO: 7530 - RNA, 17 nt, Artificial Sequence
  Synthetic
cggcgcggcccgcggcc

SEQ ID NO: 7531 - RNA, 17 nt, Artificial Sequence
  Synthetic
ucccgcggcaggcggcc

SEQ ID NO: 7532 - RNA, 17 nt, Artificial Sequence
  Synthetic
ugcgccgcgcggcggcc

SEQ ID NO: 7533 - RNA, 17 nt, Artificial Sequence
  Synthetic
cgccgugcgcggcggcc

SEQ ID NO: 7534 - RNA, 17 nt, Artificial Sequence
  Synthetic
cgcccgaggcggcggcc

SEQ ID NO: 7535 - RNA, 17 nt, Artificial Sequence
  Synthetic
ccugggcgggcucggcc

SEQ ID NO: 7536 - RNA, 17 nt, Artificial Sequence
  Synthetic
ggucgaacaugagggcc

SEQ ID NO: 7537 - RNA, 17 nt, Artificial Sequence
  Synthetic
ccgcggggguccgggcc

SEQ ID NO: 7538 - RNA, 17 nt, Artificial Sequence
  Synthetic
ccaccgccgcgcgggcc

SEQ ID NO: 7539 - RNA, 17 nt, Artificial Sequence
  Synthetic
cggaggaggcgcgggcc

SEQ ID NO: 7540 - RNA, 17 nt, Artificial Sequence
  Synthetic
cgggggcgcggcgggcc

SEQ ID NO: 7541 - RNA, 17 nt, Artificial Sequence
  Synthetic
ggccgcguguucgggcc

SEQ ID NO: 7542 - RNA, 17 nt, Artificial Sequence
  Synthetic
cugcgcgcgcuggggcc

SEQ ID NO: 7543 - RNA, 17 nt, Artificial Sequence
  Synthetic
ccgcuucggcuggggcc

SEQ ID NO: 7544 - RNA, 17 nt, Artificial Sequence
  Synthetic
cgccggggcccugggcc

SEQ ID NO: 7545 - RNA, 17 nt, Artificial Sequence
  Synthetic
ccggcggcgcccuggcc

SEQ ID NO: 7546 - RNA, 17 nt, Artificial Sequence
  Synthetic
agcggggagccguggcc

SEQ ID NO: 7547 - RNA, 17 nt, Artificial Sequence
  Synthetic
cucuacucgccgcugcc

SEQ ID NO: 7548 - RNA, 17 nt, Artificial Sequence
  Synthetic
cguggccguggagugcc

SEQ ID NO: 7549 - RNA, 17 nt, Artificial Sequence
  Synthetic
gaccuggcggccgugcc

SEQ ID NO: 7550 - RNA, 17 nt, Artificial Sequence
  Synthetic
gggcaccuggcgcaucc

SEQ ID NO: 7551 - RNA, 17 nt, Artificial Sequence
  Synthetic
cgccugccgcgggaucc

SEQ ID NO: 7552 - RNA, 17 nt, Artificial Sequence
  Synthetic
gcucggcggaccacucc

SEQ ID NO: 7553 - RNA, 17 nt, Artificial Sequence
  Synthetic
ccuccgccagcgccucc

SEQ ID NO: 7554 - RNA, 17 nt, Artificial Sequence
  Synthetic
gggcgcaguaggccucc

SEQ ID NO: 7555 - RNA, 17 nt, Artificial Sequence
  Synthetic
ccacgcgcacguccucc

SEQ ID NO: 7556 - RNA, 17 nt, Artificial Sequence
  Synthetic
gggcccggcggcgcucc

SEQ ID NO: 7557 - RNA, 17 nt, Artificial Sequence
  Synthetic
ccgccgcgccgugcucc

SEQ ID NO: 7558 - RNA, 17 nt, Artificial Sequence
  Synthetic
ggucgccgcgggggucc

SEQ ID NO: 7559 - RNA, 17 nt, Artificial Sequence
  Synthetic
ggcuggccauggggucc

SEQ ID NO: 7560 - RNA, 17 nt, Artificial Sequence
  Synthetic
cggcgccguggaguucc

SEQ ID NO: 7561 - RNA, 17 nt, Artificial Sequence
  Synthetic
gcccgagauccggaagc

SEQ ID NO: 7562 - RNA, 17 nt, Artificial Sequence
  Synthetic
cgucgcgcagcaccagc

SEQ ID NO: 7563 - RNA, 17 nt, Artificial Sequence
  Synthetic
ugcccagggccgccagc

SEQ ID NO: 7564 - RNA, 17 nt, Artificial Sequence
  Synthetic
cguucucgcgcgccagc

SEQ ID NO: 7565 - RNA, 17 nt, Artificial Sequence
  Synthetic
cgacggugucggccagc

SEQ ID NO: 7566 - RNA, 17 nt, Artificial Sequence
  Synthetic
ggcccgaggcgcgcagc

SEQ ID NO: 7567 - RNA, 17 nt, Artificial Sequence
  Synthetic
ccgccgcgcggcgcagc

SEQ ID NO: 7568 - RNA, 17 nt, Artificial Sequence
  Synthetic
cggcggcggagcucagc

SEQ ID NO: 7569 - RNA, 17 nt, Artificial Sequence
  Synthetic
gcgacggguacgucagc

SEQ ID NO: 7570 - RNA, 17 nt, Artificial Sequence
  Synthetic
ggcgcaggcuggucagc

SEQ ID NO: 7571 - RNA, 17 nt, Artificial Sequence
  Synthetic
acggcgcggggaagagc

SEQ ID NO: 7572 - RNA, 17 nt, Artificial Sequence
  Synthetic
ucugguucuggaagagc

SEQ ID NO: 7573 - RNA, 17 nt, Artificial Sequence
  Synthetic
uggcgggcccgcagagc

SEQ ID NO: 7574 - RNA, 17 nt, Artificial Sequence
  Synthetic
cgugugggcgcccgagc

SEQ ID NO: 7575 - RNA, 17 nt, Artificial Sequence
  Synthetic
gccccggcgggucgagc

SEQ ID NO: 7576 - RNA, 17 nt, Artificial Sequence
  Synthetic
ggacauggacgcggagc

SEQ ID NO: 7577 - RNA, 17 nt, Artificial Sequence
  Synthetic
ccccgcggcgccguagc

SEQ ID NO: 7578 - RNA, 17 nt, Artificial Sequence
  Synthetic
ggggcccagccacacgc

SEQ ID NO: 7579 - RNA, 17 nt, Artificial Sequence
  Synthetic
cuucggccccgacacgc

SEQ ID NO: 7580 - RNA, 17 nt, Artificial Sequence
  Synthetic
gcggcugcuguacacgc

SEQ ID NO: 7581 - RNA, 17 nt, Artificial Sequence
  Synthetic
gcugcugcuguccacgc

SEQ ID NO: 7582 - RNA, 17 nt, Artificial Sequence
  Synthetic
gacgacgaccgcgacgc

SEQ ID NO: 7583 - RNA, 17 nt, Artificial Sequence
  Synthetic
cgcgacgacgcggacgc

SEQ ID NO: 7584 - RNA, 17 nt, Artificial Sequence
  Synthetic
cgcccccgcagauacgc

SEQ ID NO: 7585 - RNA, 17 nt, Artificial Sequence
  Synthetic
gccgccgccaccaccgc

SEQ ID NO: 7586 - RNA, 17 nt, Artificial Sequence
  Synthetic
acccccgcggcgaccgc

SEQ ID NO: 7587 - RNA, 17 nt, Artificial Sequence
  Synthetic
cgagggccccgacccgc

SEQ ID NO: 7588 - RNA, 17 nt, Artificial Sequence
  Synthetic
cguccagcucgacccgc

SEQ ID NO: 7589 - RNA, 17 nt, Artificial Sequence
  Synthetic
ccgcggcgcugacccgc

SEQ ID NO: 7590 - RNA, 17 nt, Artificial Sequence
  Synthetic
gccggcgcgccccccgc

SEQ ID NO: 7591 - RNA, 17 nt, Artificial Sequence
  Synthetic
cggcgacgcgcccccgc

SEQ ID NO: 7592 - RNA, 17 nt, Artificial Sequence
  Synthetic
gggggcgcggcccccgc

SEQ ID NO: 7593 - RNA, 17 nt, Artificial Sequence
  Synthetic
ggccuacugcgccccgc

SEQ ID NO: 7594 - RNA, 17 nt, Artificial Sequence
  Synthetic
acggcgacgacgcccgc

SEQ ID NO: 7595 - RNA, 17 nt, Artificial Sequence
  Synthetic
ggggcggccgcgcccgc

SEQ ID NO: 7596 - RNA, 17 nt, Artificial Sequence
  Synthetic
gcucggccacggcccgc

SEQ ID NO: 7597 - RNA, 17 nt, Artificial Sequence
  Synthetic
ccgcgcccggggcccgc

SEQ ID NO: 7598 - RNA, 17 nt, Artificial Sequence
  Synthetic
gagcgcgcggugcccgc

SEQ ID NO: 7599 - RNA, 17 nt, Artificial Sequence
  Synthetic
gcggccgccccucccgc

SEQ ID NO: 7600 - RNA, 17 nt, Artificial Sequence
  Synthetic
ggcggcgggcuucccgc

SEQ ID NO: 7601 - RNA, 17 nt, Artificial Sequence
  Synthetic
cuggcgccgccagccgc

SEQ ID NO: 7602 - RNA, 17 nt, Artificial Sequence
  Synthetic
gccgcagaccacgccgc

SEQ ID NO: 7603 - RNA, 17 nt, Artificial Sequence
  Synthetic
accaccaccaccgccgc

SEQ ID NO: 7604 - RNA, 17 nt, Artificial Sequence
  Synthetic
gugguggggaccgccgc

SEQ ID NO: 7605 - RNA, 17 nt, Artificial Sequence
  Synthetic
cggcgggucagcgccgc

SEQ ID NO: 7606 - RNA, 17 nt, Artificial Sequence
  Synthetic
gccgccuggagcgccgc

SEQ ID NO: 7607 - RNA, 17 nt, Artificial Sequence
  Synthetic
cgcaggucccgcgccgc

SEQ ID NO: 7608 - RNA, 17 nt, Artificial Sequence
  Synthetic
gcccgccuccgcgccgc

SEQ ID NO: 7609 - RNA, 17 nt, Artificial Sequence
  Synthetic
ggcggcgggcgcgccgc

SEQ ID NO: 7610 - RNA, 17 nt, Artificial Sequence
  Synthetic
gccggcuacggcgccgc

SEQ ID NO: 7611 - RNA, 17 nt, Artificial Sequence
  Synthetic
cccggccagggcgccgc

SEQ ID NO: 7612 - RNA, 17 nt, Artificial Sequence
  Synthetic
cggcccgcggucgccgc

SEQ ID NO: 7613 - RNA, 17 nt, Artificial Sequence
  Synthetic
gcgggaggggcggccgc

SEQ ID NO: 7614 - RNA, 17 nt, Artificial Sequence
  Synthetic
cgcugggcgucggccgc

SEQ ID NO: 7615 - RNA, 17 nt, Artificial Sequence
  Synthetic
accgcgacgcgggccgc

SEQ ID NO: 7616 - RNA, 17 nt, Artificial Sequence
  Synthetic
ggcgaggaccuggccgc

SEQ ID NO: 7617 - RNA, 17 nt, Artificial Sequence
  Synthetic
gccuggccgccugccgc

SEQ ID NO: 7618 - RNA, 17 nt, Artificial Sequence
  Synthetic
ggcggccucgcugccgc

SEQ ID NO: 7619 - RNA, 17 nt, Artificial Sequence
  Synthetic
cgcugcgccucugccgc

SEQ ID NO: 7620 - RNA, 17 nt, Artificial Sequence
  Synthetic
ggcccgcgcagcuccgc

SEQ ID NO: 7621 - RNA, 17 nt, Artificial Sequence
  Synthetic
cgacguccgcgguccgc

SEQ ID NO: 7622 - RNA, 17 nt, Artificial Sequence
  Synthetic
gcccggccguccagcgc

SEQ ID NO: 7623 - RNA, 17 nt, Artificial Sequence
  Synthetic
gggcuccgcggcagcgc

SEQ ID NO: 7624 - RNA, 17 nt, Artificial Sequence
  Synthetic
cagaggcggccgagcgc

SEQ ID NO: 7625 - RNA, 17 nt, Artificial Sequence
  Synthetic
ccccgggcgccacgcgc

SEQ ID NO: 7626 - RNA, 17 nt, Artificial Sequence
  Synthetic
ugccgccggccacgcgc

SEQ ID NO: 7627 - RNA, 17 nt, Artificial Sequence
  Synthetic
guucgugcgcgacgcgc

SEQ ID NO: 7628 - RNA, 17 nt, Artificial Sequence
  Synthetic
cgcgcagguccccgcgc

SEQ ID NO: 7629 - RNA, 17 nt, Artificial Sequence
  Synthetic
gccggccaccgccgcgc

SEQ ID NO: 7630 - RNA, 17 nt, Artificial Sequence
  Synthetic
ucggccgcgggccgcgc

SEQ ID NO: 7631 - RNA, 17 nt, Artificial Sequence
  Synthetic
cuggccgcgggccgcgc

SEQ ID NO: 7632 - RNA, 17 nt, Artificial Sequence
  Synthetic
cgcgcccgccuccgcgc

SEQ ID NO: 7633 - RNA, 17 nt, Artificial Sequence
  Synthetic
ggcccgccuccgcgcgc

SEQ ID NO: 7634 - RNA, 17 nt, Artificial Sequence
  Synthetic
caggccccagcgcgcgc

SEQ ID NO: 7635 - RNA, 17 nt, Artificial Sequence
  Synthetic
gcgaggccagcgcgcgc

SEQ ID NO: 7636 - RNA, 17 nt, Artificial Sequence
  Synthetic
guucgacccgcgcgcgc

SEQ ID NO: 7637 - RNA, 17 nt, Artificial Sequence
  Synthetic
accgcgccugcgcgcgc

SEQ ID NO: 7638 - RNA, 17 nt, Artificial Sequence
  Synthetic
cgcgcagccaggcgcgc

SEQ ID NO: 7639 - RNA, 17 nt, Artificial Sequence
  Synthetic
cauggcgcccggcgcgc

SEQ ID NO: 7640 - RNA, 17 nt, Artificial Sequence
  Synthetic
gcagaaguccggcgcgc

SEQ ID NO: 7641 - RNA, 17 nt, Artificial Sequence
  Synthetic
gccggcggggggcgcgc

SEQ ID NO: 7642 - RNA, 17 nt, Artificial Sequence
  Synthetic
cucggcgcugggcgcgc

SEQ ID NO: 7643 - RNA, 17 nt, Artificial Sequence
  Synthetic
gcgggaguucugcgcgc

SEQ ID NO: 7644 - RNA, 17 nt, Artificial Sequence
  Synthetic
cgcggcgguacucgcgc

SEQ ID NO: 7645 - RNA, 17 nt, Artificial Sequence
  Synthetic
gcgcgcguagaaggcgc

SEQ ID NO: 7646 - RNA, 17 nt, Artificial Sequence
  Synthetic
cggagcucagcaggcgc

SEQ ID NO: 7647 - RNA, 17 nt, Artificial Sequence
  Synthetic
gcggcggucgcaggcgc

SEQ ID NO: 7648 - RNA, 17 nt, Artificial Sequence
  Synthetic
cgaggcggaggaggcgc

SEQ ID NO: 7649 - RNA, 17 nt, Artificial Sequence
  Synthetic
cgggauccuggaggcgc

SEQ ID NO: 7650 - RNA, 17 nt, Artificial Sequence
  Synthetic
gccgggcgccacggcgc

SEQ ID NO: 7651 - RNA, 17 nt, Artificial Sequence
  Synthetic
caggaacuccacggcgc

SEQ ID NO: 7652 - RNA, 17 nt, Artificial Sequence
  Synthetic
gacgacgacgacggcgc

SEQ ID NO: 7653 - RNA, 17 nt, Artificial Sequence
  Synthetic
cgccgugcucccggcgc

SEQ ID NO: 7654 - RNA, 17 nt, Artificial Sequence
  Synthetic
gcgcguaggcgcggcgc

SEQ ID NO: 7655 - RNA, 17 nt, Artificial Sequence
  Synthetic
gcgcuggccggcggcgc

SEQ ID NO: 7656 - RNA, 17 nt, Artificial Sequence
  Synthetic
ggcguggucugcggcgc

SEQ ID NO: 7657 - RNA, 17 nt, Artificial Sequence
  Synthetic
ccagcacggugcggcgc

SEQ ID NO: 7658 - RNA, 17 nt, Artificial Sequence
  Synthetic
ccccgacgucucggcgc

SEQ ID NO: 7659 - RNA, 17 nt, Artificial Sequence
  Synthetic
gcggcggccgagggcgc

SEQ ID NO: 7660 - RNA, 17 nt, Artificial Sequence
  Synthetic
ggcgcccacacgggcgc

SEQ ID NO: 7661 - RNA, 17 nt, Artificial Sequence
  Synthetic
ccgcgggccccgggcgc

SEQ ID NO: 7662 - RNA, 17 nt, Artificial Sequence
  Synthetic
gccgccgccucgggcgc

SEQ ID NO: 7663 - RNA, 17 nt, Artificial Sequence
  Synthetic
uggugucggcggggcgc

SEQ ID NO: 7664 - RNA, 17 nt, Artificial Sequence
  Synthetic
cggccagcagggggcgc

SEQ ID NO: 7665 - RNA, 17 nt, Artificial Sequence
  Synthetic
ggcgcuggcgggggcgc

SEQ ID NO: 7666 - RNA, 17 nt, Artificial Sequence
  Synthetic
cgagacgucgggggcgc

SEQ ID NO: 7667 - RNA, 17 nt, Artificial Sequence
  Synthetic
ucuucuucggggggcgc

SEQ ID NO: 7668 - RNA, 17 nt, Artificial Sequence
  Synthetic
gcccggggacguggcgc

SEQ ID NO: 7669 - RNA, 17 nt, Artificial Sequence
  Synthetic
gcccgucuacguggcgc

SEQ ID NO: 7670 - RNA, 17 nt, Artificial Sequence
  Synthetic
cuccggcagcguggcgc

SEQ ID NO: 7671 - RNA, 17 nt, Artificial Sequence
  Synthetic
ugcugaugcgccugcgc

SEQ ID NO: 7672 - RNA, 17 nt, Artificial Sequence
  Synthetic
gcccggcggagcugcgc

SEQ ID NO: 7673 - RNA, 17 nt, Artificial Sequence
  Synthetic
ugcagugcgccgugcgc

SEQ ID NO: 7674 - RNA, 17 nt, Artificial Sequence
  Synthetic
ggcgggcagcaccucgc

SEQ ID NO: 7675 - RNA, 17 nt, Artificial Sequence
  Synthetic
gcccccggggcccucgc

SEQ ID NO: 7676 - RNA, 17 nt, Artificial Sequence
  Synthetic
gcgcgcgcuggccucgc

SEQ ID NO: 7677 - RNA, 17 nt, Artificial Sequence
  Synthetic
gucggcggcggcgucgc

SEQ ID NO: 7678 - RNA, 17 nt, Artificial Sequence
  Synthetic
gaugaggcggcggucgc

SEQ ID NO: 7679 - RNA, 17 nt, Artificial Sequence
  Synthetic
gccgugagccuggucgc

SEQ ID NO: 7680 - RNA, 17 nt, Artificial Sequence
  Synthetic
cgggaccuggccuucgc

SEQ ID NO: 7681 - RNA, 17 nt, Artificial Sequence
  Synthetic
gggucgcggcgacaggc

SEQ ID NO: 7682 - RNA, 17 nt, Artificial Sequence
  Synthetic
cagggccgccagcaggc

SEQ ID NO: 7683 - RNA, 17 nt, Artificial Sequence
  Synthetic
cagccaggcgcgcaggc

SEQ ID NO: 7684 - RNA, 17 nt, Artificial Sequence
  Synthetic
guaggcgcggcgcaggc

SEQ ID NO: 7685 - RNA, 17 nt, Artificial Sequence
  Synthetic
gggcgccccccagaggc

SEQ ID NO: 7686 - RNA, 17 nt, Artificial Sequence
  Synthetic
gcggacgacgaggaggc

SEQ ID NO: 7687 - RNA, 17 nt, Artificial Sequence
  Synthetic
ggccggcgcgcggaggc

SEQ ID NO: 7688 - RNA, 17 nt, Artificial Sequence
  Synthetic
ccggccggcgcggaggc

SEQ ID NO: 7689 - RNA, 17 nt, Artificial Sequence
  Synthetic
ucccgcggcgcggaggc

SEQ ID NO: 7690 - RNA, 17 nt, Artificial Sequence
  Synthetic
acggcgcacugcacggc

SEQ ID NO: 7691 - RNA, 17 nt, Artificial Sequence
  Synthetic
acgggccgcuucacggc

SEQ ID NO: 7692 - RNA, 17 nt, Artificial Sequence
  Synthetic
ucccggcgcuggacggc

SEQ ID NO: 7693 - RNA, 17 nt, Artificial Sequence
  Synthetic
ggcgcgugcuguacggc

SEQ ID NO: 7694 - RNA, 17 nt, Artificial Sequence
  Synthetic
ggccgggcggccccggc

SEQ ID NO: 7695 - RNA, 17 nt, Artificial Sequence
  Synthetic
ucgucgucggccccggc

SEQ ID NO: 7696 - RNA, 17 nt, Artificial Sequence
  Synthetic
gcggcgccguagccggc

SEQ ID NO: 7697 - RNA, 17 nt, Artificial Sequence
  Synthetic
ggcggccgagcgccggc

SEQ ID NO: 7698 - RNA, 17 nt, Artificial Sequence
  Synthetic
cccgccuccgcgccggc

SEQ ID NO: 7699 - RNA, 17 nt, Artificial Sequence
  Synthetic
gcccucggcgggccggc

SEQ ID NO: 7700 - RNA, 17 nt, Artificial Sequence
  Synthetic
cggcccgaacacgcggc

SEQ ID NO: 7701 - RNA, 17 nt, Artificial Sequence
  Synthetic
cuccaggaucccgcggc

SEQ ID NO: 7702 - RNA, 17 nt, Artificial Sequence
  Synthetic
gcugcgcgggccgcggc

SEQ ID NO: 7703 - RNA, 17 nt, Artificial Sequence
  Synthetic
acggugcuggccgcggc

SEQ ID NO: 7704 - RNA, 17 nt, Artificial Sequence
  Synthetic
gguccgccgagcgcggc

SEQ ID NO: 7705 - RNA, 17 nt, Artificial Sequence
  Synthetic
gggcgcgggggcgcggc

SEQ ID NO: 7706 - RNA, 17 nt, Artificial Sequence
  Synthetic
gcccguggcgucgcggc

SEQ ID NO: 7707 - RNA, 17 nt, Artificial Sequence
  Synthetic
agcgggccgaaggcggc

SEQ ID NO: 7708 - RNA, 17 nt, Artificial Sequence
  Synthetic
ggcugggccccggcggc

SEQ ID NO: 7709 - RNA, 17 nt, Artificial Sequence
  Synthetic
ggggcggcggcggcggc

SEQ ID NO: 7710 - RNA, 17 nt, Artificial Sequence
  Synthetic
gcggugguggcggcggc

SEQ ID NO: 7711 - RNA, 17 nt, Artificial Sequence
  Synthetic
ccgacccgcagggcggc

SEQ ID NO: 7712 - RNA, 17 nt, Artificial Sequence
  Synthetic
ggguacgccauggcggc

SEQ ID NO: 7713 - RNA, 17 nt, Artificial Sequence
  Synthetic
gcgcgucggcgugcggc

SEQ ID NO: 7714 - RNA, 17 nt, Artificial Sequence
  Synthetic
gggucggggcccucggc

SEQ ID NO: 7715 - RNA, 17 nt, Artificial Sequence
  Synthetic
cccugggcgggcucggc

SEQ ID NO: 7716 - RNA, 17 nt, Artificial Sequence
  Synthetic
accacgggcccgucggc

SEQ ID NO: 7717 - RNA, 17 nt, Artificial Sequence
  Synthetic
gcggcggcggcgucggc

SEQ ID NO: 7718 - RNA, 17 nt, Artificial Sequence
  Synthetic
accgcgcgcucgucggc

SEQ ID NO: 7719 - RNA, 17 nt, Artificial Sequence
  Synthetic
guggugguggugucggc

SEQ ID NO: 7720 - RNA, 17 nt, Artificial Sequence
  Synthetic
cggcgggccgcuucggc

SEQ ID NO: 7721 - RNA, 17 nt, Artificial Sequence
  Synthetic
gggucgaacaugagggc

SEQ ID NO: 7722 - RNA, 17 nt, Artificial Sequence
  Synthetic
gccgcggggguccgggc

SEQ ID NO: 7723 - RNA, 17 nt, Artificial Sequence
  Synthetic
cagaccacgccgcgggc

SEQ ID NO: 7724 - RNA, 17 nt, Artificial Sequence
  Synthetic
cgugcuguacggcgggc

SEQ ID NO: 7725 - RNA, 17 nt, Artificial Sequence
  Synthetic
gcgggggcgcggcgggc

SEQ ID NO: 7726 - RNA, 17 nt, Artificial Sequence
  Synthetic
cggggcccucggcgggc

SEQ ID NO: 7727 - RNA, 17 nt, Artificial Sequence
  Synthetic
cggccgcguguucgggc

SEQ ID NO: 7728 - RNA, 17 nt, Artificial Sequence
  Synthetic
gagccguggcccggggc

SEQ ID NO: 7729 - RNA, 17 nt, Artificial Sequence
  Synthetic
gggguccgggccggggc

SEQ ID NO: 7730 - RNA, 17 nt, Artificial Sequence
  Synthetic
ggcgcccuggccggggc

SEQ ID NO: 7731 - RNA, 17 nt, Artificial Sequence
  Synthetic
ggcggccgugccggggc

SEQ ID NO: 7732 - RNA, 17 nt, Artificial Sequence
  Synthetic
ggggaccgccgcggggc

SEQ ID NO: 7733 - RNA, 17 nt, Artificial Sequence
  Synthetic
aggggcggccgcggggc

SEQ ID NO: 7734 - RNA, 17 nt, Artificial Sequence
  Synthetic
ggcggcgucggcggggc

SEQ ID NO: 7735 - RNA, 17 nt, Artificial Sequence
  Synthetic
gcacgcgccccgggggc

SEQ ID NO: 7736 - RNA, 17 nt, Artificial Sequence
  Synthetic
cgggccgcgccgggggc

SEQ ID NO: 7737 - RNA, 17 nt, Artificial Sequence
  Synthetic
agcguaucugcgggggc

SEQ ID NO: 7738 - RNA, 17 nt, Artificial Sequence
  Synthetic
gcgcgccgccggggggc

SEQ ID NO: 7739 - RNA, 17 nt, Artificial Sequence
  Synthetic
ccccgggggcggggggc

SEQ ID NO: 7740 - RNA, 17 nt, Artificial Sequence
  Synthetic
cgggcucggcccugggc

SEQ ID NO: 7741 - RNA, 17 nt, Artificial Sequence
  Synthetic
gccacggccgccugggc

SEQ ID NO: 7742 - RNA, 17 nt, Artificial Sequence
  Synthetic
cccggcggcgcccuggc

SEQ ID NO: 7743 - RNA, 17 nt, Artificial Sequence
  Synthetic
uggucugcggcgcuggc

SEQ ID NO: 7744 - RNA, 17 nt, Artificial Sequence
  Synthetic
gugcgccgugcgcuggc

SEQ ID NO: 7745 - RNA, 17 nt, Artificial Sequence
  Synthetic
gccgugccggggcuggc

SEQ ID NO: 7746 - RNA, 17 nt, Artificial Sequence
  Synthetic
uuccuggggcugcuggc

SEQ ID NO: 7747 - RNA, 17 nt, Artificial Sequence
  Synthetic
gcccaggcggccguggc

SEQ ID NO: 7748 - RNA, 17 nt, Artificial Sequence
  Synthetic
ggggaccugcgcguggc

SEQ ID NO: 7749 - RNA, 17 nt, Artificial Sequence
  Synthetic
gcccgcgcggcgguggc

SEQ ID NO: 7750 - RNA, 17 nt, Artificial Sequence
  Synthetic
gggcgccggcguguggc

SEQ ID NO: 7751 - RNA, 17 nt, Artificial Sequence
  Synthetic
gagccugcgcccccugc

SEQ ID NO: 7752 - RNA, 17 nt, Artificial Sequence
  Synthetic
cgccuacgcgccccugc

SEQ ID NO: 7753 - RNA, 17 nt, Artificial Sequence
  Synthetic
ggcgccagccgcccugc

SEQ ID NO: 7754 - RNA, 17 nt, Artificial Sequence
  Synthetic
cgggcuguccugccugc

SEQ ID NO: 7755 - RNA, 17 nt, Artificial Sequence
  Synthetic
ggcccgcgccacgcugc

SEQ ID NO: 7756 - RNA, 17 nt, Artificial Sequence
  Synthetic
ccucuacucgccgcugc

SEQ ID NO: 7757 - RNA, 17 nt, Artificial Sequence
  Synthetic
ggaguuccuggggcugc

SEQ ID NO: 7758 - RNA, 17 nt, Artificial Sequence
  Synthetic
acgcccagcguaucugc

SEQ ID NO: 7759 - RNA, 17 nt, Artificial Sequence
  Synthetic
ugggcaaccggcucugc

SEQ ID NO: 7760 - RNA, 17 nt, Artificial Sequence
  Synthetic
ccugcgccgcaccgugc

SEQ ID NO: 7761 - RNA, 17 nt, Artificial Sequence
  Synthetic
cgaccuggcggccgugc

SEQ ID NO: 7762 - RNA, 17 nt, Artificial Sequence
  Synthetic
ccgcgcggggacggugc

SEQ ID NO: 7763 - RNA, 17 nt, Artificial Sequence
  Synthetic
ucugacucaucaaaauc

SEQ ID NO: 7764 - RNA, 17 nt, Artificial Sequence
  Synthetic
gcgccgcgcccgagauc

SEQ ID NO: 7765 - RNA, 17 nt, Artificial Sequence
  Synthetic
cgccgacgacgaggauc

SEQ ID NO: 7766 - RNA, 17 nt, Artificial Sequence
  Synthetic
acagcagccgcgugauc

SEQ ID NO: 7767 - RNA, 17 nt, Artificial Sequence
  Synthetic
cgcucggcggaccacuc

SEQ ID NO: 7768 - RNA, 17 nt, Artificial Sequence
  Synthetic
ggccgggccgccgccuc

SEQ ID NO: 7769 - RNA, 17 nt, Artificial Sequence
  Synthetic
cgcgccuccuccgccuc

SEQ ID NO: 7770 - RNA, 17 nt, Artificial Sequence
  Synthetic
ggcccgcugcgcgccuc

SEQ ID NO: 7771 - RNA, 17 nt, Artificial Sequence
  Synthetic
gcccgguucgaggccuc

SEQ ID NO: 7772 - RNA, 17 nt, Artificial Sequence
  Synthetic
acagccgccccggccuc

SEQ ID NO: 7773 - RNA, 17 nt, Artificial Sequence
  Synthetic
gacgccgacgcggccuc

SEQ ID NO: 7774 - RNA, 17 nt, Artificial Sequence
  Synthetic
cgcaccgugcuggccuc

SEQ ID NO: 7775 - RNA, 17 nt, Artificial Sequence
  Synthetic
accacgcgcacguccuc

SEQ ID NO: 7776 - RNA, 17 nt, Artificial Sequence
  Synthetic
gccgcgucgcccagcuc

SEQ ID NO: 7777 - RNA, 17 nt, Artificial Sequence
  Synthetic
aggcgggcgcggcgcuc

SEQ ID NO: 7778 - RNA, 17 nt, Artificial Sequence
  Synthetic
gcagggggcgcaggcuc

SEQ ID NO: 7779 - RNA, 17 nt, Artificial Sequence
  Synthetic
cgcggcgggccgggcuc

SEQ ID NO: 7780 - RNA, 17 nt, Artificial Sequence
  Synthetic
agcagcuccuucaucuc

SEQ ID NO: 7781 - RNA, 17 nt, Artificial Sequence
  Synthetic
gccugcuuccggaucuc

SEQ ID NO: 7782 - RNA, 17 nt, Artificial Sequence
  Synthetic
accgcggacgucgucuc

SEQ ID NO: 7783 - RNA, 17 nt, Artificial Sequence
  Synthetic
ucguccucgcagaaguc

SEQ ID NO: 7784 - RNA, 17 nt, Artificial Sequence
  Synthetic
cccagcgccgagacguc

SEQ ID NO: 7785 - RNA, 17 nt, Artificial Sequence
  Synthetic
gggggcgcgucgccguc

SEQ ID NO: 7786 - RNA, 17 nt, Artificial Sequence
  Synthetic
cccaucgccuccgcguc

SEQ ID NO: 7787 - RNA, 17 nt, Artificial Sequence
  Synthetic
cgcagcggcggcgcguc

SEQ ID NO: 7788 - RNA, 17 nt, Artificial Sequence
  Synthetic
gcgucgccgccgucguc

SEQ ID NO: 7789 - RNA, 17 nt, Artificial Sequence
  Synthetic
cgcacguccuccggguc

SEQ ID NO: 7790 - RNA, 17 nt, Artificial Sequence
  Synthetic
cagccgcccugcggguc

SEQ ID NO: 7791 - RNA, 17 nt, Artificial Sequence
  Synthetic
cggucgccgcggggguc

SEQ ID NO: 7792 - RNA, 17 nt, Artificial Sequence
  Synthetic
aggcuggccaugggguc

SEQ ID NO: 7793 - RNA, 17 nt, Artificial Sequence
  Synthetic
augggcaccagcguguc

SEQ ID NO: 7794 - RNA, 17 nt, Artificial Sequence
  Synthetic
uggaccaggccugcuuc

SEQ ID NO: 7795 - RNA, 17 nt, Artificial Sequence
  Synthetic
ccgcgcggcucuucuuc

SEQ ID NO: 7796 - RNA, 17 nt, Artificial Sequence
  Synthetic
gcgccacgcgcggguuc

SEQ ID NO: 7797 - RNA, 17 nt, Artificial Sequence
  Synthetic
ggcgcaggcucugguuc

SEQ ID NO: 7798 - RNA, 17 nt, Artificial Sequence
  Synthetic
ccuccggccgcguguuc

SEQ ID NO: 7799 - RNA, 17 nt, Artificial Sequence
  Synthetic
ccaggccccagccgaag

SEQ ID NO: 7800 - RNA, 17 nt, Artificial Sequence
  Synthetic
gccgcccggccgugaag

SEQ ID NO: 7801 - RNA, 17 nt, Artificial Sequence
  Synthetic
ucgucgcgcagcaccag

SEQ ID NO: 7802 - RNA, 17 nt, Artificial Sequence
  Synthetic
ccgguccgcggacccag

SEQ ID NO: 7803 - RNA, 17 nt, Artificial Sequence
  Synthetic
ccucgggcgccccccag

SEQ ID NO: 7804 - RNA, 17 nt, Artificial Sequence
  Synthetic
uucucgcgcgccagcag

SEQ ID NO: 7805 - RNA, 17 nt, Artificial Sequence
  Synthetic
acggugucggccagcag

SEQ ID NO: 7806 - RNA, 17 nt, Artificial Sequence
  Synthetic
acguagacgggccgcag

SEQ ID NO: 7807 - RNA, 17 nt, Artificial Sequence
  Synthetic
gggcccgaggcgcgcag

SEQ ID NO: 7808 - RNA, 17 nt, Artificial Sequence
  Synthetic
ccgcggcagaggcgcag

SEQ ID NO: 7809 - RNA, 17 nt, Artificial Sequence
  Synthetic
gccgccgcgcggcgcag

SEQ ID NO: 7810 - RNA, 17 nt, Artificial Sequence
  Synthetic
agguccucgcccggcag

SEQ ID NO: 7811 - RNA, 17 nt, Artificial Sequence
  Synthetic
cguuggccccgcggcag

SEQ ID NO: 7812 - RNA, 17 nt, Artificial Sequence
  Synthetic
ggauuuugaugagucag

SEQ ID NO: 7813 - RNA, 17 nt, Artificial Sequence
  Synthetic
cgcgacggguacgucag

SEQ ID NO: 7814 - RNA, 17 nt, Artificial Sequence
  Synthetic
cacggcgcggggaagag

SEQ ID NO: 7815 - RNA, 17 nt, Artificial Sequence
  Synthetic
gcgggccccccccggag

SEQ ID NO: 7816 - RNA, 17 nt, Artificial Sequence
  Synthetic
cgcggcccccgcgggag

SEQ ID NO: 7817 - RNA, 17 nt, Artificial Sequence
  Synthetic
ccggcagcggcgaguag

SEQ ID NO: 7818 - RNA, 17 nt, Artificial Sequence
  Synthetic
ucugcgcgcggucguag

SEQ ID NO: 7819 - RNA, 17 nt, Artificial Sequence
  Synthetic
cgccgccgacggcaacg

SEQ ID NO: 7820 - RNA, 17 nt, Artificial Sequence
  Synthetic
gcuggcgcgcgagaacg

SEQ ID NO: 7821 - RNA, 17 nt, Artificial Sequence
  Synthetic
cccccggcccgaacacg

SEQ ID NO: 7822 - RNA, 17 nt, Artificial Sequence
  Synthetic
ggcacuccacggccacg

SEQ ID NO: 7823 - RNA, 17 nt, Artificial Sequence
  Synthetic
ugcugcugcuguccacg

SEQ ID NO: 7824 - RNA, 17 nt, Artificial Sequence
  Synthetic
cuggggccuggcgcacg

SEQ ID NO: 7825 - RNA, 17 nt, Artificial Sequence
  Synthetic
cgaagcgcgugcgcacg

SEQ ID NO: 7826 - RNA, 17 nt, Artificial Sequence
  Synthetic
aguacgcccugaucacg

SEQ ID NO: 7827 - RNA, 17 nt, Artificial Sequence
  Synthetic
ggaggcggaugcagacg

SEQ ID NO: 7828 - RNA, 17 nt, Artificial Sequence
  Synthetic
gucgucgucgucagacg

SEQ ID NO: 7829 - RNA, 17 nt, Artificial Sequence
  Synthetic
ggaggacgccgacgacg

SEQ ID NO: 7830 - RNA, 17 nt, Artificial Sequence
  Synthetic
ggugcugcgcgacgacg

SEQ ID NO: 7831 - RNA, 17 nt, Artificial Sequence
  Synthetic
ccucggcgcggacgacg

SEQ ID NO: 7832 - RNA, 17 nt, Artificial Sequence
  Synthetic
cgagcuggacgccgacg

SEQ ID NO: 7833 - RNA, 17 nt, Artificial Sequence
  Synthetic
ugacgacgaccgcgacg

SEQ ID NO: 7834 - RNA, 17 nt, Artificial Sequence
  Synthetic
gcccgagcugggcgacg

SEQ ID NO: 7835 - RNA, 17 nt, Artificial Sequence
  Synthetic
ggacuucugcgaggacg

SEQ ID NO: 7836 - RNA, 17 nt, Artificial Sequence
  Synthetic
gcuguacacgccggacg

SEQ ID NO: 7837 - RNA, 17 nt, Artificial Sequence
  Synthetic
gcgcgacgacgcggacg

SEQ ID NO: 7838 - RNA, 17 nt, Artificial Sequence
  Synthetic
cguggcgcccggggacg

SEQ ID NO: 7839 - RNA, 17 nt, Artificial Sequence
  Synthetic
gcccguggacauggacg

SEQ ID NO: 7840 - RNA, 17 nt, Artificial Sequence
  Synthetic
gcugcggcccgucuacg

SEQ ID NO: 7841 - RNA, 17 nt, Artificial Sequence
  Synthetic
gacccccgcggcgaccg

SEQ ID NO: 7842 - RNA, 17 nt, Artificial Sequence
  Synthetic
guacgccccgcggaccg

SEQ ID NO: 7843 - RNA, 17 nt, Artificial Sequence
  Synthetic
gaacgcggcgcugaccg

SEQ ID NO: 7844 - RNA, 17 nt, Artificial Sequence
  Synthetic
ggcggcgagcacccccg

SEQ ID NO: 7845 - RNA, 17 nt, Artificial Sequence
  Synthetic
cccggcccggacccccg

SEQ ID NO: 7846 - RNA, 17 nt, Artificial Sequence
  Synthetic
ccggccccccgcccccg

SEQ ID NO: 7847 - RNA, 17 nt, Artificial Sequence
  Synthetic
ccggggcgccgcccccg

SEQ ID NO: 7848 - RNA, 17 nt, Artificial Sequence
  Synthetic
ggggggcgcggcccccg

SEQ ID NO: 7849 - RNA, 17 nt, Artificial Sequence
  Synthetic
cggcguggccagccccg

SEQ ID NO: 7850 - RNA, 17 nt, Artificial Sequence
  Synthetic
gguccggguacgccccg

SEQ ID NO: 7851 - RNA, 17 nt, Artificial Sequence
  Synthetic
ggacgccccccgccccg

SEQ ID NO: 7852 - RNA, 17 nt, Artificial Sequence
  Synthetic
guacagcacgcgccccg

SEQ ID NO: 7853 - RNA, 17 nt, Artificial Sequence
  Synthetic
gcggccgccgcgccccg

SEQ ID NO: 7854 - RNA, 17 nt, Artificial Sequence
  Synthetic
aggccuacugcgccccg

SEQ ID NO: 7855 - RNA, 17 nt, Artificial Sequence
  Synthetic
ugcccgcgagggccccg

SEQ ID NO: 7856 - RNA, 17 nt, Artificial Sequence
  Synthetic
accgcacguuggccccg

SEQ ID NO: 7857 - RNA, 17 nt, Artificial Sequence
  Synthetic
gccgaggcgcgagcccg

SEQ ID NO: 7858 - RNA, 17 nt, Artificial Sequence
  Synthetic
gacggcgacgacgcccg

SEQ ID NO: 7859 - RNA, 17 nt, Artificial Sequence
  Synthetic
gccgagggucccgcccg

SEQ ID NO: 7860 - RNA, 17 nt, Artificial Sequence
  Synthetic
ccgcgcccccgcgcccg

SEQ ID NO: 7861 - RNA, 17 nt, Artificial Sequence
  Synthetic
ggcgucgcccgcgcccg

SEQ ID NO: 7862 - RNA, 17 nt, Artificial Sequence
  Synthetic
cggggcggccgcgcccg

SEQ ID NO: 7863 - RNA, 17 nt, Artificial Sequence
  Synthetic
gggcgccggggcgcccg

SEQ ID NO: 7864 - RNA, 17 nt, Artificial Sequence
  Synthetic
ccucuggggggcgcccg

SEQ ID NO: 7865 - RNA, 17 nt, Artificial Sequence
  Synthetic
cccgcgcguggcgcccg

SEQ ID NO: 7866 - RNA, 17 nt, Artificial Sequence
  Synthetic
agcucggccacggcccg

SEQ ID NO: 7867 - RNA, 17 nt, Artificial Sequence
  Synthetic
ggccgugaagcggcccg

SEQ ID NO: 7868 - RNA, 17 nt, Artificial Sequence
  Synthetic
cguccccgcgcggcccg

SEQ ID NO: 7869 - RNA, 17 nt, Artificial Sequence
  Synthetic
gcccccggcgcggcccg

SEQ ID NO: 7870 - RNA, 17 nt, Artificial Sequence
  Synthetic
gcgcuccaggcggcccg

SEQ ID NO: 7871 - RNA, 17 nt, Artificial Sequence
  Synthetic
gcccgccgacgggcccg

SEQ ID NO: 7872 - RNA, 17 nt, Artificial Sequence
  Synthetic
gcggcgcagcgggcccg

SEQ ID NO: 7873 - RNA, 17 nt, Artificial Sequence
  Synthetic
cccgcgcccggggcccg

SEQ ID NO: 7874 - RNA, 17 nt, Artificial Sequence
  Synthetic
cggggagccguggcccg

SEQ ID NO: 7875 - RNA, 17 nt, Artificial Sequence
  Synthetic
gcgccuccaggaucccg

SEQ ID NO: 7876 - RNA, 17 nt, Artificial Sequence
  Synthetic
cgcggccgccccucccg

SEQ ID NO: 7877 - RNA, 17 nt, Artificial Sequence
  Synthetic
cgcuugcgcgccucccg

SEQ ID NO: 7878 - RNA, 17 nt, Artificial Sequence
  Synthetic
cggcggcgggcuucccg

SEQ ID NO: 7879 - RNA, 17 nt, Artificial Sequence
  Synthetic
acgucagcggggagccg

SEQ ID NO: 7880 - RNA, 17 nt, Artificial Sequence
  Synthetic
cgccgcagaccacgccg

SEQ ID NO: 7881 - RNA, 17 nt, Artificial Sequence
  Synthetic
ggugguggggaccgccg

SEQ ID NO: 7882 - RNA, 17 nt, Artificial Sequence
  Synthetic
uccagcucgacccgccg

SEQ ID NO: 7883 - RNA, 17 nt, Artificial Sequence
  Synthetic
cacgccgccgcccgccg

SEQ ID NO: 7884 - RNA, 17 nt, Artificial Sequence
  Synthetic
gacccgccggcccgccg

SEQ ID NO: 7885 - RNA, 17 nt, Artificial Sequence
  Synthetic
gcgcagaacucccgccg

SEQ ID NO: 7886 - RNA, 17 nt, Artificial Sequence
  Synthetic
ggcgccgccagccgccg

SEQ ID NO: 7887 - RNA, 17 nt, Artificial Sequence
  Synthetic
ggcuggccacgccgccg

SEQ ID NO: 7888 - RNA, 17 nt, Artificial Sequence
  Synthetic
cgccgacgccgccgccg

SEQ ID NO: 7889 - RNA, 17 nt, Artificial Sequence
  Synthetic
cgccgccgccgccgccg

SEQ ID NO: 7890 - RNA, 17 nt, Artificial Sequence
  Synthetic
cggcgggcgcgccgccg

SEQ ID NO: 7891 - RNA, 17 nt, Artificial Sequence
  Synthetic
cggcagcgaggccgccg

SEQ ID NO: 7892 - RNA, 17 nt, Artificial Sequence
  Synthetic
gcacguggcggccgccg

SEQ ID NO: 7893 - RNA, 17 nt, Artificial Sequence
  Synthetic
ccggcgggucagcgccg

SEQ ID NO: 7894 - RNA, 17 nt, Artificial Sequence
  Synthetic
cgcucuuccccgcgccg

SEQ ID NO: 7895 - RNA, 17 nt, Artificial Sequence
  Synthetic
ggccgcgggccgcgccg

SEQ ID NO: 7896 - RNA, 17 nt, Artificial Sequence
  Synthetic
cgcccgccuccgcgccg

SEQ ID NO: 7897 - RNA, 17 nt, Artificial Sequence
  Synthetic
ccucgucguccgcgccg

SEQ ID NO: 7898 - RNA, 17 nt, Artificial Sequence
  Synthetic
caacgccgugcgcgccg

SEQ ID NO: 7899 - RNA, 17 nt, Artificial Sequence
  Synthetic
cgccggcuacggcgccg

SEQ ID NO: 7900 - RNA, 17 nt, Artificial Sequence
  Synthetic
ggccuucgccggcgccg

SEQ ID NO: 7901 - RNA, 17 nt, Artificial Sequence
  Synthetic
cgcccacacgggcgccg

SEQ ID NO: 7902 - RNA, 17 nt, Artificial Sequence
  Synthetic
gugucggcggggcgccg

SEQ ID NO: 7903 - RNA, 17 nt, Artificial Sequence
  Synthetic
ggccgacaccgucgccg

SEQ ID NO: 7904 - RNA, 17 nt, Artificial Sequence
  Synthetic
gcggcccgcggucgccg

SEQ ID NO: 7905 - RNA, 17 nt, Artificial Sequence
  Synthetic
cgugagccuggucgccg

SEQ ID NO: 7906 - RNA, 17 nt, Artificial Sequence
  Synthetic
gcgccccccagaggccg

SEQ ID NO: 7907 - RNA, 17 nt, Artificial Sequence
  Synthetic
cgccuccgcgccggccg

SEQ ID NO: 7908 - RNA, 17 nt, Artificial Sequence
  Synthetic
gcccgcccaggcggccg

SEQ ID NO: 7909 - RNA, 17 nt, Artificial Sequence
  Synthetic
gcggggcgcggcggccg

SEQ ID NO: 7910 - RNA, 17 nt, Artificial Sequence
  Synthetic
cuccagggcggcggccg

SEQ ID NO: 7911 - RNA, 17 nt, Artificial Sequence
  Synthetic
cgcgggaggggcggccg

SEQ ID NO: 7912 - RNA, 17 nt, Artificial Sequence
  Synthetic
cugggcgggcucggccg

SEQ ID NO: 7913 - RNA, 17 nt, Artificial Sequence
  Synthetic
ggcgagcgagucggccg

SEQ ID NO: 7914 - RNA, 17 nt, Artificial Sequence
  Synthetic
acgcugggcgucggccg

SEQ ID NO: 7915 - RNA, 17 nt, Artificial Sequence
  Synthetic
cgcggggguccgggccg

SEQ ID NO: 7916 - RNA, 17 nt, Artificial Sequence
  Synthetic
cugcgccccgcgggccg

SEQ ID NO: 7917 - RNA, 17 nt, Artificial Sequence
  Synthetic
cggagcugcgcgggccg

SEQ ID NO: 7918 - RNA, 17 nt, Artificial Sequence
  Synthetic
gccgcguguucgggccg

SEQ ID NO: 7919 - RNA, 17 nt, Artificial Sequence
  Synthetic
gggcgaggaccuggccg

SEQ ID NO: 7920 - RNA, 17 nt, Artificial Sequence
  Synthetic
cggcggcgcccuggccg

SEQ ID NO: 7921 - RNA, 17 nt, Artificial Sequence
  Synthetic
ggggacggugcuggccg

SEQ ID NO: 7922 - RNA, 17 nt, Artificial Sequence
  Synthetic
ggcgggccgcguggccg

SEQ ID NO: 7923 - RNA, 17 nt, Artificial Sequence
  Synthetic
ugccuggccgccugccg

SEQ ID NO: 7924 - RNA, 17 nt, Artificial Sequence
  Synthetic
ugggcccggcgcugccg

SEQ ID NO: 7925 - RNA, 17 nt, Artificial Sequence
  Synthetic
ccgcugcgccucugccg

SEQ ID NO: 7926 - RNA, 17 nt, Artificial Sequence
  Synthetic
accuggcggccgugccg

SEQ ID NO: 7927 - RNA, 17 nt, Artificial Sequence
  Synthetic
cucggcggaccacuccg

SEQ ID NO: 7928 - RNA, 17 nt, Artificial Sequence
  Synthetic
agcaggcgcgggcuccg

SEQ ID NO: 7929 - RNA, 17 nt, Artificial Sequence
  Synthetic
gucggcgggccaguccg

SEQ ID NO: 7930 - RNA, 17 nt, Artificial Sequence
  Synthetic
accggagacgacguccg

SEQ ID NO: 7931 - RNA, 17 nt, Artificial Sequence
  Synthetic
cuggaagagcagguccg

SEQ ID NO: 7932 - RNA, 17 nt, Artificial Sequence
  Synthetic
acgucgucuccgguccg

SEQ ID NO: 7933 - RNA, 17 nt, Artificial Sequence
  Synthetic
acgacguccgcgguccg

SEQ ID NO: 7934 - RNA, 17 nt, Artificial Sequence
  Synthetic
gcgggccgcuggguccg

SEQ ID NO: 7935 - RNA, 17 nt, Artificial Sequence
  Synthetic
gucgcgcagcaccagcg

SEQ ID NO: 7936 - RNA, 17 nt, Artificial Sequence
  Synthetic
gcagcgcgcggccagcg

SEQ ID NO: 7937 - RNA, 17 nt, Artificial Sequence
  Synthetic
cuucaucuccggcagcg

SEQ ID NO: 7938 - RNA, 17 nt, Artificial Sequence
  Synthetic
cguggccggcggcagcg

SEQ ID NO: 7939 - RNA, 17 nt, Artificial Sequence
  Synthetic
cgacggguacgucagcg

SEQ ID NO: 7940 - RNA, 17 nt, Artificial Sequence
  Synthetic
gagugguccgccgagcg

SEQ ID NO: 7941 - RNA, 17 nt, Artificial Sequence
  Synthetic
uccccgggcgccacgcg

SEQ ID NO: 7942 - RNA, 17 nt, Artificial Sequence
  Synthetic
ccagcaccguccccgcg

SEQ ID NO: 7943 - RNA, 17 nt, Artificial Sequence
  Synthetic
cucggccacggcccgcg

SEQ ID NO: 7944 - RNA, 17 nt, Artificial Sequence
  Synthetic
gcgccgccgggcccgcg

SEQ ID NO: 7945 - RNA, 17 nt, Artificial Sequence
  Synthetic
aggcgggggugcccgcg

SEQ ID NO: 7946 - RNA, 17 nt, Artificial Sequence
  Synthetic
cggccgccccucccgcg

SEQ ID NO: 7947 - RNA, 17 nt, Artificial Sequence
  Synthetic
gaaggccaggucccgcg

SEQ ID NO: 7948 - RNA, 17 nt, Artificial Sequence
  Synthetic
cccgaagaagagccgcg

SEQ ID NO: 7949 - RNA, 17 nt, Artificial Sequence
  Synthetic
ggccggccaccgccgcg

SEQ ID NO: 7950 - RNA, 17 nt, Artificial Sequence
  Synthetic
ugguggggaccgccgcg

SEQ ID NO: 7951 - RNA, 17 nt, Artificial Sequence
  Synthetic
gcauccaggccgccgcg

SEQ ID NO: 7952 - RNA, 17 nt, Artificial Sequence
  Synthetic
ggcgggucagcgccgcg

SEQ ID NO: 7953 - RNA, 17 nt, Artificial Sequence
  Synthetic
ccggcuacggcgccgcg

SEQ ID NO: 7954 - RNA, 17 nt, Artificial Sequence
  Synthetic
gggcccgcugcgccgcg

SEQ ID NO: 7955 - RNA, 17 nt, Artificial Sequence
  Synthetic
ggcccgcggucgccgcg

SEQ ID NO: 7956 - RNA, 17 nt, Artificial Sequence
  Synthetic
cgggaggggcggccgcg

SEQ ID NO: 7957 - RNA, 17 nt, Artificial Sequence
  Synthetic
gucggccgcgggccgcg

SEQ ID NO: 7958 - RNA, 17 nt, Artificial Sequence
  Synthetic
cgcggaggcgggccgcg

SEQ ID NO: 7959 - RNA, 17 nt, Artificial Sequence
  Synthetic
gcugcgccucugccgcg

SEQ ID NO: 7960 - RNA, 17 nt, Artificial Sequence
  Synthetic
ggcggggggcguccgcg

SEQ ID NO: 7961 - RNA, 17 nt, Artificial Sequence
  Synthetic
gacguccgcgguccgcg

SEQ ID NO: 7962 - RNA, 17 nt, Artificial Sequence
  Synthetic
cggggcggcgcagcgcg

SEQ ID NO: 7963 - RNA, 17 nt, Artificial Sequence
  Synthetic
gccggccgacgagcgcg

SEQ ID NO: 7964 - RNA, 17 nt, Artificial Sequence
  Synthetic
gcuccagaacccgcgcg

SEQ ID NO: 7965 - RNA, 17 nt, Artificial Sequence
  Synthetic
cggccgcgggccgcgcg

SEQ ID NO: 7966 - RNA, 17 nt, Artificial Sequence
  Synthetic
agcgaggccagcgcgcg

SEQ ID NO: 7967 - RNA, 17 nt, Artificial Sequence
  Synthetic
gggggucuucgcgcgcg

SEQ ID NO: 7968 - RNA, 17 nt, Artificial Sequence
  Synthetic
gcggcgguacucgcgcg

SEQ ID NO: 7969 - RNA, 17 nt, Artificial Sequence
  Synthetic
ccgggcgccacggcgcg

SEQ ID NO: 7970 - RNA, 17 nt, Artificial Sequence
  Synthetic
uggcggcggccggcgcg

SEQ ID NO: 7971 - RNA, 17 nt, Artificial Sequence
  Synthetic
cgcgggccccgggcgcg

SEQ ID NO: 7972 - RNA, 17 nt, Artificial Sequence
  Synthetic
cuucuucggggggcgcg

SEQ ID NO: 7973 - RNA, 17 nt, Artificial Sequence
  Synthetic
gcgcggggaccugcgcg

SEQ ID NO: 7974 - RNA, 17 nt, Artificial Sequence
  Synthetic
gcugaugcgccugcgcg

SEQ ID NO: 7975 - RNA, 17 nt, Artificial Sequence
  Synthetic
ggaagcccuucugcgcg

SEQ ID NO: 7976 - RNA, 17 nt, Artificial Sequence
  Synthetic
ggcgggaguucugcgcg

SEQ ID NO: 7977 - RNA, 17 nt, Artificial Sequence
  Synthetic
cccggaggacgugcgcg

SEQ ID NO: 7978 - RNA, 17 nt, Artificial Sequence
  Synthetic
gcgcggcgguacucgcg

SEQ ID NO: 7979 - RNA, 17 nt, Artificial Sequence
  Synthetic
gcggagcucagcaggcg

SEQ ID NO: 7980 - RNA, 17 nt, Artificial Sequence
  Synthetic
cccagcgcgcgcaggcg

SEQ ID NO: 7981 - RNA, 17 nt, Artificial Sequence
  Synthetic
agccaggcgcgcaggcg

SEQ ID NO: 7982 - RNA, 17 nt, Artificial Sequence
  Synthetic
cggacgacgaggaggcg

SEQ ID NO: 7983 - RNA, 17 nt, Artificial Sequence
  Synthetic
ccgaggcggaggaggcg

SEQ ID NO: 7984 - RNA, 17 nt, Artificial Sequence
  Synthetic
gcaggggcgcguaggcg

SEQ ID NO: 7985 - RNA, 17 nt, Artificial Sequence
  Synthetic
ggccgggcgccacggcg

SEQ ID NO: 7986 - RNA, 17 nt, Artificial Sequence
  Synthetic
gcgccgggagcacggcg

SEQ ID NO: 7987 - RNA, 17 nt, Artificial Sequence
  Synthetic
ggggcccgcccccggcg

SEQ ID NO: 7988 - RNA, 17 nt, Artificial Sequence
  Synthetic
gcggccgagcgccggcg

SEQ ID NO: 7989 - RNA, 17 nt, Artificial Sequence
  Synthetic
gucggccccggccggcg

SEQ ID NO: 7990 - RNA, 17 nt, Artificial Sequence
  Synthetic
gggucccgcccgcggcg

SEQ ID NO: 7991 - RNA, 17 nt, Artificial Sequence
  Synthetic
gcgcgccucccgcggcg

SEQ ID NO: 7992 - RNA, 17 nt, Artificial Sequence
  Synthetic
ugcgcuggccggcggcg

SEQ ID NO: 7993 - RNA, 17 nt, Artificial Sequence
  Synthetic
cgcggcgggcggcggcg

SEQ ID NO: 7994 - RNA, 17 nt, Artificial Sequence
  Synthetic
cucgcgccucggcggcg

SEQ ID NO: 7995 - RNA, 17 nt, Artificial Sequence
  Synthetic
cgcgucggcgugcggcg

SEQ ID NO: 7996 - RNA, 17 nt, Artificial Sequence
  Synthetic
gggcgggacccucggcg

SEQ ID NO: 7997 - RNA, 17 nt, Artificial Sequence
  Synthetic
cggcggcggcgucggcg

SEQ ID NO: 7998 - RNA, 17 nt, Artificial Sequence
  Synthetic
uggugguggugucggcg

SEQ ID NO: 7999 - RNA, 17 nt, Artificial Sequence
  Synthetic
cccgcgggccccgggcg

SEQ ID NO: 8000 - RNA, 17 nt, Artificial Sequence
  Synthetic
cucgccgcugccgggcg

SEQ ID NO: 8001 - RNA, 17 nt, Artificial Sequence
  Synthetic
cccggggcccgcgggcg

SEQ ID NO: 8002 - RNA, 17 nt, Artificial Sequence
  Synthetic
cggcgcggaggcgggcg

SEQ ID NO: 8003 - RNA, 17 nt, Artificial Sequence
  Synthetic
ggccgccgccucgggcg

SEQ ID NO: 8004 - RNA, 17 nt, Artificial Sequence
  Synthetic
cuuccggaucucgggcg

SEQ ID NO: 8005 - RNA, 17 nt, Artificial Sequence
  Synthetic
gcgcccuggccggggcg

SEQ ID NO: 8006 - RNA, 17 nt, Artificial Sequence
  Synthetic
gucagcgccgcggggcg

SEQ ID NO: 8007 - RNA, 17 nt, Artificial Sequence
  Synthetic
ggggcggccgcggggcg

SEQ ID NO: 8008 - RNA, 17 nt, Artificial Sequence
  Synthetic
gcggcgucggcggggcg

SEQ ID NO: 8009 - RNA, 17 nt, Artificial Sequence
  Synthetic
cacgcgccccgggggcg

SEQ ID NO: 8010 - RNA, 17 nt, Artificial Sequence
  Synthetic
ccccgggcgcgggggcg

SEQ ID NO: 8011 - RNA, 17 nt, Artificial Sequence
  Synthetic
cggcgcuggcgggggcg

SEQ ID NO: 8012 - RNA, 17 nt, Artificial Sequence
  Synthetic
cgcgccgccggggggcg

SEQ ID NO: 8013 - RNA, 17 nt, Artificial Sequence
  Synthetic
cggcggggcggggggcg

SEQ ID NO: 8014 - RNA, 17 nt, Artificial Sequence
  Synthetic
cucuucuucggggggcg

SEQ ID NO: 8015 - RNA, 17 nt, Artificial Sequence
  Synthetic
ggucugcggcgcuggcg

SEQ ID NO: 8016 - RNA, 17 nt, Artificial Sequence
  Synthetic
ucuccggcagcguggcg

SEQ ID NO: 8017 - RNA, 17 nt, Artificial Sequence
  Synthetic
gugcugaugcgccugcg

SEQ ID NO: 8018 - RNA, 17 nt, Artificial Sequence
  Synthetic
cgccuaccuggccugcg

SEQ ID NO: 8019 - RNA, 17 nt, Artificial Sequence
  Synthetic
ggcccggcggagcugcg

SEQ ID NO: 8020 - RNA, 17 nt, Artificial Sequence
  Synthetic
cgcccagcguaucugcg

SEQ ID NO: 8021 - RNA, 17 nt, Artificial Sequence
  Synthetic
cgcgccggacuucugcg

SEQ ID NO: 8022 - RNA, 17 nt, Artificial Sequence
  Synthetic
gggcgcgacgccgugcg

SEQ ID NO: 8023 - RNA, 17 nt, Artificial Sequence
  Synthetic
guacaggcgcgcgugcg

SEQ ID NO: 8024 - RNA, 17 nt, Artificial Sequence
  Synthetic
cgcccccggggcccucg

SEQ ID NO: 8025 - RNA, 17 nt, Artificial Sequence
  Synthetic
acgggcccguggucucg

SEQ ID NO: 8026 - RNA, 17 nt, Artificial Sequence
  Synthetic
ccagcgccgagacgucg

SEQ ID NO: 8027 - RNA, 17 nt, Artificial Sequence
  Synthetic
cgcugacguacccgucg

SEQ ID NO: 8028 - RNA, 17 nt, Artificial Sequence
  Synthetic
gggcgucgucgccgucg

SEQ ID NO: 8029 - RNA, 17 nt, Artificial Sequence
  Synthetic
cccagcggcccgcgucg

SEQ ID NO: 8030 - RNA, 17 nt, Artificial Sequence
  Synthetic
gcagcggcggcgcgucg

SEQ ID NO: 8031 - RNA, 17 nt, Artificial Sequence
  Synthetic
agcggcccguggcgucg

SEQ ID NO: 8032 - RNA, 17 nt, Artificial Sequence
  Synthetic
cgucgccgccgucgucg

SEQ ID NO: 8033 - RNA, 17 nt, Artificial Sequence
  Synthetic
agccgcccugcgggucg

SEQ ID NO: 8034 - RNA, 17 nt, Artificial Sequence
  Synthetic
cggggcgccgggggucg

SEQ ID NO: 8035 - RNA, 17 nt, Artificial Sequence
  Synthetic
ugggcaccagcgugucg

SEQ ID NO: 8036 - RNA, 17 nt, Artificial Sequence
  Synthetic
cgcgcggcucuucuucg

SEQ ID NO: 8037 - RNA, 17 nt, Artificial Sequence
  Synthetic
ggcgcgggcccgguucg

SEQ ID NO: 8038 - RNA, 17 nt, Artificial Sequence
  Synthetic
gcgcagcgggccgaagg

SEQ ID NO: 8039 - RNA, 17 nt, Artificial Sequence
  Synthetic
ccauggcguaccccagg

SEQ ID NO: 8040 - RNA, 17 nt, Artificial Sequence
  Synthetic
ccaguugcccgcccagg

SEQ ID NO: 8041 - RNA, 17 nt, Artificial Sequence
  Synthetic
cccggcggcgcuccagg

SEQ ID NO: 8042 - RNA, 17 nt, Artificial Sequence
  Synthetic
cggugucggccagcagg

SEQ ID NO: 8043 - RNA, 17 nt, Artificial Sequence
  Synthetic
gcagccaggcgcgcagg

SEQ ID NO: 8044 - RNA, 17 nt, Artificial Sequence
  Synthetic
caggaucccgcggcagg

SEQ ID NO: 8045 - RNA, 17 nt, Artificial Sequence
  Synthetic
uuuugaugagucagagg

SEQ ID NO: 8046 - RNA, 17 nt, Artificial Sequence
  Synthetic
ggcggaugcagacgagg

SEQ ID NO: 8047 - RNA, 17 nt, Artificial Sequence
  Synthetic
gucgucgucagacgagg

SEQ ID NO: 8048 - RNA, 17 nt, Artificial Sequence
  Synthetic
cggcgcggacgacgagg

SEQ ID NO: 8049 - RNA, 17 nt, Artificial Sequence
  Synthetic
gucgcccgcgcccgagg

SEQ ID NO: 8050 - RNA, 17 nt, Artificial Sequence
  Synthetic
cuggggggcgcccgagg

SEQ ID NO: 8051 - RNA, 17 nt, Artificial Sequence
  Synthetic
ggaugcagacgaggagg

SEQ ID NO: 8052 - RNA, 17 nt, Artificial Sequence
  Synthetic
gucgucagacgaggagg

SEQ ID NO: 8053 - RNA, 17 nt, Artificial Sequence
  Synthetic
cgcggacgacgaggagg

SEQ ID NO: 8054 - RNA, 17 nt, Artificial Sequence
  Synthetic
ugcagacgaggaggagg

SEQ ID NO: 8055 - RNA, 17 nt, Artificial Sequence
  Synthetic
agacgaggaggaggagg

SEQ ID NO: 8056 - RNA, 17 nt, Artificial Sequence
  Synthetic
ggaggcggaggaggagg

SEQ ID NO: 8057 - RNA, 17 nt, Artificial Sequence
  Synthetic
ggaggaggcggaggagg

SEQ ID NO: 8058 - RNA, 17 nt, Artificial Sequence
  Synthetic
cggccggcgcgcggagg

SEQ ID NO: 8059 - RNA, 17 nt, Artificial Sequence
  Synthetic
cccggccggcgcggagg

SEQ ID NO: 8060 - RNA, 17 nt, Artificial Sequence
  Synthetic
cucccgcggcgcggagg

SEQ ID NO: 8061 - RNA, 17 nt, Artificial Sequence
  Synthetic
ggcgcccgaggcggagg

SEQ ID NO: 8062 - RNA, 17 nt, Artificial Sequence
  Synthetic
ggaggaggaggcggagg

SEQ ID NO: 8063 - RNA, 17 nt, Artificial Sequence
  Synthetic
gggcggcggcguggagg

SEQ ID NO: 8064 - RNA, 17 nt, Artificial Sequence
  Synthetic
cguugacgacgaugagg

SEQ ID NO: 8065 - RNA, 17 nt, Artificial Sequence
  Synthetic
gcgcacggcggccacgg

SEQ ID NO: 8066 - RNA, 17 nt, Artificial Sequence
  Synthetic
gcggcucauggccacgg

SEQ ID NO: 8067 - RNA, 17 nt, Artificial Sequence
  Synthetic
gcucacggcgcgcacgg

SEQ ID NO: 8068 - RNA, 17 nt, Artificial Sequence
  Synthetic
cacggcgcacugcacgg

SEQ ID NO: 8069 - RNA, 17 nt, Artificial Sequence
  Synthetic
cgaacccccgacgacgg

SEQ ID NO: 8070 - RNA, 17 nt, Artificial Sequence
  Synthetic
gggcgcgugcuguacgg

SEQ ID NO: 8071 - RNA, 17 nt, Artificial Sequence
  Synthetic
ccaggugcccgacccgg

SEQ ID NO: 8072 - RNA, 17 nt, Artificial Sequence
  Synthetic
gccgccccgccccccgg

SEQ ID NO: 8073 - RNA, 17 nt, Artificial Sequence
  Synthetic
uacagcacgcgccccgg

SEQ ID NO: 8074 - RNA, 17 nt, Artificial Sequence
  Synthetic
cggccgggcggccccgg

SEQ ID NO: 8075 - RNA, 17 nt, Artificial Sequence
  Synthetic
gcccgcgagggccccgg

SEQ ID NO: 8076 - RNA, 17 nt, Artificial Sequence
  Synthetic
guguggcugggccccgg

SEQ ID NO: 8077 - RNA, 17 nt, Artificial Sequence
  Synthetic
cgcggggcgccgcccgg

SEQ ID NO: 8078 - RNA, 17 nt, Artificial Sequence
  Synthetic
cgugcgcggcggcccgg

SEQ ID NO: 8079 - RNA, 17 nt, Artificial Sequence
  Synthetic
ccgccgcgcgggcccgg

SEQ ID NO: 8080 - RNA, 17 nt, Artificial Sequence
  Synthetic
cgcggcgccguagccgg

SEQ ID NO: 8081 - RNA, 17 nt, Artificial Sequence
  Synthetic
ggcgggcgcgccgccgg

SEQ ID NO: 8082 - RNA, 17 nt, Artificial Sequence
  Synthetic
aggcggccgagcgccgg

SEQ ID NO: 8083 - RNA, 17 nt, Artificial Sequence
  Synthetic
gccgcgggccgcgccgg

SEQ ID NO: 8084 - RNA, 17 nt, Artificial Sequence
  Synthetic
ggcggggggcgcgccgg

SEQ ID NO: 8085 - RNA, 17 nt, Artificial Sequence
  Synthetic
cgcguagaaggcgccgg

SEQ ID NO: 8086 - RNA, 17 nt, Artificial Sequence
  Synthetic
gacgacgacggcgccgg

SEQ ID NO: 8087 - RNA, 17 nt, Artificial Sequence
  Synthetic
ugucggcggggcgccgg

SEQ ID NO: 8088 - RNA, 17 nt, Artificial Sequence
  Synthetic
cccgaacacgcggccgg

SEQ ID NO: 8089 - RNA, 17 nt, Artificial Sequence
  Synthetic
ggcccucggcgggccgg

SEQ ID NO: 8090 - RNA, 17 nt, Artificial Sequence
  Synthetic
ccgcguguucgggccgg

SEQ ID NO: 8091 - RNA, 17 nt, Artificial Sequence
  Synthetic
cgccgugcgcuggccgg

SEQ ID NO: 8092 - RNA, 17 nt, Artificial Sequence
  Synthetic
gaccugcgcguggccgg

SEQ ID NO: 8093 - RNA, 17 nt, Artificial Sequence
  Synthetic
ucggcggaccacuccgg

SEQ ID NO: 8094 - RNA, 17 nt, Artificial Sequence
  Synthetic
ucgcgcagcaccagcgg

SEQ ID NO: 8095 - RNA, 17 nt, Artificial Sequence
  Synthetic
cggcagaggcgcagcgg

SEQ ID NO: 8096 - RNA, 17 nt, Artificial Sequence
  Synthetic
gcgcgcggucguagcgg

SEQ ID NO: 8097 - RNA, 17 nt, Artificial Sequence
  Synthetic
guacacgccggacgcgg

SEQ ID NO: 8098 - RNA, 17 nt, Artificial Sequence
  Synthetic
cguggccagccccgcgg

SEQ ID NO: 8099 - RNA, 17 nt, Artificial Sequence
  Synthetic
ggccgccccucccgcgg

SEQ ID NO: 8100 - RNA, 17 nt, Artificial Sequence
  Synthetic
cggcuacggcgccgcgg

SEQ ID NO: 8101 - RNA, 17 nt, Artificial Sequence
  Synthetic
gcccgcggucgccgcgg

SEQ ID NO: 8102 - RNA, 17 nt, Artificial Sequence
  Synthetic
gggcgcggcggccgcgg

SEQ ID NO: 8103 - RNA, 17 nt, Artificial Sequence
  Synthetic
agcugcgcgggccgcgg

SEQ ID NO: 8104 - RNA, 17 nt, Artificial Sequence
  Synthetic
gacggugcuggccgcgg

SEQ ID NO: 8105 - RNA, 17 nt, Artificial Sequence
  Synthetic
gaagagcagguccgcgg

SEQ ID NO: 8106 - RNA, 17 nt, Artificial Sequence
  Synthetic
ugguccgccgagcgcgg

SEQ ID NO: 8107 - RNA, 17 nt, Artificial Sequence
  Synthetic
ccgccgggcccgcgcgg

SEQ ID NO: 8108 - RNA, 17 nt, Artificial Sequence
  Synthetic
cccgcugcgccgcgcgg

SEQ ID NO: 8109 - RNA, 17 nt, Artificial Sequence
  Synthetic
cggcggccggcgcgcgg

SEQ ID NO: 8110 - RNA, 17 nt, Artificial Sequence
  Synthetic
ccgggagcacggcgcgg

SEQ ID NO: 8111 - RNA, 17 nt, Artificial Sequence
  Synthetic
ggccccggccggcgcgg

SEQ ID NO: 8112 - RNA, 17 nt, Artificial Sequence
  Synthetic
cgccucccgcggcgcgg

SEQ ID NO: 8113 - RNA, 17 nt, Artificial Sequence
  Synthetic
gcgggccccgggcgcgg

SEQ ID NO: 8114 - RNA, 17 nt, Artificial Sequence
  Synthetic
agcgccgcggggcgcgg

SEQ ID NO: 8115 - RNA, 17 nt, Artificial Sequence
  Synthetic
cgggcgcgggggcgcgg

SEQ ID NO: 8116 - RNA, 17 nt, Artificial Sequence
  Synthetic
cgcgacgccgugcgcgg

SEQ ID NO: 8117 - RNA, 17 nt, Artificial Sequence
  Synthetic
cagcgggccgaaggcgg

SEQ ID NO: 8118 - RNA, 17 nt, Artificial Sequence
  Synthetic
gcccgcgcccgaggcgg

SEQ ID NO: 8119 - RNA, 17 nt, Artificial Sequence
  Synthetic
gggggcgcccgaggcgg

SEQ ID NO: 8120 - RNA, 17 nt, Artificial Sequence
  Synthetic
ggacgacgaggaggcgg

SEQ ID NO: 8121 - RNA, 17 nt, Artificial Sequence
  Synthetic
cgaggaggaggaggcgg

SEQ ID NO: 8122 - RNA, 17 nt, Artificial Sequence
  Synthetic
ggcggaggaggaggcgg

SEQ ID NO: 8123 - RNA, 17 nt, Artificial Sequence
  Synthetic
ugacgacgaugaggcgg

SEQ ID NO: 8124 - RNA, 17 nt, Artificial Sequence
  Synthetic
cggccgagcgccggcgg

SEQ ID NO: 8125 - RNA, 17 nt, Artificial Sequence
  Synthetic
ggggggcgcgccggcgg

SEQ ID NO: 8126 - RNA, 17 nt, Artificial Sequence
  Synthetic
gacgacggcgccggcgg

SEQ ID NO: 8127 - RNA, 17 nt, Artificial Sequence
  Synthetic
cgcggcggccgcggcgg

SEQ ID NO: 8128 - RNA, 17 nt, Artificial Sequence
  Synthetic
gagcagguccgcggcgg

SEQ ID NO: 8129 - RNA, 17 nt, Artificial Sequence
  Synthetic
ccgggcccgcgcggcgg

SEQ ID NO: 8130 - RNA, 17 nt, Artificial Sequence
  Synthetic
gggcgcgccggcggcgg

SEQ ID NO: 8131 - RNA, 17 nt, Artificial Sequence
  Synthetic
cagguccgcggcggcgg

SEQ ID NO: 8132 - RNA, 17 nt, Artificial Sequence
  Synthetic
guccgcggcggcggcgg

SEQ ID NO: 8133 - RNA, 17 nt, Artificial Sequence
  Synthetic
cgcggcggcggcggcgg

SEQ ID NO: 8134 - RNA, 17 nt, Artificial Sequence
  Synthetic
cggggcggcggcggcgg

SEQ ID NO: 8135 - RNA, 17 nt, Artificial Sequence
  Synthetic
caacggggcggcggcgg

SEQ ID NO: 8136 - RNA, 17 nt, Artificial Sequence
  Synthetic
cggcaacggggcggcgg

SEQ ID NO: 8137 - RNA, 17 nt, Artificial Sequence
  Synthetic
cccguugccgucggcgg

SEQ ID NO: 8138 - RNA, 17 nt, Artificial Sequence
  Synthetic
guaggccuccagggcgg

SEQ ID NO: 8139 - RNA, 17 nt, Artificial Sequence
  Synthetic
cuggccgcggcgggcgg

SEQ ID NO: 8140 - RNA, 17 nt, Artificial Sequence
  Synthetic
cgacggcaacggggcgg

SEQ ID NO: 8141 - RNA, 17 nt, Artificial Sequence
  Synthetic
gggcggccgcggggcgg

SEQ ID NO: 8142 - RNA, 17 nt, Artificial Sequence
  Synthetic
cggcgucggcggggcgg

SEQ ID NO: 8143 - RNA, 17 nt, Artificial Sequence
  Synthetic
acgcgccccgggggcgg

SEQ ID NO: 8144 - RNA, 17 nt, Artificial Sequence
  Synthetic
gggguacgccauggcgg

SEQ ID NO: 8145 - RNA, 17 nt, Artificial Sequence
  Synthetic
ccuggaggcgcuggcgg

SEQ ID NO: 8146 - RNA, 17 nt, Artificial Sequence
  Synthetic
gucugcggcgcuggcgg

SEQ ID NO: 8147 - RNA, 17 nt, Artificial Sequence
  Synthetic
gccggcggugguggcgg

SEQ ID NO: 8148 - RNA, 17 nt, Artificial Sequence
  Synthetic
gcccagcguaucugcgg

SEQ ID NO: 8149 - RNA, 17 nt, Artificial Sequence
  Synthetic
ggcgcgucggcgugcgg

SEQ ID NO: 8150 - RNA, 17 nt, Artificial Sequence
  Synthetic
cgggucggggcccucgg

SEQ ID NO: 8151 - RNA, 17 nt, Artificial Sequence
  Synthetic
acgggcucgcgccucgg

SEQ ID NO: 8152 - RNA, 17 nt, Artificial Sequence
  Synthetic
cagcccgccgcgcucgg

SEQ ID NO: 8153 - RNA, 17 nt, Artificial Sequence
  Synthetic
cagcgccgagacgucgg

SEQ ID NO: 8154 - RNA, 17 nt, Artificial Sequence
  Synthetic
gaccacgggcccgucgg

SEQ ID NO: 8155 - RNA, 17 nt, Artificial Sequence
  Synthetic
cgccccguugccgucgg

SEQ ID NO: 8156 - RNA, 17 nt, Artificial Sequence
  Synthetic
cgcggcggcggcgucgg

SEQ ID NO: 8157 - RNA, 17 nt, Artificial Sequence
  Synthetic
gucgccgccgucgucgg

SEQ ID NO: 8158 - RNA, 17 nt, Artificial Sequence
  Synthetic
gguggugguggugucgg

SEQ ID NO: 8159 - RNA, 17 nt, Artificial Sequence
  Synthetic
gcgcggcucuucuucgg

SEQ ID NO: 8160 - RNA, 17 nt, Artificial Sequence
  Synthetic
gcucaggcgccccaggg

SEQ ID NO: 8161 - RNA, 17 nt, Artificial Sequence
  Synthetic
gcaguaggccuccaggg

SEQ ID NO: 8162 - RNA, 17 nt, Artificial Sequence
  Synthetic
ggccccgacccgcaggg

SEQ ID NO: 8163 - RNA, 17 nt, Artificial Sequence
  Synthetic
gcgggcgcgccgccggg

SEQ ID NO: 8164 - RNA, 17 nt, Artificial Sequence
  Synthetic
gccagggcgccgccggg

SEQ ID NO: 8165 - RNA, 17 nt, Artificial Sequence
  Synthetic
gccgcuucacggccggg

SEQ ID NO: 8166 - RNA, 17 nt, Artificial Sequence
  Synthetic
cggcggaccacuccggg

SEQ ID NO: 8167 - RNA, 17 nt, Artificial Sequence
  Synthetic
gcgcggggaagagcggg

SEQ ID NO: 8168 - RNA, 17 nt, Artificial Sequence
  Synthetic
ggcgcggcccccgcggg

SEQ ID NO: 8169 - RNA, 17 nt, Artificial Sequence
  Synthetic
gcagaccacgccgcggg

SEQ ID NO: 8170 - RNA, 17 nt, Artificial Sequence
  Synthetic
cgccuccgcgccgcggg

SEQ ID NO: 8171 - RNA, 17 nt, Artificial Sequence
  Synthetic
gcuggcgggggcgcggg

SEQ ID NO: 8172 - RNA, 17 nt, Artificial Sequence
  Synthetic
ggccgagcgccggcggg

SEQ ID NO: 8173 - RNA, 17 nt, Artificial Sequence
  Synthetic
gugcuggccgcggcggg

SEQ ID NO: 8174 - RNA, 17 nt, Artificial Sequence
  Synthetic
ggcggccgcggggcggg

SEQ ID NO: 8175 - RNA, 17 nt, Artificial Sequence
  Synthetic
ggcgucggcggggcggg

SEQ ID NO: 8176 - RNA, 17 nt, Artificial Sequence
  Synthetic
cgcgccccgggggcggg

SEQ ID NO: 8177 - RNA, 17 nt, Artificial Sequence
  Synthetic
cgcggcucuucuucggg

SEQ ID NO: 8178 - RNA, 17 nt, Artificial Sequence
  Synthetic
ggcccccgcgggagggg

SEQ ID NO: 8179 - RNA, 17 nt, Artificial Sequence
  Synthetic
cgccgacggcaacgggg

SEQ ID NO: 8180 - RNA, 17 nt, Artificial Sequence
  Synthetic
ccccccagaggccgggg

SEQ ID NO: 8181 - RNA, 17 nt, Artificial Sequence
  Synthetic
ggggguccgggccgggg

SEQ ID NO: 8182 - RNA, 17 nt, Artificial Sequence
  Synthetic
cggcgcccuggccgggg

SEQ ID NO: 8183 - RNA, 17 nt, Artificial Sequence
  Synthetic
ggcggaccacuccgggg

SEQ ID NO: 8184 - RNA, 17 nt, Artificial Sequence
  Synthetic
gaggggcggccgcgggg

SEQ ID NO: 8185 - RNA, 17 nt, Artificial Sequence
  Synthetic
gucggcgugcggcgggg

SEQ ID NO: 8186 - RNA, 17 nt, Artificial Sequence
  Synthetic
cggcggcgucggcgggg

SEQ ID NO: 8187 - RNA, 17 nt, Artificial Sequence
  Synthetic
gccgccggggggcgggg

SEQ ID NO: 8188 - RNA, 17 nt, Artificial Sequence
  Synthetic
agcacgcgccccggggg

SEQ ID NO: 8189 - RNA, 17 nt, Artificial Sequence
  Synthetic
cgcgagggccccggggg

SEQ ID NO: 8190 - RNA, 17 nt, Artificial Sequence
  Synthetic
gcgggccgcgccggggg

SEQ ID NO: 8191 - RNA, 17 nt, Artificial Sequence
  Synthetic
gcggaccacuccggggg

SEQ ID NO: 8192 - RNA, 17 nt, Artificial Sequence
  Synthetic
cagcguaucugcggggg

SEQ ID NO: 8193 - RNA, 17 nt, Artificial Sequence
  Synthetic
ggcgcgccgccgggggg

SEQ ID NO: 8194 - RNA, 17 nt, Artificial Sequence
  Synthetic
acgcggaggcgaugggg

SEQ ID NO: 8195 - RNA, 17 nt, Artificial Sequence
  Synthetic
gcgggcucggcccuggg

SEQ ID NO: 8196 - RNA, 17 nt, Artificial Sequence
  Synthetic
cgccacggccgccuggg

SEQ ID NO: 8197 - RNA, 17 nt, Artificial Sequence
  Synthetic
ccgccccggccucuggg

SEQ ID NO: 8198 - RNA, 17 nt, Artificial Sequence
  Synthetic
ccugggguacgccaugg

SEQ ID NO: 8199 - RNA, 17 nt, Artificial Sequence
  Synthetic
cuucgacggcgaccugg

SEQ ID NO: 8200 - RNA, 17 nt, Artificial Sequence
  Synthetic
cucggccgccgcccugg

SEQ ID NO: 8201 - RNA, 17 nt, Artificial Sequence
  Synthetic
cugccgcgggauccugg

SEQ ID NO: 8202 - RNA, 17 nt, Artificial Sequence
  Synthetic
cauggacgcggagcugg

SEQ ID NO: 8203 - RNA, 17 nt, Artificial Sequence
  Synthetic
gauccuggaggcgcugg

SEQ ID NO: 8204 - RNA, 17 nt, Artificial Sequence
  Synthetic
guggucugcggcgcugg

SEQ ID NO: 8205 - RNA, 17 nt, Artificial Sequence
  Synthetic
ugggccccggcggcugg

SEQ ID NO: 8206 - RNA, 17 nt, Artificial Sequence
  Synthetic
gcuguccugccugcugg

SEQ ID NO: 8207 - RNA, 17 nt, Artificial Sequence
  Synthetic
gccgccccggccucugg

SEQ ID NO: 8208 - RNA, 17 nt, Artificial Sequence
  Synthetic
gggccuggcgcacgugg

SEQ ID NO: 8209 - RNA, 17 nt, Artificial Sequence
  Synthetic
cgcccaggcggccgugg

SEQ ID NO: 8210 - RNA, 17 nt, Artificial Sequence
  Synthetic
ggucuucgcgcgcgugg

SEQ ID NO: 8211 - RNA, 17 nt, Artificial Sequence
  Synthetic
ggcgggcggcggcgugg

SEQ ID NO: 8212 - RNA, 17 nt, Artificial Sequence
  Synthetic
cgucgucgccgucgugg

SEQ ID NO: 8213 - RNA, 17 nt, Artificial Sequence
  Synthetic
cggcggcguggaggugg

SEQ ID NO: 8214 - RNA, 17 nt, Artificial Sequence
  Synthetic
gacggcgccggcggugg

SEQ ID NO: 8215 - RNA, 17 nt, Artificial Sequence
  Synthetic
cgcgccggcggcggugg

SEQ ID NO: 8216 - RNA, 17 nt, Artificial Sequence
  Synthetic
ggcgccggcgguggugg

SEQ ID NO: 8217 - RNA, 17 nt, Artificial Sequence
  Synthetic
gccggcggcgguggugg

SEQ ID NO: 8218 - RNA, 17 nt, Artificial Sequence
  Synthetic
ggcggcggugguggugg

SEQ ID NO: 8219 - RNA, 17 nt, Artificial Sequence
  Synthetic
ggcgguggugguggugg

SEQ ID NO: 8220 - RNA, 17 nt, Artificial Sequence
  Synthetic
ggugguggugguggugg

SEQ ID NO: 8221 - RNA, 17 nt, Artificial Sequence
  Synthetic
cgcgcgggucgaacaug

SEQ ID NO: 8222 - RNA, 17 nt, Artificial Sequence
  Synthetic
gcgacaggcuggccaug

SEQ ID NO: 8223 - RNA, 17 nt, Artificial Sequence
  Synthetic
cggcguugacgacgaug

SEQ ID NO: 8224 - RNA, 17 nt, Artificial Sequence
  Synthetic
cggacgcggaggcgaug

SEQ ID NO: 8225 - RNA, 17 nt, Artificial Sequence
  Synthetic
gggccgugccccaccug

SEQ ID NO: 8226 - RNA, 17 nt, Artificial Sequence
  Synthetic
cggcgccagccgcccug

SEQ ID NO: 8227 - RNA, 17 nt, Artificial Sequence
  Synthetic
gggugcucgccgcccug

SEQ ID NO: 8228 - RNA, 17 nt, Artificial Sequence
  Synthetic
gcgccguggaguuccug

SEQ ID NO: 8229 - RNA, 17 nt, Artificial Sequence
  Synthetic
ccuggcugcgcgagcug

SEQ ID NO: 8230 - RNA, 17 nt, Artificial Sequence
  Synthetic
gccugggcgcgccgcug

SEQ ID NO: 8231 - RNA, 17 nt, Artificial Sequence
  Synthetic
cgcgccugcgcgcgcug

SEQ ID NO: 8232 - RNA, 17 nt, Artificial Sequence
  Synthetic
ccgucuacguggcgcug

SEQ ID NO: 8233 - RNA, 17 nt, Artificial Sequence
  Synthetic
gcgggccgcuucggcug

SEQ ID NO: 8234 - RNA, 17 nt, Artificial Sequence
  Synthetic
gacgcccagcguaucug

SEQ ID NO: 8235 - RNA, 17 nt, Artificial Sequence
  Synthetic
agccgccccggccucug

SEQ ID NO: 8236 - RNA, 17 nt, Artificial Sequence
  Synthetic
cugggcaaccggcucug

SEQ ID NO: 8237 - RNA, 17 nt, Artificial Sequence
  Synthetic
gcccgcggcguggucug

SEQ ID NO: 8238 - RNA, 17 nt, Artificial Sequence
  Synthetic
gccgcggggccaacgug

SEQ ID NO: 8239 - RNA, 17 nt, Artificial Sequence
  Synthetic
gcgccccggcgcccgug

SEQ ID NO: 8240 - RNA, 17 nt, Artificial Sequence
  Synthetic
ccgagggcgccggcgug

SEQ ID NO: 8241 - RNA, 17 nt, Artificial Sequence
  Synthetic
cggggcgcgucggcgug

SEQ ID NO: 8242 - RNA, 17 nt, Artificial Sequence
  Synthetic
auggcguaccccaggug

SEQ ID NO: 8243 - RNA, 17 nt, Artificial Sequence
  Synthetic
cggaggccagcacggug

SEQ ID NO: 8244 - RNA, 17 nt, Artificial Sequence
  Synthetic
gcggcguggagguggug

SEQ ID NO: 8245 - RNA, 17 nt, Artificial Sequence
  Synthetic
cgacgacggacuguuug

SEQ ID NO: 8246 - RNA, 17 nt, Artificial Sequence
  Synthetic
uacucgcgcggggacau

SEQ ID NO: 8247 - RNA, 17 nt, Artificial Sequence
  Synthetic
ggcgacaggcuggccau

SEQ ID NO: 8248 - RNA, 17 nt, Artificial Sequence
  Synthetic
ccggacgcggaggcgau

SEQ ID NO: 8249 - RNA, 17 nt, Artificial Sequence
  Synthetic
cgggccgugccccaccu

SEQ ID NO: 8250 - RNA, 17 nt, Artificial Sequence
  Synthetic
gccgcgggcgggacccu

SEQ ID NO: 8251 - RNA, 17 nt, Artificial Sequence
  Synthetic
ggggugcucgccgcccu

SEQ ID NO: 8252 - RNA, 17 nt, Artificial Sequence
  Synthetic
ccacacgccggcgcccu

SEQ ID NO: 8253 - RNA, 17 nt, Artificial Sequence
  Synthetic
ugccugcuggcggcccu

SEQ ID NO: 8254 - RNA, 17 nt, Artificial Sequence
  Synthetic
ggggcgggcucggcccu

SEQ ID NO: 8255 - RNA, 17 nt, Artificial Sequence
  Synthetic
cuggucgccggggcccu

SEQ ID NO: 8256 - RNA, 17 nt, Artificial Sequence
  Synthetic
cugcgggucggggcccu

SEQ ID NO: 8257 - RNA, 17 nt, Artificial Sequence
  Synthetic
cggccgggccgccgccu

SEQ ID NO: 8258 - RNA, 17 nt, Artificial Sequence
  Synthetic
gcccgccacggccgccu

SEQ ID NO: 8259 - RNA, 17 nt, Artificial Sequence
  Synthetic
ccgcgccuccuccgccu

SEQ ID NO: 8260 - RNA, 17 nt, Artificial Sequence
  Synthetic
cggcccgcugcgcgccu

SEQ ID NO: 8261 - RNA, 17 nt, Artificial Sequence
  Synthetic
uccacgggcucgcgccu

SEQ ID NO: 8262 - RNA, 17 nt, Artificial Sequence
  Synthetic
ggcccgguucgaggccu

SEQ ID NO: 8263 - RNA, 17 nt, Artificial Sequence
  Synthetic
ugcgcgcgcuggggccu

SEQ ID NO: 8264 - RNA, 17 nt, Artificial Sequence
  Synthetic
ggcgccguggaguuccu

SEQ ID NO: 8265 - RNA, 17 nt, Artificial Sequence
  Synthetic
cgccgcgucgcccagcu

SEQ ID NO: 8266 - RNA, 17 nt, Artificial Sequence
  Synthetic
gugugggcgcccgagcu

SEQ ID NO: 8267 - RNA, 17 nt, Artificial Sequence
  Synthetic
cgggugguccgugagcu

SEQ ID NO: 8268 - RNA, 17 nt, Artificial Sequence
  Synthetic
gcccccgcagauacgcu

SEQ ID NO: 8269 - RNA, 17 nt, Artificial Sequence
  Synthetic
ccgcgacgcgggccgcu

SEQ ID NO: 8270 - RNA, 17 nt, Artificial Sequence
  Synthetic
ggacagcccgccgcgcu

SEQ ID NO: 8271 - RNA, 17 nt, Artificial Sequence
  Synthetic
ccgcgccugcgcgcgcu

SEQ ID NO: 8272 - RNA, 17 nt, Artificial Sequence
  Synthetic
cgccccccgccggcgcu

SEQ ID NO: 8273 - RNA, 17 nt, Artificial Sequence
  Synthetic
cccgacgucucggcgcu

SEQ ID NO: 8274 - RNA, 17 nt, Artificial Sequence
  Synthetic
cccgucuacguggcgcu

SEQ ID NO: 8275 - RNA, 17 nt, Artificial Sequence
  Synthetic
ggcgggccgcuucggcu

SEQ ID NO: 8276 - RNA, 17 nt, Artificial Sequence
  Synthetic
gugcuguacggcgggcu

SEQ ID NO: 8277 - RNA, 17 nt, Artificial Sequence
  Synthetic
ccgggccggggcgggcu

SEQ ID NO: 8278 - RNA, 17 nt, Artificial Sequence
  Synthetic
ucggcccugggcgggcu

SEQ ID NO: 8279 - RNA, 17 nt, Artificial Sequence
  Synthetic
ggcgccggcguguggcu

SEQ ID NO: 8280 - RNA, 17 nt, Artificial Sequence
  Synthetic
ggccugcuuccggaucu

SEQ ID NO: 8281 - RNA, 17 nt, Artificial Sequence
  Synthetic
cagccgccccggccucu

SEQ ID NO: 8282 - RNA, 17 nt, Artificial Sequence
  Synthetic
cggcgcccccgacgucu

SEQ ID NO: 8283 - RNA, 17 nt, Artificial Sequence
  Synthetic
ggcccgcggggcgcagu

SEQ ID NO: 8284 - RNA, 17 nt, Artificial Sequence
  Synthetic
gggcgcggcgagcgagu

SEQ ID NO: 8285 - RNA, 17 nt, Artificial Sequence
  Synthetic
cacgcgguaccgcacgu

SEQ ID NO: 8286 - RNA, 17 nt, Artificial Sequence
  Synthetic
gcccagcgccgagacgu

SEQ ID NO: 8287 - RNA, 17 nt, Artificial Sequence
  Synthetic
cgagaccacgggcccgu

SEQ ID NO: 8288 - RNA, 17 nt, Artificial Sequence
  Synthetic
cgggggcgcgucgccgu

SEQ ID NO: 8289 - RNA, 17 nt, Artificial Sequence
  Synthetic
cgccgccccguugccgu

SEQ ID NO: 8290 - RNA, 17 nt, Artificial Sequence
  Synthetic
ggcgccggaggccgcgu

SEQ ID NO: 8291 - RNA, 17 nt, Artificial Sequence
  Synthetic
gcgcagcggcggcgcgu

SEQ ID NO: 8292 - RNA, 17 nt, Artificial Sequence
  Synthetic
cgccagcaggggcgcgu

SEQ ID NO: 8293 - RNA, 17 nt, Artificial Sequence
  Synthetic
gcgcaggcggggcgcgu

SEQ ID NO: 8294 - RNA, 17 nt, Artificial Sequence
  Synthetic
ggccgcggcggcggcgu

SEQ ID NO: 8295 - RNA, 17 nt, Artificial Sequence
  Synthetic
gcagauacgcugggcgu

SEQ ID NO: 8296 - RNA, 17 nt, Artificial Sequence
  Synthetic
gggcaccgcgcgcucgu

SEQ ID NO: 8297 - RNA, 17 nt, Artificial Sequence
  Synthetic
ggcgucgccgccgucgu

SEQ ID NO: 8298 - RNA, 17 nt, Artificial Sequence
  Synthetic
auccggauccucgucgu

SEQ ID NO: 8299 - RNA, 17 nt, Artificial Sequence
  Synthetic
gucgucgucgucgucgu

SEQ ID NO: 8300 - RNA, 17 nt, Artificial Sequence
  Synthetic
cauggcguaccccaggu

SEQ ID NO: 8301 - RNA, 17 nt, Artificial Sequence
  Synthetic
caccucgcaggccaggu

SEQ ID NO: 8302 - RNA, 17 nt, Artificial Sequence
  Synthetic
gucgccgucguggcggu

SEQ ID NO: 8303 - RNA, 17 nt, Artificial Sequence
  Synthetic
gcgcacguccuccgggu

SEQ ID NO: 8304 - RNA, 17 nt, Artificial Sequence
  Synthetic
ccagccgcccugcgggu

SEQ ID NO: 8305 - RNA, 17 nt, Artificial Sequence
  Synthetic
ggcggcguggagguggu

SEQ ID NO: 8306 - RNA, 17 nt, Artificial Sequence
  Synthetic
cgccccggcgcccgugu

SEQ ID NO: 8307 - RNA, 17 nt, Artificial Sequence
  Synthetic
caugggcaccagcgugu

SEQ ID NO: 8308 - RNA, 17 nt, Artificial Sequence
  Synthetic
ggccgcggcgacggugu

SEQ ID NO: 8309 - RNA, 17 nt, Artificial Sequence
  Synthetic
ggugguggugguggugu

SEQ ID NO: 8310 - RNA, 17 nt, Artificial Sequence
  Synthetic
ggcgcgcccgccgccuu

SEQ ID NO: 8311 - RNA, 17 nt, Artificial Sequence
  Synthetic
auggcggcgggccgcuu

SEQ ID NO: 8312 - RNA, 17 nt, Artificial Sequence
  Synthetic
cgcgugcgcacgcgcuu

SEQ ID NO: 8313 - RNA, 17 nt, Artificial Sequence
  Synthetic
uccgcgcggcucuucuu

SEQ ID NO: 8314 - RNA, 17 nt, Artificial Sequence
  Synthetic
gacgacgacggacuguu

SEQ ID NO: 8315 - RNA, 17 nt, Artificial Sequence
  Synthetic
gccuccggccgcguguu

SEQ ID NO: 8316 - RNA, 17 nt, Artificial Sequence
  Synthetic
acgacgacggacuguuu

SEQ ID NO: 8317 - RNA, 20 nt, Artificial Sequence
  Synthetic
gacgccgccgccgacggcaa

SEQ ID NO: 8318 - RNA, 20 nt, Artificial Sequence
  Synthetic
cgcuacgaccgcgcgcagaa

SEQ ID NO: 8319 - RNA, 20 nt, Artificial Sequence
  Synthetic
gcccagcucgggcgcccaca

SEQ ID NO: 8320 - RNA, 20 nt, Artificial Sequence
  Synthetic
gcgguacucgcgcggggaca

SEQ ID NO: 8321 - RNA, 20 nt, Artificial Sequence
  Synthetic
gaggcgcgagcccguggaca

SEQ ID NO: 8322 - RNA, 20 nt, Artificial Sequence
  Synthetic
ggcgugcugccgcgagacca

SEQ ID NO: 8323 - RNA, 20 nt, Artificial Sequence
  Synthetic
cggggcguacccggacccca

SEQ ID NO: 8324 - RNA, 20 nt, Artificial Sequence
  Synthetic
cgcggcgcucaggcgcccca

SEQ ID NO: 8325 - RNA, 20 nt, Artificial Sequence
  Synthetic
gccccggccgagcccgccca

SEQ ID NO: 8326 - RNA, 20 nt, Artificial Sequence
  Synthetic
ccgcggcagcgccgggccca

SEQ ID NO: 8327 - RNA, 20 nt, Artificial Sequence
  Synthetic
cccgcagagccgguugccca

SEQ ID NO: 8328 - RNA, 20 nt, Artificial Sequence
  Synthetic
gguggccggccgcgacgcca

SEQ ID NO: 8329 - RNA, 20 nt, Artificial Sequence
  Synthetic
cucgggcgcgggcgacgcca

SEQ ID NO: 8330 - RNA, 20 nt, Artificial Sequence
  Synthetic
gccccaccugggguacgcca

SEQ ID NO: 8331 - RNA, 20 nt, Artificial Sequence
  Synthetic
ccggcucugcgggcccgcca

SEQ ID NO: 8332 - RNA, 20 nt, Artificial Sequence
  Synthetic
gccgaagcggcccgccgcca

SEQ ID NO: 8333 - RNA, 20 nt, Artificial Sequence
  Synthetic
guccggcgcgccgggcgcca

SEQ ID NO: 8334 - RNA, 20 nt, Artificial Sequence
  Synthetic
aacaugagggccgggcgcca

SEQ ID NO: 8335 - RNA, 20 nt, Artificial Sequence
  Synthetic
caagagccccgccccggcca

SEQ ID NO: 8336 - RNA, 20 nt, Artificial Sequence
  Synthetic
cacggcgcgcacggcggcca

SEQ ID NO: 8337 - RNA, 20 nt, Artificial Sequence
  Synthetic
gugguccgugagcucggcca

SEQ ID NO: 8338 - RNA, 20 nt, Artificial Sequence
  Synthetic
ggggggccggccccgggcca

SEQ ID NO: 8339 - RNA, 20 nt, Artificial Sequence
  Synthetic
guagcggcggcucauggcca

SEQ ID NO: 8340 - RNA, 20 nt, Artificial Sequence
  Synthetic
ucgcggcgacaggcuggcca

SEQ ID NO: 8341 - RNA, 20 nt, Artificial Sequence
  Synthetic
cagcagccccaggaacucca

SEQ ID NO: 8342 - RNA, 20 nt, Artificial Sequence
  Synthetic
gcaggcggccaggcacucca

SEQ ID NO: 8343 - RNA, 20 nt, Artificial Sequence
  Synthetic
cggggcgcaguaggccucca

SEQ ID NO: 8344 - RNA, 20 nt, Artificial Sequence
  Synthetic
cagcuccgcguccaugucca

SEQ ID NO: 8345 - RNA, 20 nt, Artificial Sequence
  Synthetic
cgcguucucgcgcgccagca

SEQ ID NO: 8346 - RNA, 20 nt, Artificial Sequence
  Synthetic
cacgcggccggaggccagca

SEQ ID NO: 8347 - RNA, 20 nt, Artificial Sequence
  Synthetic
ggcgacggugucggccagca

SEQ ID NO: 8348 - RNA, 20 nt, Artificial Sequence
  Synthetic
gccguccagcgccgggagca

SEQ ID NO: 8349 - RNA, 20 nt, Artificial Sequence
  Synthetic
gccgagggccccgacccgca

SEQ ID NO: 8350 - RNA, 20 nt, Artificial Sequence
  Synthetic
ccgcgccgccggccagcgca

SEQ ID NO: 8351 - RNA, 20 nt, Artificial Sequence
  Synthetic
cuccgccgggccgccgcgca

SEQ ID NO: 8352 - RNA, 20 nt, Artificial Sequence
  Synthetic
gaccaggcucacggcgcgca

SEQ ID NO: 8353 - RNA, 20 nt, Artificial Sequence
  Synthetic
gggccaguccgcggcgcgca

SEQ ID NO: 8354 - RNA, 20 nt, Artificial Sequence
  Synthetic
gucucggcgcugggcgcgca

SEQ ID NO: 8355 - RNA, 20 nt, Artificial Sequence
  Synthetic
ggcuccggccagccccggca

SEQ ID NO: 8356 - RNA, 20 nt, Artificial Sequence
  Synthetic
ggcguaccccagguggggca

SEQ ID NO: 8357 - RNA, 20 nt, Artificial Sequence
  Synthetic
ccagcgcacggcgcacugca

SEQ ID NO: 8358 - RNA, 20 nt, Artificial Sequence
  Synthetic
guacagcagccgcgugauca

SEQ ID NO: 8359 - RNA, 20 nt, Artificial Sequence
  Synthetic
gcgggccguggccgagcuca

SEQ ID NO: 8360 - RNA, 20 nt, Artificial Sequence
  Synthetic
ggccccggcgaccaggcuca

SEQ ID NO: 8361 - RNA, 20 nt, Artificial Sequence
  Synthetic
gcggucguagcggcggcuca

SEQ ID NO: 8362 - RNA, 20 nt, Artificial Sequence
  Synthetic
cgacgccacgggccgcuuca

SEQ ID NO: 8363 - RNA, 20 nt, Artificial Sequence
  Synthetic
ccgcuacgaccgcgcgcaga

SEQ ID NO: 8364 - RNA, 20 nt, Artificial Sequence
  Synthetic
gcgccccagcgccacguaga

SEQ ID NO: 8365 - RNA, 20 nt, Artificial Sequence
  Synthetic
gucgcgguagcgcgcguaga

SEQ ID NO: 8366 - RNA, 20 nt, Artificial Sequence
  Synthetic
ggcgacgccaaccgccacga

SEQ ID NO: 8367 - RNA, 20 nt, Artificial Sequence
  Synthetic
gacgacgacgacgacgacga

SEQ ID NO: 8368 - RNA, 20 nt, Artificial Sequence
  Synthetic
gagcuggaggacgacgacga

SEQ ID NO: 8369 - RNA, 20 nt, Artificial Sequence
  Synthetic
ggggcgcgaacccccgacga

SEQ ID NO: 8370 - RNA, 20 nt, Artificial Sequence
  Synthetic
cgggcgcugcucgagcccga

SEQ ID NO: 8371 - RNA, 20 nt, Artificial Sequence
  Synthetic
cugacccgccggcccgccga

SEQ ID NO: 8372 - RNA, 20 nt, Artificial Sequence
  Synthetic
gccgcggacuggcccgccga

SEQ ID NO: 8373 - RNA, 20 nt, Artificial Sequence
  Synthetic
gccggcgacgccgccgccga

SEQ ID NO: 8374 - RNA, 20 nt, Artificial Sequence
  Synthetic
cuccucgucguccgcgccga

SEQ ID NO: 8375 - RNA, 20 nt, Artificial Sequence
  Synthetic
gccuccagggcggcggccga

SEQ ID NO: 8376 - RNA, 20 nt, Artificial Sequence
  Synthetic
cgaggcgcgcagcgggccga

SEQ ID NO: 8377 - RNA, 20 nt, Artificial Sequence
  Synthetic
uucuacgcgcgcuaccgcga

SEQ ID NO: 8378 - RNA, 20 nt, Artificial Sequence
  Synthetic
ggaggcgggggugcccgcga

SEQ ID NO: 8379 - RNA, 20 nt, Artificial Sequence
  Synthetic
cacgccggacgcggaggcga

SEQ ID NO: 8380 - RNA, 20 nt, Artificial Sequence
  Synthetic
gaacuccacggcgccggcga

SEQ ID NO: 8381 - RNA, 20 nt, Artificial Sequence
  Synthetic
gagcgagucggccgcggcga

SEQ ID NO: 8382 - RNA, 20 nt, Artificial Sequence
  Synthetic
gcgcuggcggagggcuucga

SEQ ID NO: 8383 - RNA, 20 nt, Artificial Sequence
  Synthetic
auccuggaggcgcuggcgga

SEQ ID NO: 8384 - RNA, 20 nt, Artificial Sequence
  Synthetic
ggggcgcggcccccgcggga

SEQ ID NO: 8385 - RNA, 20 nt, Artificial Sequence
  Synthetic
ggccgcgggccgcgcgggga

SEQ ID NO: 8386 - RNA, 20 nt, Artificial Sequence
  Synthetic
gccgugcucccggcgcugga

SEQ ID NO: 8387 - RNA, 20 nt, Artificial Sequence
  Synthetic
cgcgcgcgggucgaacauga

SEQ ID NO: 8388 - RNA, 20 nt, Artificial Sequence
  Synthetic
cgccacgcugccggagauga

SEQ ID NO: 8389 - RNA, 20 nt, Artificial Sequence
  Synthetic
cgcgcggugcccgccggcua

SEQ ID NO: 8390 - RNA, 20 nt, Artificial Sequence
  Synthetic
cccccggggcgcgugcugua

SEQ ID NO: 8391 - RNA, 20 nt, Artificial Sequence
  Synthetic
acgccgccgccgacggcaac

SEQ ID NO: 8392 - RNA, 20 nt, Artificial Sequence
  Synthetic
cggccgccugggcgggcaac

SEQ ID NO: 8393 - RNA, 20 nt, Artificial Sequence
  Synthetic
ugcuggcggcccugggcaac

SEQ ID NO: 8394 - RNA, 20 nt, Artificial Sequence
  Synthetic
gggcgcccgaggccucgaac

SEQ ID NO: 8395 - RNA, 20 nt, Artificial Sequence
  Synthetic
cccagcucgggcgcccacac

SEQ ID NO: 8396 - RNA, 20 nt, Artificial Sequence
  Synthetic
gcgugcugccgcgagaccac

SEQ ID NO: 8397 - RNA, 20 nt, Artificial Sequence
  Synthetic
guggccggccgcgacgccac

SEQ ID NO: 8398 - RNA, 20 nt, Artificial Sequence
  Synthetic
agcuccgcguccauguccac

SEQ ID NO: 8399 - RNA, 20 nt, Artificial Sequence
  Synthetic
cgccccagcgccacguagac

SEQ ID NO: 8400 - RNA, 20 nt, Artificial Sequence
  Synthetic
ccgcggacuggcccgccgac

SEQ ID NO: 8401 - RNA, 20 nt, Artificial Sequence
  Synthetic
ucuacgcgcgcuaccgcgac

SEQ ID NO: 8402 - RNA, 20 nt, Artificial Sequence
  Synthetic
gcgccgggggucgcggcgac

SEQ ID NO: 8403 - RNA, 20 nt, Artificial Sequence
  Synthetic
acgccgugcgcgccgcggac

SEQ ID NO: 8404 - RNA, 20 nt, Artificial Sequence
  Synthetic
gggccgcuggguccgcggac

SEQ ID NO: 8405 - RNA, 20 nt, Artificial Sequence
  Synthetic
gccugggcgggcaacuggac

SEQ ID NO: 8406 - RNA, 20 nt, Artificial Sequence
  Synthetic
cgcgagaacgcggcgcugac

SEQ ID NO: 8407 - RNA, 20 nt, Artificial Sequence
  Synthetic
gcggcggcgcgucgggguac

SEQ ID NO: 8408 - RNA, 20 nt, Artificial Sequence
  Synthetic
ggcgcccgaggccucgaacc

SEQ ID NO: 8409 - RNA, 20 nt, Artificial Sequence
  Synthetic
ggcgcgggccgugccccacc

SEQ ID NO: 8410 - RNA, 20 nt, Artificial Sequence
  Synthetic
cguccuccgggucgggcacc

SEQ ID NO: 8411 - RNA, 20 nt, Artificial Sequence
  Synthetic
gaugcgccaggugcccgacc

SEQ ID NO: 8412 - RNA, 20 nt, Artificial Sequence
  Synthetic
ggagggcuucgacggcgacc

SEQ ID NO: 8413 - RNA, 20 nt, Artificial Sequence
  Synthetic
ggcccagggccccggcgacc

SEQ ID NO: 8414 - RNA, 20 nt, Artificial Sequence
  Synthetic
gccgcugccgggcgaggacc

SEQ ID NO: 8415 - RNA, 20 nt, Artificial Sequence
  Synthetic
gcugcuguccacgcgggacc

SEQ ID NO: 8416 - RNA, 20 nt, Artificial Sequence
  Synthetic
cggggacguggcgcuggacc

SEQ ID NO: 8417 - RNA, 20 nt, Artificial Sequence
  Synthetic
gcgagaacgcggcgcugacc

SEQ ID NO: 8418 - RNA, 20 nt, Artificial Sequence
  Synthetic
cucgcggcagcacgccuacc

SEQ ID NO: 8419 - RNA, 20 nt, Artificial Sequence
  Synthetic
cgcgguccgcggggcguacc

SEQ ID NO: 8420 - RNA, 20 nt, Artificial Sequence
  Synthetic
uccacgcgcgcgaagacccc

SEQ ID NO: 8421 - RNA, 20 nt, Artificial Sequence
  Synthetic
cagccugucgccgcgacccc

SEQ ID NO: 8422 - RNA, 20 nt, Artificial Sequence
  Synthetic
ccgccgccauggcguacccc

SEQ ID NO: 8423 - RNA, 20 nt, Artificial Sequence
  Synthetic
cgccgggggcgggccccccc

SEQ ID NO: 8424 - RNA, 20 nt, Artificial Sequence
  Synthetic
ggggccggccccccgccccc

SEQ ID NO: 8425 - RNA, 20 nt, Artificial Sequence
  Synthetic
cgcugcgccgccccgccccc

SEQ ID NO: 8426 - RNA, 20 nt, Artificial Sequence
  Synthetic
ucggccggggcgccgccccc

SEQ ID NO: 8427 - RNA, 20 nt, Artificial Sequence
  Synthetic
aggcgccggccagcagcccc

SEQ ID NO: 8428 - RNA, 20 nt, Artificial Sequence
  Synthetic
cggggccggccccccgcccc

SEQ ID NO: 8429 - RNA, 20 nt, Artificial Sequence
  Synthetic
cuccggggggggcccgcccc

SEQ ID NO: 8430 - RNA, 20 nt, Artificial Sequence
  Synthetic
cucggccggggcgccgcccc

SEQ ID NO: 8431 - RNA, 20 nt, Artificial Sequence
  Synthetic
cgccguacagcacgcgcccc

SEQ ID NO: 8432 - RNA, 20 nt, Artificial Sequence
  Synthetic
gcgcggcgcucaggcgcccc

SEQ ID NO: 8433 - RNA, 20 nt, Artificial Sequence
  Synthetic
gggggcggggggccggcccc

SEQ ID NO: 8434 - RNA, 20 nt, Artificial Sequence
  Synthetic
ggggugcccgcgagggcccc

SEQ ID NO: 8435 - RNA, 20 nt, Artificial Sequence
  Synthetic
cggccgcgcccgcgggcccc

SEQ ID NO: 8436 - RNA, 20 nt, Artificial Sequence
  Synthetic
ugguccagcgccacgucccc

SEQ ID NO: 8437 - RNA, 20 nt, Artificial Sequence
  Synthetic
ggccgggcuccggccagccc

SEQ ID NO: 8438 - RNA, 20 nt, Artificial Sequence
  Synthetic
caagcgcaagagccccgccc

SEQ ID NO: 8439 - RNA, 20 nt, Artificial Sequence
  Synthetic
cgccccggccgagcccgccc

SEQ ID NO: 8440 - RNA, 20 nt, Artificial Sequence
  Synthetic
gcccagggccgagcccgccc

SEQ ID NO: 8441 - RNA, 20 nt, Artificial Sequence
  Synthetic
gccgguccaguugcccgccc

SEQ ID NO: 8442 - RNA, 20 nt, Artificial Sequence
  Synthetic
gggcugggcgacagccgccc

SEQ ID NO: 8443 - RNA, 20 nt, Artificial Sequence
  Synthetic
ggcgcccucggccgccgccc

SEQ ID NO: 8444 - RNA, 20 nt, Artificial Sequence
  Synthetic
cgcgggggugcucgccgccc

SEQ ID NO: 8445 - RNA, 20 nt, Artificial Sequence
  Synthetic
ccgccguacagcacgcgccc

SEQ ID NO: 8446 - RNA, 20 nt, Artificial Sequence
  Synthetic
cccgccgcgcccccgcgccc

SEQ ID NO: 8447 - RNA, 20 nt, Artificial Sequence
  Synthetic
cgggccgcagcggcgcgccc

SEQ ID NO: 8448 - RNA, 20 nt, Artificial Sequence
  Synthetic
gucgucggggguucgcgccc

SEQ ID NO: 8449 - RNA, 20 nt, Artificial Sequence
  Synthetic
ggcgccgcccggcggcgccc

SEQ ID NO: 8450 - RNA, 20 nt, Artificial Sequence
  Synthetic
gggccccgggggcggcgccc

SEQ ID NO: 8451 - RNA, 20 nt, Artificial Sequence
  Synthetic
guucgaggccucgggcgccc

SEQ ID NO: 8452 - RNA, 20 nt, Artificial Sequence
  Synthetic
agaacccgcgcguggcgccc

SEQ ID NO: 8453 - RNA, 20 nt, Artificial Sequence
  Synthetic
cgggggcggggggccggccc

SEQ ID NO: 8454 - RNA, 20 nt, Artificial Sequence
  Synthetic
gcuucacggccgggcggccc

SEQ ID NO: 8455 - RNA, 20 nt, Artificial Sequence
  Synthetic
guccugccugcuggcggccc

SEQ ID NO: 8456 - RNA, 20 nt, Artificial Sequence
  Synthetic
ggccggggcgggcucggccc

SEQ ID NO: 8457 - RNA, 20 nt, Artificial Sequence
  Synthetic
gucgucgucgucgucggccc

SEQ ID NO: 8458 - RNA, 20 nt, Artificial Sequence
  Synthetic
cagcgccgggcccagggccc

SEQ ID NO: 8459 - RNA, 20 nt, Artificial Sequence
  Synthetic
gggggugcccgcgagggccc

SEQ ID NO: 8460 - RNA, 20 nt, Artificial Sequence
  Synthetic
uccgcggcagcgccgggccc

SEQ ID NO: 8461 - RNA, 20 nt, Artificial Sequence
  Synthetic
gcggccgcgcccgcgggccc

SEQ ID NO: 8462 - RNA, 20 nt, Artificial Sequence
  Synthetic
gagccuggucgccggggccc

SEQ ID NO: 8463 - RNA, 20 nt, Artificial Sequence
  Synthetic
gccggcguguggcugggccc

SEQ ID NO: 8464 - RNA, 20 nt, Artificial Sequence
  Synthetic
ucagcggggagccguggccc

SEQ ID NO: 8465 - RNA, 20 nt, Artificial Sequence
  Synthetic
gcccgcagagccgguugccc

SEQ ID NO: 8466 - RNA, 20 nt, Artificial Sequence
  Synthetic
cugguccagcgccacguccc

SEQ ID NO: 8467 - RNA, 20 nt, Artificial Sequence
  Synthetic
gaaccgcagcucgcgcagcc

SEQ ID NO: 8468 - RNA, 20 nt, Artificial Sequence
  Synthetic
ugccggggcuggccggagcc

SEQ ID NO: 8469 - RNA, 20 nt, Artificial Sequence
  Synthetic
cgccgugcgcgccgugagcc

SEQ ID NO: 8470 - RNA, 20 nt, Artificial Sequence
  Synthetic
ggcguccagcucgacccgcc

SEQ ID NO: 8471 - RNA, 20 nt, Artificial Sequence
  Synthetic
ggcuggcgccgccagccgcc

SEQ ID NO: 8472 - RNA, 20 nt, Artificial Sequence
  Synthetic
gggccgccuggagcgccgcc

SEQ ID NO: 8473 - RNA, 20 nt, Artificial Sequence
  Synthetic
aaggcggcgggcgcgccgcc

SEQ ID NO: 8474 - RNA, 20 nt, Artificial Sequence
  Synthetic
gccccggccagggcgccgcc

SEQ ID NO: 8475 - RNA, 20 nt, Artificial Sequence
  Synthetic
ggggggcgcggggcgccgcc

SEQ ID NO: 8476 - RNA, 20 nt, Artificial Sequence
  Synthetic
gcgggcccgccacggccgcc

SEQ ID NO: 8477 - RNA, 20 nt, Artificial Sequence
  Synthetic
ccagccccggcacggccgcc

SEQ ID NO: 8478 - RNA, 20 nt, Artificial Sequence
  Synthetic
cgcggcgaccgcgggccgcc

SEQ ID NO: 8479 - RNA, 20 nt, Artificial Sequence
  Synthetic
cucgacccgccggggccgcc

SEQ ID NO: 8480 - RNA, 20 nt, Artificial Sequence
  Synthetic
gcggcccgcgcagcuccgcc

SEQ ID NO: 8481 - RNA, 20 nt, Artificial Sequence
  Synthetic
cggcccggccguccagcgcc

SEQ ID NO: 8482 - RNA, 20 nt, Artificial Sequence
  Synthetic
gcgggcuccgcggcagcgcc

SEQ ID NO: 8483 - RNA, 20 nt, Artificial Sequence
  Synthetic
gcccgccgcgcccccgcgcc

SEQ ID NO: 8484 - RNA, 20 nt, Artificial Sequence
  Synthetic
accuggccgcgggccgcgcc

SEQ ID NO: 8485 - RNA, 20 nt, Artificial Sequence
  Synthetic
ucgcagaaguccggcgcgcc

SEQ ID NO: 8486 - RNA, 20 nt, Artificial Sequence
  Synthetic
acgcgccccgccugcgcgcc

SEQ ID NO: 8487 - RNA, 20 nt, Artificial Sequence
  Synthetic
cgggcgcccacacgggcgcc

SEQ ID NO: 8488 - RNA, 20 nt, Artificial Sequence
  Synthetic
gguggugucggcggggcgcc

SEQ ID NO: 8489 - RNA, 20 nt, Artificial Sequence
  Synthetic
gcgggcgacgccauggcgcc

SEQ ID NO: 8490 - RNA, 20 nt, Artificial Sequence
  Synthetic
cuuccccgcgccguggcgcc

SEQ ID NO: 8491 - RNA, 20 nt, Artificial Sequence
  Synthetic
cagaacccgcgcguggcgcc

SEQ ID NO: 8492 - RNA, 20 nt, Artificial Sequence
  Synthetic
cgcggcggccuggaugcgcc

SEQ ID NO: 8493 - RNA, 20 nt, Artificial Sequence
  Synthetic
cggcggccgccacgugcgcc

SEQ ID NO: 8494 - RNA, 20 nt, Artificial Sequence
  Synthetic
cccgcggccagguccucgcc

SEQ ID NO: 8495 - RNA, 20 nt, Artificial Sequence
  Synthetic
gcgccgugagccuggucgcc

SEQ ID NO: 8496 - RNA, 20 nt, Artificial Sequence
  Synthetic
ccacggcgccggcgaaggcc

SEQ ID NO: 8497 - RNA, 20 nt, Artificial Sequence
  Synthetic
ccgagauccggaagcaggcc

SEQ ID NO: 8498 - RNA, 20 nt, Artificial Sequence
  Synthetic
cgggcagcaccucgcaggcc

SEQ ID NO: 8499 - RNA, 20 nt, Artificial Sequence
  Synthetic
ucgggcgccccccagaggcc

SEQ ID NO: 8500 - RNA, 20 nt, Artificial Sequence
  Synthetic
ccacgggccgcuucacggcc

SEQ ID NO: 8501 - RNA, 20 nt, Artificial Sequence
  Synthetic
gcucccggcgcuggacggcc

SEQ ID NO: 8502 - RNA, 20 nt, Artificial Sequence
  Synthetic
gcaagagccccgccccggcc

SEQ ID NO: 8503 - RNA, 20 nt, Artificial Sequence
  Synthetic
gggccgagcccgccccggcc

SEQ ID NO: 8504 - RNA, 20 nt, Artificial Sequence
  Synthetic
cgcccgccuccgcgccggcc

SEQ ID NO: 8505 - RNA, 20 nt, Artificial Sequence
  Synthetic
ccccggcgcggcccgcggcc

SEQ ID NO: 8506 - RNA, 20 nt, Artificial Sequence
  Synthetic
ggaucccgcggcaggcggcc

SEQ ID NO: 8507 - RNA, 20 nt, Artificial Sequence
  Synthetic
cgcugcgccgcgcggcggcc

SEQ ID NO: 8508 - RNA, 20 nt, Artificial Sequence
  Synthetic
cgacgccgugcgcggcggcc

SEQ ID NO: 8509 - RNA, 20 nt, Artificial Sequence
  Synthetic
ccgcgcccgaggcggcggcc

SEQ ID NO: 8510 - RNA, 20 nt, Artificial Sequence
  Synthetic
ggcccugggcgggcucggcc

SEQ ID NO: 8511 - RNA, 20 nt, Artificial Sequence
  Synthetic
gcgggucgaacaugagggcc

SEQ ID NO: 8512 - RNA, 20 nt, Artificial Sequence
  Synthetic
ucgccgcggggguccgggcc

SEQ ID NO: 8513 - RNA, 20 nt, Artificial Sequence
  Synthetic
cggccaccgccgcgcgggcc

SEQ ID NO: 8514 - RNA, 20 nt, Artificial Sequence
  Synthetic
aggcggaggaggcgcgggcc

SEQ ID NO: 8515 - RNA, 20 nt, Artificial Sequence
  Synthetic
gcgcgggggcgcggcgggcc

SEQ ID NO: 8516 - RNA, 20 nt, Artificial Sequence
  Synthetic
uccggccgcguguucgggcc

SEQ ID NO: 8517 - RNA, 20 nt, Artificial Sequence
  Synthetic
cgccugcgcgcgcuggggcc

SEQ ID NO: 8518 - RNA, 20 nt, Artificial Sequence
  Synthetic
gggccgcuucggcuggggcc

SEQ ID NO: 8519 - RNA, 20 nt, Artificial Sequence
  Synthetic
ggucgccggggcccugggcc

SEQ ID NO: 8520 - RNA, 20 nt, Artificial Sequence
  Synthetic
cgcccggcggcgcccuggcc

SEQ ID NO: 8521 - RNA, 20 nt, Artificial Sequence
  Synthetic
gucagcggggagccguggcc

SEQ ID NO: 8522 - RNA, 20 nt, Artificial Sequence
  Synthetic
auccucuacucgccgcugcc

SEQ ID NO: 8523 - RNA, 20 nt, Artificial Sequence
  Synthetic
ccgcguggccguggagugcc

SEQ ID NO: 8524 - RNA, 20 nt, Artificial Sequence
  Synthetic
ggcgaccuggcggccgugcc

SEQ ID NO: 8525 - RNA, 20 nt, Artificial Sequence
  Synthetic
gucgggcaccuggcgcaucc

SEQ ID NO: 8526 - RNA, 20 nt, Artificial Sequence
  Synthetic
ggccgccugccgcgggaucc

SEQ ID NO: 8527 - RNA, 20 nt, Artificial Sequence
  Synthetic
cgcgcucggcggaccacucc

SEQ ID NO: 8528 - RNA, 20 nt, Artificial Sequence
  Synthetic
agcccuccgccagcgccucc

SEQ ID NO: 8529 - RNA, 20 nt, Artificial Sequence
  Synthetic
gcggggcgcaguaggccucc

SEQ ID NO: 8530 - RNA, 20 nt, Artificial Sequence
  Synthetic
ucaccacgcgcacguccucc

SEQ ID NO: 8531 - RNA, 20 nt, Artificial Sequence
  Synthetic
cgcgggcccggcggcgcucc

SEQ ID NO: 8532 - RNA, 20 nt, Artificial Sequence
  Synthetic
guaccgccgcgccgugcucc

SEQ ID NO: 8533 - RNA, 20 nt, Artificial Sequence
  Synthetic
cgcggucgccgcgggggucc

SEQ ID NO: 8534 - RNA, 20 nt, Artificial Sequence
  Synthetic
acaggcuggccauggggucc

SEQ ID NO: 8535 - RNA, 20 nt, Artificial Sequence
  Synthetic
cgccggcgccguggaguucc

SEQ ID NO: 8536 - RNA, 20 nt, Artificial Sequence
  Synthetic
cgcgcccgagauccggaagc

SEQ ID NO: 8537 - RNA, 20 nt, Artificial Sequence
  Synthetic
cgucgucgcgcagcaccagc

SEQ ID NO: 8538 - RNA, 20 nt, Artificial Sequence
  Synthetic
gguugcccagggccgccagc

SEQ ID NO: 8539 - RNA, 20 nt, Artificial Sequence
  Synthetic
ccgcguucucgcgcgccagc

SEQ ID NO: 8540 - RNA, 20 nt, Artificial Sequence
  Synthetic
cggcgacggugucggccagc

SEQ ID NO: 8541 - RNA, 20 nt, Artificial Sequence
  Synthetic
gcgggcccgaggcgcgcagc

SEQ ID NO: 8542 - RNA, 20 nt, Artificial Sequence
  Synthetic
aggccgccgcgcggcgcagc

SEQ ID NO: 8543 - RNA, 20 nt, Artificial Sequence
  Synthetic
cggcggcggcggagcucagc

SEQ ID NO: 8544 - RNA, 20 nt, Artificial Sequence
  Synthetic
accgcgacggguacgucagc

SEQ ID NO: 8545 - RNA, 20 nt, Artificial Sequence
  Synthetic
cgcggcgcaggcuggucagc

SEQ ID NO: 8546 - RNA, 20 nt, Artificial Sequence
  Synthetic
gccacggcgcggggaagagc

SEQ ID NO: 8547 - RNA, 20 nt, Artificial Sequence
  Synthetic
ggcucugguucuggaagagc

SEQ ID NO: 8548 - RNA, 20 nt, Artificial Sequence
  Synthetic
ccguggcgggcccgcagagc

SEQ ID NO: 8549 - RNA, 20 nt, Artificial Sequence
  Synthetic
gcccgugugggcgcccgagc

SEQ ID NO: 8550 - RNA, 20 nt, Artificial Sequence
  Synthetic
gcggccccggcgggucgagc

SEQ ID NO: 8551 - RNA, 20 nt, Artificial Sequence
  Synthetic
cguggacauggacgcggagc

SEQ ID NO: 8552 - RNA, 20 nt, Artificial Sequence
  Synthetic
cacccccgcggcgccguagc

SEQ ID NO: 8553 - RNA, 20 nt, Artificial Sequence
  Synthetic
gccggggcccagccacacgc

SEQ ID NO: 8554 - RNA, 20 nt, Artificial Sequence
  Synthetic
gcgcuucggccccgacacgc

SEQ ID NO: 8555 - RNA, 20 nt, Artificial Sequence
  Synthetic
cacgcggcugcuguacacgc

SEQ ID NO: 8556 - RNA, 20 nt, Artificial Sequence
  Synthetic
cgugcugcugcuguccacgc

SEQ ID NO: 8557 - RNA, 20 nt, Artificial Sequence
  Synthetic
gaugacgacgaccgcgacgc

SEQ ID NO: 8558 - RNA, 20 nt, Artificial Sequence
  Synthetic
cugcgcgacgacgcggacgc

SEQ ID NO: 8559 - RNA, 20 nt, Artificial Sequence
  Synthetic
gcccgcccccgcagauacgc

SEQ ID NO: 8560 - RNA, 20 nt, Artificial Sequence
  Synthetic
ccggccgccgccaccaccgc

SEQ ID NO: 8561 - RNA, 20 nt, Artificial Sequence
  Synthetic
cggacccccgcggcgaccgc

SEQ ID NO: 8562 - RNA, 20 nt, Artificial Sequence
  Synthetic
cgccgagggccccgacccgc

SEQ ID NO: 8563 - RNA, 20 nt, Artificial Sequence
  Synthetic
cggcguccagcucgacccgc

SEQ ID NO: 8564 - RNA, 20 nt, Artificial Sequence
  Synthetic
gccccgcggcgcugacccgc

SEQ ID NO: 8565 - RNA, 20 nt, Artificial Sequence
  Synthetic
gccgccggcgcgccccccgc

SEQ ID NO: 8566 - RNA, 20 nt, Artificial Sequence
  Synthetic
cgacggcgacgcgcccccgc

SEQ ID NO: 8567 - RNA, 20 nt, Artificial Sequence
  Synthetic
gcggggggcgcggcccccgc

SEQ ID NO: 8568 - RNA, 20 nt, Artificial Sequence
  Synthetic
ggaggccuacugcgccccgc

SEQ ID NO: 8569 - RNA, 20 nt, Artificial Sequence
  Synthetic
acgacggcgacgacgcccgc

SEQ ID NO: 8570 - RNA, 20 nt, Artificial Sequence
  Synthetic
ggcggggcggccgcgcccgc

SEQ ID NO: 8571 - RNA, 20 nt, Artificial Sequence
  Synthetic
ugagcucggccacggcccgc

SEQ ID NO: 8572 - RNA, 20 nt, Artificial Sequence
  Synthetic
cccccgcgcccggggcccgc

SEQ ID NO: 8573 - RNA, 20 nt, Artificial Sequence
  Synthetic
gacgagcgcgcggugcccgc

SEQ ID NO: 8574 - RNA, 20 nt, Artificial Sequence
  Synthetic
cccgcggccgccccucccgc

SEQ ID NO: 8575 - RNA, 20 nt, Artificial Sequence
  Synthetic
ggcggcggcgggcuucccgc

SEQ ID NO: 8576 - RNA, 20 nt, Artificial Sequence
  Synthetic
cggcuggcgccgccagccgc

SEQ ID NO: 8577 - RNA, 20 nt, Artificial Sequence
  Synthetic
agcgccgcagaccacgccgc

SEQ ID NO: 8578 - RNA, 20 nt, Artificial Sequence
  Synthetic
accaccaccaccaccgccgc

SEQ ID NO: 8579 - RNA, 20 nt, Artificial Sequence
  Synthetic
gaggugguggggaccgccgc

SEQ ID NO: 8580 - RNA, 20 nt, Artificial Sequence
  Synthetic
ggccggcgggucagcgccgc

SEQ ID NO: 8581 - RNA, 20 nt, Artificial Sequence
  Synthetic
cgggccgccuggagcgccgc

SEQ ID NO: 8582 - RNA, 20 nt, Artificial Sequence
  Synthetic
cggcgcaggucccgcgccgc

SEQ ID NO: 8583 - RNA, 20 nt, Artificial Sequence
  Synthetic
cgcgcccgccuccgcgccgc

SEQ ID NO: 8584 - RNA, 20 nt, Artificial Sequence
  Synthetic
gaaggcggcgggcgcgccgc

SEQ ID NO: 8585 - RNA, 20 nt, Artificial Sequence
  Synthetic
cccgccggcuacggcgccgc

SEQ ID NO: 8586 - RNA, 20 nt, Artificial Sequence
  Synthetic
cgccccggccagggcgccgc

SEQ ID NO: 8587 - RNA, 20 nt, Artificial Sequence
  Synthetic
aggcggcccgcggucgccgc

SEQ ID NO: 8588 - RNA, 20 nt, Artificial Sequence
  Synthetic
cccgcgggaggggcggccgc

SEQ ID NO: 8589 - RNA, 20 nt, Artificial Sequence
  Synthetic
auacgcugggcgucggccgc

SEQ ID NO: 8590 - RNA, 20 nt, Artificial Sequence
  Synthetic
acgaccgcgacgcgggccgc

SEQ ID NO: 8591 - RNA, 20 nt, Artificial Sequence
  Synthetic
ccgggcgaggaccuggccgc

SEQ ID NO: 8592 - RNA, 20 nt, Artificial Sequence
  Synthetic
agugccuggccgccugccgc

SEQ ID NO: 8593 - RNA, 20 nt, Artificial Sequence
  Synthetic
cacggcggccucgcugccgc

SEQ ID NO: 8594 - RNA, 20 nt, Artificial Sequence
  Synthetic
cgccgcugcgccucugccgc

SEQ ID NO: 8595 - RNA, 20 nt, Artificial Sequence
  Synthetic
cgcggcccgcgcagcuccgc

SEQ ID NO: 8596 - RNA, 20 nt, Artificial Sequence
  Synthetic
agacgacguccgcgguccgc

SEQ ID NO: 8597 - RNA, 20 nt, Artificial Sequence
  Synthetic
gcggcccggccguccagcgc

SEQ ID NO: 8598 - RNA, 20 nt, Artificial Sequence
  Synthetic
cgcgggcuccgcggcagcgc

SEQ ID NO: 8599 - RNA, 20 nt, Artificial Sequence
  Synthetic
agucagaggcggccgagcgc

SEQ ID NO: 8600 - RNA, 20 nt, Artificial Sequence
  Synthetic
cguccccgggcgccacgcgc

SEQ ID NO: 8601 - RNA, 20 nt, Artificial Sequence
  Synthetic
cgcugccgccggccacgcgc

SEQ ID NO: 8602 - RNA, 20 nt, Artificial Sequence
  Synthetic
gcgguucgugcgcgacgcgc

SEQ ID NO: 8603 - RNA, 20 nt, Artificial Sequence
  Synthetic
ccacgcgcagguccccgcgc

SEQ ID NO: 8604 - RNA, 20 nt, Artificial Sequence
  Synthetic
gcggccggccaccgccgcgc

SEQ ID NO: 8605 - RNA, 20 nt, Artificial Sequence
  Synthetic
gcgucggccgcgggccgcgc

SEQ ID NO: 8606 - RNA, 20 nt, Artificial Sequence
  Synthetic
gaccuggccgcgggccgcgc

SEQ ID NO: 8607 - RNA, 20 nt, Artificial Sequence
  Synthetic
cgccgcgcccgccuccgcgc

SEQ ID NO: 8608 - RNA, 20 nt, Artificial Sequence
  Synthetic
cgcggcccgccuccgcgcgc

SEQ ID NO: 8609 - RNA, 20 nt, Artificial Sequence
  Synthetic
gcccaggccccagcgcgcgc

SEQ ID NO: 8610 - RNA, 20 nt, Artificial Sequence
  Synthetic
ccagcgaggccagcgcgcgc

SEQ ID NO: 8611 - RNA, 20 nt, Artificial Sequence
  Synthetic
cauguucgacccgcgcgcgc

SEQ ID NO: 8612 - RNA, 20 nt, Artificial Sequence
  Synthetic
cgcaccgcgccugcgcgcgc

SEQ ID NO: 8613 - RNA, 20 nt, Artificial Sequence
  Synthetic
gcucgcgcagccaggcgcgc

SEQ ID NO: 8614 - RNA, 20 nt, Artificial Sequence
  Synthetic
cgccauggcgcccggcgcgc

SEQ ID NO: 8615 - RNA, 20 nt, Artificial Sequence
  Synthetic
cucgcagaaguccggcgcgc

SEQ ID NO: 8616 - RNA, 20 nt, Artificial Sequence
  Synthetic
agcgccggcggggggcgcgc

SEQ ID NO: 8617 - RNA, 20 nt, Artificial Sequence
  Synthetic
cgucucggcgcugggcgcgc

SEQ ID NO: 8618 - RNA, 20 nt, Artificial Sequence
  Synthetic
gcggcgggaguucugcgcgc

SEQ ID NO: 8619 - RNA, 20 nt, Artificial Sequence
  Synthetic
cggcgcggcgguacucgcgc

SEQ ID NO: 8620 - RNA, 20 nt, Artificial Sequence
  Synthetic
guagcgcgcguagaaggcgc

SEQ ID NO: 8621 - RNA, 20 nt, Artificial Sequence
  Synthetic
cggcggagcucagcaggcgc

SEQ ID NO: 8622 - RNA, 20 nt, Artificial Sequence
  Synthetic
gaggcggcggucgcaggcgc

SEQ ID NO: 8623 - RNA, 20 nt, Artificial Sequence
  Synthetic
gcccgaggcggaggaggcgc

SEQ ID NO: 8624 - RNA, 20 nt, Artificial Sequence
  Synthetic
ccgcgggauccuggaggcgc

SEQ ID NO: 8625 - RNA, 20 nt, Artificial Sequence
  Synthetic
agggccgggcgccacggcgc

SEQ ID NO: 8626 - RNA, 20 nt, Artificial Sequence
  Synthetic
ccccaggaacuccacggcgc

SEQ ID NO: 8627 - RNA, 20 nt, Artificial Sequence
  Synthetic
gacgacgacgacgacggcgc

SEQ ID NO: 8628 - RNA, 20 nt, Artificial Sequence
  Synthetic
ccgcgccgugcucccggcgc

SEQ ID NO: 8629 - RNA, 20 nt, Artificial Sequence
  Synthetic
ggggcgcguaggcgcggcgc

SEQ ID NO: 8630 - RNA, 20 nt, Artificial Sequence
  Synthetic
cgugcgcuggccggcggcgc

SEQ ID NO: 8631 - RNA, 20 nt, Artificial Sequence
  Synthetic
cgcggcguggucugcggcgc

SEQ ID NO: 8632 - RNA, 20 nt, Artificial Sequence
  Synthetic
aggccagcacggugcggcgc

SEQ ID NO: 8633 - RNA, 20 nt, Artificial Sequence
  Synthetic
cgcccccgacgucucggcgc

SEQ ID NO: 8634 - RNA, 20 nt, Artificial Sequence
  Synthetic
agggcggcggccgagggcgc

SEQ ID NO: 8635 - RNA, 20 nt, Artificial Sequence
  Synthetic
ucgggcgcccacacgggcgc

SEQ ID NO: 8636 - RNA, 20 nt, Artificial Sequence
  Synthetic
cgcccgcgggccccgggcgc

SEQ ID NO: 8637 - RNA, 20 nt, Artificial Sequence
  Synthetic
cgggccgccgccucgggcgc

SEQ ID NO: 8638 - RNA, 20 nt, Artificial Sequence
  Synthetic
ugguggugucggcggggcgc

SEQ ID NO: 8639 - RNA, 20 nt, Artificial Sequence
  Synthetic
ugucggccagcagggggcgc

SEQ ID NO: 8640 - RNA, 20 nt, Artificial Sequence
  Synthetic
ugcggcgcuggcgggggcgc

SEQ ID NO: 8641 - RNA, 20 nt, Artificial Sequence
  Synthetic
cgccgagacgucgggggcgc

SEQ ID NO: 8642 - RNA, 20 nt, Artificial Sequence
  Synthetic
ggcucuucuucggggggcgc

SEQ ID NO: 8643 - RNA, 20 nt, Artificial Sequence
  Synthetic
ggcgcccggggacguggcgc

SEQ ID NO: 8644 - RNA, 20 nt, Artificial Sequence
  Synthetic
gcggcccgucuacguggcgc

SEQ ID NO: 8645 - RNA, 20 nt, Artificial Sequence
  Synthetic
caucuccggcagcguggcgc

SEQ ID NO: 8646 - RNA, 20 nt, Artificial Sequence
  Synthetic
uggugcugaugcgccugcgc

SEQ ID NO: 8647 - RNA, 20 nt, Artificial Sequence
  Synthetic
gcggcccggcggagcugcgc

SEQ ID NO: 8648 - RNA, 20 nt, Artificial Sequence
  Synthetic
ccgugcagugcgccgugcgc

SEQ ID NO: 8649 - RNA, 20 nt, Artificial Sequence
  Synthetic
cacggcgggcagcaccucgc

SEQ ID NO: 8650 - RNA, 20 nt, Artificial Sequence
  Synthetic
gccgcccccggggcccucgc

SEQ ID NO: 8651 - RNA, 20 nt, Artificial Sequence
  Synthetic
cccgcgcgcgcuggccucgc

SEQ ID NO: 8652 - RNA, 20 nt, Artificial Sequence
  Synthetic
gccgucggcggcggcgucgc

SEQ ID NO: 8653 - RNA, 20 nt, Artificial Sequence
  Synthetic
gacgaugaggcggcggucgc

SEQ ID NO: 8654 - RNA, 20 nt, Artificial Sequence
  Synthetic
cgcgccgugagccuggucgc

SEQ ID NO: 8655 - RNA, 20 nt, Artificial Sequence
  Synthetic
acgcgggaccuggccuucgc

SEQ ID NO: 8656 - RNA, 20 nt, Artificial Sequence
  Synthetic
cgggggucgcggcgacaggc

SEQ ID NO: 8657 - RNA, 20 nt, Artificial Sequence
  Synthetic
gcccagggccgccagcaggc

SEQ ID NO: 8658 - RNA, 20 nt, Artificial Sequence
  Synthetic
gcgcagccaggcgcgcaggc

SEQ ID NO: 8659 - RNA, 20 nt, Artificial Sequence
  Synthetic
cgcguaggcgcggcgcaggc

SEQ ID NO: 8660 - RNA, 20 nt, Artificial Sequence
  Synthetic
cucgggcgccccccagaggc

SEQ ID NO: 8661 - RNA, 20 nt, Artificial Sequence
  Synthetic
ggcgcggacgacgaggaggc

SEQ ID NO: 8662 - RNA, 20 nt, Artificial Sequence
  Synthetic
ggcggccggcgcgcggaggc

SEQ ID NO: 8663 - RNA, 20 nt, Artificial Sequence
  Synthetic
gccccggccggcgcggaggc

SEQ ID NO: 8664 - RNA, 20 nt, Artificial Sequence
  Synthetic
gccucccgcggcgcggaggc

SEQ ID NO: 8665 - RNA, 20 nt, Artificial Sequence
  Synthetic
cgcacggcgcacugcacggc

SEQ ID NO: 8666 - RNA, 20 nt, Artificial Sequence
  Synthetic
gccacgggccgcuucacggc

SEQ ID NO: 8667 - RNA, 20 nt, Artificial Sequence
  Synthetic
ugcucccggcgcuggacggc

SEQ ID NO: 8668 - RNA, 20 nt, Artificial Sequence
  Synthetic
cggggcgcgugcuguacggc

SEQ ID NO: 8669 - RNA, 20 nt, Artificial Sequence
  Synthetic
cacggccgggcggccccggc

SEQ ID NO: 8670 - RNA, 20 nt, Artificial Sequence
  Synthetic
ucgucgucgucggccccggc

SEQ ID NO: 8671 - RNA, 20 nt, Artificial Sequence
  Synthetic
cccgcggcgccguagccggc

SEQ ID NO: 8672 - RNA, 20 nt, Artificial Sequence
  Synthetic
agaggcggccgagcgccggc

SEQ ID NO: 8673 - RNA, 20 nt, Artificial Sequence
  Synthetic
gcgcccgccuccgcgccggc

SEQ ID NO: 8674 - RNA, 20 nt, Artificial Sequence
  Synthetic
ggggcccucggcgggccggc

SEQ ID NO: 8675 - RNA, 20 nt, Artificial Sequence
  Synthetic
ccccggcccgaacacgcggc

SEQ ID NO: 8676 - RNA, 20 nt, Artificial Sequence
  Synthetic
cgccuccaggaucccgcggc

SEQ ID NO: 8677 - RNA, 20 nt, Artificial Sequence
  Synthetic
ggagcugcgcgggccgcggc

SEQ ID NO: 8678 - RNA, 20 nt, Artificial Sequence
  Synthetic
gggacggugcuggccgcggc

SEQ ID NO: 8679 - RNA, 20 nt, Artificial Sequence
  Synthetic
agugguccgccgagcgcggc

SEQ ID NO: 8680 - RNA, 20 nt, Artificial Sequence
  Synthetic
cccgggcgcgggggcgcggc

SEQ ID NO: 8681 - RNA, 20 nt, Artificial Sequence
  Synthetic
gcggcccguggcgucgcggc

SEQ ID NO: 8682 - RNA, 20 nt, Artificial Sequence
  Synthetic
cgcagcgggccgaaggcggc

SEQ ID NO: 8683 - RNA, 20 nt, Artificial Sequence
  Synthetic
uguggcugggccccggcggc

SEQ ID NO: 8684 - RNA, 20 nt, Artificial Sequence
  Synthetic
aacggggcggcggcggcggc

SEQ ID NO: 8685 - RNA, 20 nt, Artificial Sequence
  Synthetic
ccggcggugguggcggcggc

SEQ ID NO: 8686 - RNA, 20 nt, Artificial Sequence
  Synthetic
gccccgacccgcagggcggc

SEQ ID NO: 8687 - RNA, 20 nt, Artificial Sequence
  Synthetic
cugggguacgccauggcggc

SEQ ID NO: 8688 - RNA, 20 nt, Artificial Sequence
  Synthetic
ggggcgcgucggcgugcggc

SEQ ID NO: 8689 - RNA, 20 nt, Artificial Sequence
  Synthetic
ugcgggucggggcccucggc

SEQ ID NO: 8690 - RNA, 20 nt, Artificial Sequence
  Synthetic
cggcccugggcgggcucggc

SEQ ID NO: 8691 - RNA, 20 nt, Artificial Sequence
  Synthetic
gagaccacgggcccgucggc

SEQ ID NO: 8692 - RNA, 20 nt, Artificial Sequence
  Synthetic
gccgcggcggcggcgucggc

SEQ ID NO: 8693 - RNA, 20 nt, Artificial Sequence
  Synthetic
ggcaccgcgcgcucgucggc

SEQ ID NO: 8694 - RNA, 20 nt, Artificial Sequence
  Synthetic
gugguggugguggugucggc

SEQ ID NO: 8695 - RNA, 20 nt, Artificial Sequence
  Synthetic
uggcggcgggccgcuucggc

SEQ ID NO: 8696 - RNA, 20 nt, Artificial Sequence
  Synthetic
cgcgggucgaacaugagggc

SEQ ID NO: 8697 - RNA, 20 nt, Artificial Sequence
  Synthetic
gucgccgcggggguccgggc

SEQ ID NO: 8698 - RNA, 20 nt, Artificial Sequence
  Synthetic
ccgcagaccacgccgcgggc

SEQ ID NO: 8699 - RNA, 20 nt, Artificial Sequence
  Synthetic
gcgcgugcuguacggcgggc

SEQ ID NO: 8700 - RNA, 20 nt, Artificial Sequence
  Synthetic
ggcgcgggggcgcggcgggc

SEQ ID NO: 8701 - RNA, 20 nt, Artificial Sequence
  Synthetic
ggucggggcccucggcgggc

SEQ ID NO: 8702 - RNA, 20 nt, Artificial Sequence
  Synthetic
cuccggccgcguguucgggc

SEQ ID NO: 8703 - RNA, 20 nt, Artificial Sequence
  Synthetic
ggggagccguggcccggggc

SEQ ID NO: 8704 - RNA, 20 nt, Artificial Sequence
  Synthetic
gcggggguccgggccggggc

SEQ ID NO: 8705 - RNA, 20 nt, Artificial Sequence
  Synthetic
ggcggcgcccuggccggggc

SEQ ID NO: 8706 - RNA, 20 nt, Artificial Sequence
  Synthetic
ccuggcggccgugccggggc

SEQ ID NO: 8707 - RNA, 20 nt, Artificial Sequence
  Synthetic
gguggggaccgccgcggggc

SEQ ID NO: 8708 - RNA, 20 nt, Artificial Sequence
  Synthetic
gggaggggcggccgcggggc

SEQ ID NO: 8709 - RNA, 20 nt, Artificial Sequence
  Synthetic
ggcggcggcgucggcggggc

SEQ ID NO: 8710 - RNA, 20 nt, Artificial Sequence
  Synthetic
acagcacgcgccccgggggc

SEQ ID NO: 8711 - RNA, 20 nt, Artificial Sequence
  Synthetic
ccgcgggccgcgccgggggc

SEQ ID NO: 8712 - RNA, 20 nt, Artificial Sequence
  Synthetic
cccagcguaucugcgggggc

SEQ ID NO: 8713 - RNA, 20 nt, Artificial Sequence
  Synthetic
cgggcgcgccgccggggggc

SEQ ID NO: 8714 - RNA, 20 nt, Artificial Sequence
  Synthetic
gcgccccgggggcggggggc

SEQ ID NO: 8715 - RNA, 20 nt, Artificial Sequence
  Synthetic
gggcgggcucggcccugggc

SEQ ID NO: 8716 - RNA, 20 nt, Artificial Sequence
  Synthetic
cccgccacggccgccugggc

SEQ ID NO: 8717 - RNA, 20 nt, Artificial Sequence
  Synthetic
ccgcccggcggcgcccuggc

SEQ ID NO: 8718 - RNA, 20 nt, Artificial Sequence
  Synthetic
gcguggucugcggcgcuggc

SEQ ID NO: 8719 - RNA, 20 nt, Artificial Sequence
  Synthetic
gcagugcgccgugcgcuggc

SEQ ID NO: 8720 - RNA, 20 nt, Artificial Sequence
  Synthetic
gcggccgugccggggcuggc

SEQ ID NO: 8721 - RNA, 20 nt, Artificial Sequence
  Synthetic
gaguuccuggggcugcuggc

SEQ ID NO: 8722 - RNA, 20 nt, Artificial Sequence
  Synthetic
cccgcccaggcggccguggc

SEQ ID NO: 8723 - RNA, 20 nt, Artificial Sequence
  Synthetic
cgcggggaccugcgcguggc

SEQ ID NO: 8724 - RNA, 20 nt, Artificial Sequence
  Synthetic
cgggcccgcgcggcgguggc

SEQ ID NO: 8725 - RNA, 20 nt, Artificial Sequence
  Synthetic
cgagggcgccggcguguggc

SEQ ID NO: 8726 - RNA, 20 nt, Artificial Sequence
  Synthetic
ccagagccugcgcccccugc

SEQ ID NO: 8727 - RNA, 20 nt, Artificial Sequence
  Synthetic
ccgcgccuacgcgccccugc

SEQ ID NO: 8728 - RNA, 20 nt, Artificial Sequence
  Synthetic
ggcggcgccagccgcccugc

SEQ ID NO: 8729 - RNA, 20 nt, Artificial Sequence
  Synthetic
cggcgggcuguccugccugc

SEQ ID NO: 8730 - RNA, 20 nt, Artificial Sequence
  Synthetic
cacggcccgcgccacgcugc

SEQ ID NO: 8731 - RNA, 20 nt, Artificial Sequence
  Synthetic
gauccucuacucgccgcugc

SEQ ID NO: 8732 - RNA, 20 nt, Artificial Sequence
  Synthetic
cguggaguuccuggggcugc

SEQ ID NO: 8733 - RNA, 20 nt, Artificial Sequence
  Synthetic
ccgacgcccagcguaucugc

SEQ ID NO: 8734 - RNA, 20 nt, Artificial Sequence
  Synthetic
cccugggcaaccggcucugc

SEQ ID NO: 8735 - RNA, 20 nt, Artificial Sequence
  Synthetic
ggaccugcgccgcaccgugc

SEQ ID NO: 8736 - RNA, 20 nt, Artificial Sequence
  Synthetic
cggcgaccuggcggccgugc

SEQ ID NO: 8737 - RNA, 20 nt, Artificial Sequence
  Synthetic
gggccgcgcggggacggugc

SEQ ID NO: 8738 - RNA, 20 nt, Artificial Sequence
  Synthetic
gccucugacucaucaaaauc

SEQ ID NO: 8739 - RNA, 20 nt, Artificial Sequence
  Synthetic
ugcgcgccgcgcccgagauc

SEQ ID NO: 8740 - RNA, 20 nt, Artificial Sequence
  Synthetic
ggacgccgacgacgaggauc

SEQ ID NO: 8741 - RNA, 20 nt, Artificial Sequence
  Synthetic
uguacagcagccgcgugauc

SEQ ID NO: 8742 - RNA, 20 nt, Artificial Sequence
  Synthetic
ccgcgcucggcggaccacuc

SEQ ID NO: 8743 - RNA, 20 nt, Artificial Sequence
  Synthetic
gacggccgggccgccgccuc

SEQ ID NO: 8744 - RNA, 20 nt, Artificial Sequence
  Synthetic
gcccgcgccuccuccgccuc

SEQ ID NO: 8745 - RNA, 20 nt, Artificial Sequence
  Synthetic
uucggcccgcugcgcgccuc

SEQ ID NO: 8746 - RNA, 20 nt, Artificial Sequence
  Synthetic
cgggcccgguucgaggccuc

SEQ ID NO: 8747 - RNA, 20 nt, Artificial Sequence
  Synthetic
gcgacagccgccccggccuc

SEQ ID NO: 8748 - RNA, 20 nt, Artificial Sequence
  Synthetic
cuggacgccgacgcggccuc

SEQ ID NO: 8749 - RNA, 20 nt, Artificial Sequence
  Synthetic
cgccgcaccgugcuggccuc

SEQ ID NO: 8750 - RNA, 20 nt, Artificial Sequence
  Synthetic
aucaccacgcgcacguccuc

SEQ ID NO: 8751 - RNA, 20 nt, Artificial Sequence
  Synthetic
ugcgccgcgucgcccagcuc

SEQ ID NO: 8752 - RNA, 20 nt, Artificial Sequence
  Synthetic
cggaggcgggcgcggcgcuc

SEQ ID NO: 8753 - RNA, 20 nt, Artificial Sequence
  Synthetic
ccagcagggggcgcaggcuc

SEQ ID NO: 8754 - RNA, 20 nt, Artificial Sequence
  Synthetic
gggcgcggcgggccgggcuc

SEQ ID NO: 8755 - RNA, 20 nt, Artificial Sequence
  Synthetic
aacagcagcuccuucaucuc

SEQ ID NO: 8756 - RNA, 20 nt, Artificial Sequence
  Synthetic
caggccugcuuccggaucuc

SEQ ID NO: 8757 - RNA, 20 nt, Artificial Sequence
  Synthetic
cggaccgcggacgucgucuc

SEQ ID NO: 8758 - RNA, 20 nt, Artificial Sequence
  Synthetic
gccucguccucgcagaaguc

SEQ ID NO: 8759 - RNA, 20 nt, Artificial Sequence
  Synthetic
gcgcccagcgccgagacguc

SEQ ID NO: 8760 - RNA, 20 nt, Artificial Sequence
  Synthetic
agcgggggcgcgucgccguc

SEQ ID NO: 8761 - RNA, 20 nt, Artificial Sequence
  Synthetic
caccccaucgccuccgcguc

SEQ ID NO: 8762 - RNA, 20 nt, Artificial Sequence
  Synthetic
aggcgcagcggcggcgcguc

SEQ ID NO: 8763 - RNA, 20 nt, Artificial Sequence
  Synthetic
uuggcgucgccgccgucguc

SEQ ID NO: 8764 - RNA, 20 nt, Artificial Sequence
  Synthetic
acgcgcacguccuccggguc

SEQ ID NO: 8765 - RNA, 20 nt, Artificial Sequence
  Synthetic
cgccagccgcccugcggguc

SEQ ID NO: 8766 - RNA, 20 nt, Artificial Sequence
  Synthetic
ccgcggucgccgcggggguc

SEQ ID NO: 8767 - RNA, 20 nt, Artificial Sequence
  Synthetic
gacaggcuggccaugggguc

SEQ ID NO: 8768 - RNA, 20 nt, Artificial Sequence
  Synthetic
gacaugggcaccagcguguc

SEQ ID NO: 8769 - RNA, 20 nt, Artificial Sequence
  Synthetic
cgcuggaccaggccugcuuc

SEQ ID NO: 8770 - RNA, 20 nt, Artificial Sequence
  Synthetic
cguccgcgcggcucuucuuc

SEQ ID NO: 8771 - RNA, 20 nt, Artificial Sequence
  Synthetic
cgggcgccacgcgcggguuc

SEQ ID NO: 8772 - RNA, 20 nt, Artificial Sequence
  Synthetic
gggggcgcaggcucugguuc

SEQ ID NO: 8773 - RNA, 20 nt, Artificial Sequence
  Synthetic
uggccuccggccgcguguuc

SEQ ID NO: 8774 - RNA, 20 nt, Artificial Sequence
  Synthetic
gcgccaggccccagccgaag

SEQ ID NO: 8775 - RNA, 20 nt, Artificial Sequence
  Synthetic
ggggccgcccggccgugaag

SEQ ID NO: 8776 - RNA, 20 nt, Artificial Sequence
  Synthetic
gcgucgucgcgcagcaccag

SEQ ID NO: 8777 - RNA, 20 nt, Artificial Sequence
  Synthetic
ucuccgguccgcggacccag

SEQ ID NO: 8778 - RNA, 20 nt, Artificial Sequence
  Synthetic
ccgccucgggcgccccccag

SEQ ID NO: 8779 - RNA, 20 nt, Artificial Sequence
  Synthetic
gcguucucgcgcgccagcag

SEQ ID NO: 8780 - RNA, 20 nt, Artificial Sequence
  Synthetic
gcgacggugucggccagcag

SEQ ID NO: 8781 - RNA, 20 nt, Artificial Sequence
  Synthetic
gccacguagacgggccgcag

SEQ ID NO: 8782 - RNA, 20 nt, Artificial Sequence
  Synthetic
agcgggcccgaggcgcgcag

SEQ ID NO: 8783 - RNA, 20 nt, Artificial Sequence
  Synthetic
gccccgcggcagaggcgcag

SEQ ID NO: 8784 - RNA, 20 nt, Artificial Sequence
  Synthetic
caggccgccgcgcggcgcag

SEQ ID NO: 8785 - RNA, 20 nt, Artificial Sequence
  Synthetic
gccagguccucgcccggcag

SEQ ID NO: 8786 - RNA, 20 nt, Artificial Sequence
  Synthetic
gcacguuggccccgcggcag

SEQ ID NO: 8787 - RNA, 20 nt, Artificial Sequence
  Synthetic
uccggauuuugaugagucag

SEQ ID NO: 8788 - RNA, 20 nt, Artificial Sequence
  Synthetic
uaccgcgacggguacgucag

SEQ ID NO: 8789 - RNA, 20 nt, Artificial Sequence
  Synthetic
cgccacggcgcggggaagag

SEQ ID NO: 8790 - RNA, 20 nt, Artificial Sequence
  Synthetic
ggggcgggccccccccggag

SEQ ID NO: 8791 - RNA, 20 nt, Artificial Sequence
  Synthetic
gggcgcggcccccgcgggag

SEQ ID NO: 8792 - RNA, 20 nt, Artificial Sequence
  Synthetic
cgcccggcagcggcgaguag

SEQ ID NO: 8793 - RNA, 20 nt, Artificial Sequence
  Synthetic
ccuucugcgcgcggucguag

SEQ ID NO: 8794 - RNA, 20 nt, Artificial Sequence
  Synthetic
cgccgccgccgacggcaacg

SEQ ID NO: 8795 - RNA, 20 nt, Artificial Sequence
  Synthetic
ccugcuggcgcgcgagaacg

SEQ ID NO: 8796 - RNA, 20 nt, Artificial Sequence
  Synthetic
agacccccggcccgaacacg

SEQ ID NO: 8797 - RNA, 20 nt, Artificial Sequence
  Synthetic
ccaggcacuccacggccacg

SEQ ID NO: 8798 - RNA, 20 nt, Artificial Sequence
  Synthetic
gcgugcugcugcuguccacg

SEQ ID NO: 8799 - RNA, 20 nt, Artificial Sequence
  Synthetic
cggcuggggccuggcgcacg

SEQ ID NO: 8800 - RNA, 20 nt, Artificial Sequence
  Synthetic
ggccgaagcgcgugcgcacg

SEQ ID NO: 8801 - RNA, 20 nt, Artificial Sequence
  Synthetic
agcaguacgcccugaucacg

SEQ ID NO: 8802 - RNA, 20 nt, Artificial Sequence
  Synthetic
cgaggaggcggaugcagacg

SEQ ID NO: 8803 - RNA, 20 nt, Artificial Sequence
  Synthetic
gucgucgucgucgucagacg

SEQ ID NO: 8804 - RNA, 20 nt, Artificial Sequence
  Synthetic
ggcggaggacgccgacgacg

SEQ ID NO: 8805 - RNA, 20 nt, Artificial Sequence
  Synthetic
gcuggugcugcgcgacgacg

SEQ ID NO: 8806 - RNA, 20 nt, Artificial Sequence
  Synthetic
gacccucggcgcggacgacg

SEQ ID NO: 8807 - RNA, 20 nt, Artificial Sequence
  Synthetic
ggucgagcuggacgccgacg

SEQ ID NO: 8808 - RNA, 20 nt, Artificial Sequence
  Synthetic
cgaugacgacgaccgcgacg

SEQ ID NO: 8809 - RNA, 20 nt, Artificial Sequence
  Synthetic
ggcgcccgagcugggcgacg

SEQ ID NO: 8810 - RNA, 20 nt, Artificial Sequence
  Synthetic
gccggacuucugcgaggacg

SEQ ID NO: 8811 - RNA, 20 nt, Artificial Sequence
  Synthetic
gcugcuguacacgccggacg

SEQ ID NO: 8812 - RNA, 20 nt, Artificial Sequence
  Synthetic
gcugcgcgacgacgcggacg

SEQ ID NO: 8813 - RNA, 20 nt, Artificial Sequence
  Synthetic
gcgcguggcgcccggggacg

SEQ ID NO: 8814 - RNA, 20 nt, Artificial Sequence
  Synthetic
cgagcccguggacauggacg

SEQ ID NO: 8815 - RNA, 20 nt, Artificial Sequence
  Synthetic
gccgcugcggcccgucuacg

SEQ ID NO: 8816 - RNA, 20 nt, Artificial Sequence
  Synthetic
ccggacccccgcggcgaccg

SEQ ID NO: 8817 - RNA, 20 nt, Artificial Sequence
  Synthetic
cggguacgccccgcggaccg

SEQ ID NO: 8818 - RNA, 20 nt, Artificial Sequence
  Synthetic
cgagaacgcggcgcugaccg

SEQ ID NO: 8819 - RNA, 20 nt, Artificial Sequence
  Synthetic
cagggcggcgagcacccccg

SEQ ID NO: 8820 - RNA, 20 nt, Artificial Sequence
  Synthetic
cgccccggcccggacccccg

SEQ ID NO: 8821 - RNA, 20 nt, Artificial Sequence
  Synthetic
gggccggccccccgcccccg

SEQ ID NO: 8822 - RNA, 20 nt, Artificial Sequence
  Synthetic
cggccggggcgccgcccccg

SEQ ID NO: 8823 - RNA, 20 nt, Artificial Sequence
  Synthetic
ggcggggggcgcggcccccg

SEQ ID NO: 8824 - RNA, 20 nt, Artificial Sequence
  Synthetic
cggcggcguggccagccccg

SEQ ID NO: 8825 - RNA, 20 nt, Artificial Sequence
  Synthetic
ugggguccggguacgccccg

SEQ ID NO: 8826 - RNA, 20 nt, Artificial Sequence
  Synthetic
cgcggacgccccccgccccg

SEQ ID NO: 8827 - RNA, 20 nt, Artificial Sequence
  Synthetic
gccguacagcacgcgccccg

SEQ ID NO: 8828 - RNA, 20 nt, Artificial Sequence
  Synthetic
gccgcggccgccgcgccccg

SEQ ID NO: 8829 - RNA, 20 nt, Artificial Sequence
  Synthetic
uggaggccuacugcgccccg

SEQ ID NO: 8830 - RNA, 20 nt, Artificial Sequence
  Synthetic
gggugcccgcgagggccccg

SEQ ID NO: 8831 - RNA, 20 nt, Artificial Sequence
  Synthetic
gguaccgcacguuggccccg

SEQ ID NO: 8832 - RNA, 20 nt, Artificial Sequence
  Synthetic
gccgccgaggcgcgagcccg

SEQ ID NO: 8833 - RNA, 20 nt, Artificial Sequence
  Synthetic
cacgacggcgacgacgcccg

SEQ ID NO: 8834 - RNA, 20 nt, Artificial Sequence
  Synthetic
cgcgccgagggucccgcccg

SEQ ID NO: 8835 - RNA, 20 nt, Artificial Sequence
  Synthetic
ccgccgcgcccccgcgcccg

SEQ ID NO: 8836 - RNA, 20 nt, Artificial Sequence
  Synthetic
cauggcgucgcccgcgcccg

SEQ ID NO: 8837 - RNA, 20 nt, Artificial Sequence
  Synthetic
cggcggggcggccgcgcccg

SEQ ID NO: 8838 - RNA, 20 nt, Artificial Sequence
  Synthetic
cacgggcgccggggcgcccg

SEQ ID NO: 8839 - RNA, 20 nt, Artificial Sequence
  Synthetic
cggccucuggggggcgcccg

SEQ ID NO: 8840 - RNA, 20 nt, Artificial Sequence
  Synthetic
gaacccgcgcguggcgcccg

SEQ ID NO: 8841 - RNA, 20 nt, Artificial Sequence
  Synthetic
gugagcucggccacggcccg

SEQ ID NO: 8842 - RNA, 20 nt, Artificial Sequence
  Synthetic
cccggccgugaagcggcccg

SEQ ID NO: 8843 - RNA, 20 nt, Artificial Sequence
  Synthetic
caccguccccgcgcggcccg

SEQ ID NO: 8844 - RNA, 20 nt, Artificial Sequence
  Synthetic
cccgcccccggcgcggcccg

SEQ ID NO: 8845 - RNA, 20 nt, Artificial Sequence
  Synthetic
gcggcgcuccaggcggcccg

SEQ ID NO: 8846 - RNA, 20 nt, Artificial Sequence
  Synthetic
cuggcccgccgacgggcccg

SEQ ID NO: 8847 - RNA, 20 nt, Artificial Sequence
  Synthetic
cgcgcggcgcagcgggcccg

SEQ ID NO: 8848 - RNA, 20 nt, Artificial Sequence
  Synthetic
gcccccgcgcccggggcccg

SEQ ID NO: 8849 - RNA, 20 nt, Artificial Sequence
  Synthetic
cagcggggagccguggcccg

SEQ ID NO: 8850 - RNA, 20 nt, Artificial Sequence
  Synthetic
ccagcgccuccaggaucccg

SEQ ID NO: 8851 - RNA, 20 nt, Artificial Sequence
  Synthetic
ccccgcggccgccccucccg

SEQ ID NO: 8852 - RNA, 20 nt, Artificial Sequence
  Synthetic
uugcgcuugcgcgccucccg

SEQ ID NO: 8853 - RNA, 20 nt, Artificial Sequence
  Synthetic
cggcggcggcgggcuucccg

SEQ ID NO: 8854 - RNA, 20 nt, Artificial Sequence
  Synthetic
gguacgucagcggggagccg

SEQ ID NO: 8855 - RNA, 20 nt, Artificial Sequence
  Synthetic
cagcgccgcagaccacgccg

SEQ ID NO: 8856 - RNA, 20 nt, Artificial Sequence
  Synthetic
ggaggugguggggaccgccg

SEQ ID NO: 8857 - RNA, 20 nt, Artificial Sequence
  Synthetic
gcguccagcucgacccgccg

SEQ ID NO: 8858 - RNA, 20 nt, Artificial Sequence
  Synthetic
cuccacgccgccgcccgccg

SEQ ID NO: 8859 - RNA, 20 nt, Artificial Sequence
  Synthetic
gcugacccgccggcccgccg

SEQ ID NO: 8860 - RNA, 20 nt, Artificial Sequence
  Synthetic
cgcgcgcagaacucccgccg

SEQ ID NO: 8861 - RNA, 20 nt, Artificial Sequence
  Synthetic
gcuggcgccgccagccgccg

SEQ ID NO: 8862 - RNA, 20 nt, Artificial Sequence
  Synthetic
cggggcuggccacgccgccg

SEQ ID NO: 8863 - RNA, 20 nt, Artificial Sequence
  Synthetic
ccccgccgacgccgccgccg

SEQ ID NO: 8864 - RNA, 20 nt, Artificial Sequence
  Synthetic
cuccgccgccgccgccgccg

SEQ ID NO: 8865 - RNA, 20 nt, Artificial Sequence
  Synthetic
aggcggcgggcgcgccgccg

SEQ ID NO: 8866 - RNA, 20 nt, Artificial Sequence
  Synthetic
cggcggcagcgaggccgccg

SEQ ID NO: 8867 - RNA, 20 nt, Artificial Sequence
  Synthetic
ggcgcacguggcggccgccg

SEQ ID NO: 8868 - RNA, 20 nt, Artificial Sequence
  Synthetic
gggccggcgggucagcgccg

SEQ ID NO: 8869 - RNA, 20 nt, Artificial Sequence
  Synthetic
acccgcucuuccccgcgccg

SEQ ID NO: 8870 - RNA, 20 nt, Artificial Sequence
  Synthetic
ccuggccgcgggccgcgccg

SEQ ID NO: 8871 - RNA, 20 nt, Artificial Sequence
  Synthetic
ccgcgcccgccuccgcgccg

SEQ ID NO: 8872 - RNA, 20 nt, Artificial Sequence
  Synthetic
ccuccucgucguccgcgccg

SEQ ID NO: 8873 - RNA, 20 nt, Artificial Sequence
  Synthetic
cgucaacgccgugcgcgccg

SEQ ID NO: 8874 - RNA, 20 nt, Artificial Sequence
  Synthetic
gcccgccggcuacggcgccg

SEQ ID NO: 8875 - RNA, 20 nt, Artificial Sequence
  Synthetic
ccuggccuucgccggcgccg

SEQ ID NO: 8876 - RNA, 20 nt, Artificial Sequence
  Synthetic
gggcgcccacacgggcgccg

SEQ ID NO: 8877 - RNA, 20 nt, Artificial Sequence
  Synthetic
guggugucggcggggcgccg

SEQ ID NO: 8878 - RNA, 20 nt, Artificial Sequence
  Synthetic
gcuggccgacaccgucgccg

SEQ ID NO: 8879 - RNA, 20 nt, Artificial Sequence
  Synthetic
caggcggcccgcggucgccg

SEQ ID NO: 8880 - RNA, 20 nt, Artificial Sequence
  Synthetic
cgccgugagccuggucgccg

SEQ ID NO: 8881 - RNA, 20 nt, Artificial Sequence
  Synthetic
cgggcgccccccagaggccg

SEQ ID NO: 8882 - RNA, 20 nt, Artificial Sequence
  Synthetic
gcccgccuccgcgccggccg

SEQ ID NO: 8883 - RNA, 20 nt, Artificial Sequence
  Synthetic
guugcccgcccaggcggccg

SEQ ID NO: 8884 - RNA, 20 nt, Artificial Sequence
  Synthetic
gccgcggggcgcggcggccg

SEQ ID NO: 8885 - RNA, 20 nt, Artificial Sequence
  Synthetic
ggccuccagggcggcggccg

SEQ ID NO: 8886 - RNA, 20 nt, Artificial Sequence
  Synthetic
ccccgcgggaggggcggccg

SEQ ID NO: 8887 - RNA, 20 nt, Artificial Sequence
  Synthetic
gcccugggcgggcucggccg

SEQ ID NO: 8888 - RNA, 20 nt, Artificial Sequence
  Synthetic
cgcggcgagcgagucggccg

SEQ ID NO: 8889 - RNA, 20 nt, Artificial Sequence
  Synthetic
gauacgcugggcgucggccg

SEQ ID NO: 8890 - RNA, 20 nt, Artificial Sequence
  Synthetic
cgccgcggggguccgggccg

SEQ ID NO: 8891 - RNA, 20 nt, Artificial Sequence
  Synthetic
cuacugcgccccgcgggccg

SEQ ID NO: 8892 - RNA, 20 nt, Artificial Sequence
  Synthetic
cggcggagcugcgcgggccg

SEQ ID NO: 8893 - RNA, 20 nt, Artificial Sequence
  Synthetic
ccggccgcguguucgggccg

SEQ ID NO: 8894 - RNA, 20 nt, Artificial Sequence
  Synthetic
gccgggcgaggaccuggccg

SEQ ID NO: 8895 - RNA, 20 nt, Artificial Sequence
  Synthetic
gcccggcggcgcccuggccg

SEQ ID NO: 8896 - RNA, 20 nt, Artificial Sequence
  Synthetic
cgcggggacggugcuggccg

SEQ ID NO: 8897 - RNA, 20 nt, Artificial Sequence
  Synthetic
ggaggcgggccgcguggccg

SEQ ID NO: 8898 - RNA, 20 nt, Artificial Sequence
  Synthetic
gagugccuggccgccugccg

SEQ ID NO: 8899 - RNA, 20 nt, Artificial Sequence
  Synthetic
cccugggcccggcgcugccg

SEQ ID NO: 8900 - RNA, 20 nt, Artificial Sequence
  Synthetic
ccgccgcugcgccucugccg

SEQ ID NO: 8901 - RNA, 20 nt, Artificial Sequence
  Synthetic
gcgaccuggcggccgugccg

SEQ ID NO: 8902 - RNA, 20 nt, Artificial Sequence
  Synthetic
gcgcucggcggaccacuccg

SEQ ID NO: 8903 - RNA, 20 nt, Artificial Sequence
  Synthetic
cucagcaggcgcgggcuccg

SEQ ID NO: 8904 - RNA, 20 nt, Artificial Sequence
  Synthetic
cccgucggcgggccaguccg

SEQ ID NO: 8905 - RNA, 20 nt, Artificial Sequence
  Synthetic
cggaccggagacgacguccg

SEQ ID NO: 8906 - RNA, 20 nt, Artificial Sequence
  Synthetic
guucuggaagagcagguccg

SEQ ID NO: 8907 - RNA, 20 nt, Artificial Sequence
  Synthetic
cggacgucgucuccgguccg

SEQ ID NO: 8908 - RNA, 20 nt, Artificial Sequence
  Synthetic
gagacgacguccgcgguccg

SEQ ID NO: 8909 - RNA, 20 nt, Artificial Sequence
  Synthetic
gacgcgggccgcuggguccg

SEQ ID NO: 8910 - RNA, 20 nt, Artificial Sequence
  Synthetic
gucgucgcgcagcaccagcg

SEQ ID NO: 8911 - RNA, 20 nt, Artificial Sequence
  Synthetic
ggcgcagcgcgcggccagcg

SEQ ID NO: 8912 - RNA, 20 nt, Artificial Sequence
  Synthetic
cuccuucaucuccggcagcg

SEQ ID NO: 8913 - RNA, 20 nt, Artificial Sequence
  Synthetic
gcgcguggccggcggcagcg

SEQ ID NO: 8914 - RNA, 20 nt, Artificial Sequence
  Synthetic
ccgcgacggguacgucagcg

SEQ ID NO: 8915 - RNA, 20 nt, Artificial Sequence
  Synthetic
ccggagugguccgccgagcg

SEQ ID NO: 8916 - RNA, 20 nt, Artificial Sequence
  Synthetic
acguccccgggcgccacgcg

SEQ ID NO: 8917 - RNA, 20 nt, Artificial Sequence
  Synthetic
cggccagcaccguccccgcg

SEQ ID NO: 8918 - RNA, 20 nt, Artificial Sequence
  Synthetic
gagcucggccacggcccgcg

SEQ ID NO: 8919 - RNA, 20 nt, Artificial Sequence
  Synthetic
ggagcgccgccgggcccgcg

SEQ ID NO: 8920 - RNA, 20 nt, Artificial Sequence
  Synthetic
aggaggcgggggugcccgcg

SEQ ID NO: 8921 - RNA, 20 nt, Artificial Sequence
  Synthetic
ccgcggccgccccucccgcg

SEQ ID NO: 8922 - RNA, 20 nt, Artificial Sequence
  Synthetic
ggcgaaggccaggucccgcg

SEQ ID NO: 8923 - RNA, 20 nt, Artificial Sequence
  Synthetic
ccccccgaagaagagccgcg

SEQ ID NO: 8924 - RNA, 20 nt, Artificial Sequence
  Synthetic
cgcggccggccaccgccgcg

SEQ ID NO: 8925 - RNA, 20 nt, Artificial Sequence
  Synthetic
aggugguggggaccgccgcg

SEQ ID NO: 8926 - RNA, 20 nt, Artificial Sequence
  Synthetic
ggcgcauccaggccgccgcg

SEQ ID NO: 8927 - RNA, 20 nt, Artificial Sequence
  Synthetic
gccggcgggucagcgccgcg

SEQ ID NO: 8928 - RNA, 20 nt, Artificial Sequence
  Synthetic
ccgccggcuacggcgccgcg

SEQ ID NO: 8929 - RNA, 20 nt, Artificial Sequence
  Synthetic
cucgggcccgcugcgccgcg

SEQ ID NO: 8930 - RNA, 20 nt, Artificial Sequence
  Synthetic
ggcggcccgcggucgccgcg

SEQ ID NO: 8931 - RNA, 20 nt, Artificial Sequence
  Synthetic
ccgcgggaggggcggccgcg

SEQ ID NO: 8932 - RNA, 20 nt, Artificial Sequence
  Synthetic
ggcgucggccgcgggccgcg

SEQ ID NO: 8933 - RNA, 20 nt, Artificial Sequence
  Synthetic
gcgcgcggaggcgggccgcg

SEQ ID NO: 8934 - RNA, 20 nt, Artificial Sequence
  Synthetic
gccgcugcgccucugccgcg

SEQ ID NO: 8935 - RNA, 20 nt, Artificial Sequence
  Synthetic
cggggcggggggcguccgcg

SEQ ID NO: 8936 - RNA, 20 nt, Artificial Sequence
  Synthetic
gacgacguccgcgguccgcg

SEQ ID NO: 8937 - RNA, 20 nt, Artificial Sequence
  Synthetic
gggcggggcggcgcagcgcg

SEQ ID NO: 8938 - RNA, 20 nt, Artificial Sequence
  Synthetic
gucgccggccgacgagcgcg

SEQ ID NO: 8939 - RNA, 20 nt, Artificial Sequence
  Synthetic
guggcuccagaacccgcgcg

SEQ ID NO: 8940 - RNA, 20 nt, Artificial Sequence
  Synthetic
cgucggccgcgggccgcgcg

SEQ ID NO: 8941 - RNA, 20 nt, Artificial Sequence
  Synthetic
gccagcgaggccagcgcgcg

SEQ ID NO: 8942 - RNA, 20 nt, Artificial Sequence
  Synthetic
gccgggggucuucgcgcgcg

SEQ ID NO: 8943 - RNA, 20 nt, Artificial Sequence
  Synthetic
ggcgcggcgguacucgcgcg

SEQ ID NO: 8944 - RNA, 20 nt, Artificial Sequence
  Synthetic
gggccgggcgccacggcgcg

SEQ ID NO: 8945 - RNA, 20 nt, Artificial Sequence
  Synthetic
ugguggcggcggccggcgcg

SEQ ID NO: 8946 - RNA, 20 nt, Artificial Sequence
  Synthetic
gcccgcgggccccgggcgcg

SEQ ID NO: 8947 - RNA, 20 nt, Artificial Sequence
  Synthetic
gcucuucuucggggggcgcg

SEQ ID NO: 8948 - RNA, 20 nt, Artificial Sequence
  Synthetic
ccugcgcggggaccugcgcg

SEQ ID NO: 8949 - RNA, 20 nt, Artificial Sequence
  Synthetic
ggugcugaugcgccugcgcg

SEQ ID NO: 8950 - RNA, 20 nt, Artificial Sequence
  Synthetic
gcaggaagcccuucugcgcg

SEQ ID NO: 8951 - RNA, 20 nt, Artificial Sequence
  Synthetic
cgcggcgggaguucugcgcg

SEQ ID NO: 8952 - RNA, 20 nt, Artificial Sequence
  Synthetic
cgacccggaggacgugcgcg

SEQ ID NO: 8953 - RNA, 20 nt, Artificial Sequence
  Synthetic
acggcgcggcgguacucgcg

SEQ ID NO: 8954 - RNA, 20 nt, Artificial Sequence
  Synthetic
gcggcggagcucagcaggcg

SEQ ID NO: 8955 - RNA, 20 nt, Artificial Sequence
  Synthetic
ggccccagcgcgcgcaggcg

SEQ ID NO: 8956 - RNA, 20 nt, Artificial Sequence
  Synthetic
cgcagccaggcgcgcaggcg

SEQ ID NO: 8957 - RNA, 20 nt, Artificial Sequence
  Synthetic
gcgcggacgacgaggaggcg

SEQ ID NO: 8958 - RNA, 20 nt, Artificial Sequence
  Synthetic
cgcccgaggcggaggaggcg

SEQ ID NO: 8959 - RNA, 20 nt, Artificial Sequence
  Synthetic
ccagcaggggcgcguaggcg

SEQ ID NO: 8960 - RNA, 20 nt, Artificial Sequence
  Synthetic
gagggccgggcgccacggcg

SEQ ID NO: 8961 - RNA, 20 nt, Artificial Sequence
  Synthetic
ccagcgccgggagcacggcg

SEQ ID NO: 8962 - RNA, 20 nt, Artificial Sequence
  Synthetic
gggggggcccgcccccggcg

SEQ ID NO: 8963 - RNA, 20 nt, Artificial Sequence
  Synthetic
gaggcggccgagcgccggcg

SEQ ID NO: 8964 - RNA, 20 nt, Artificial Sequence
  Synthetic
gucgucggccccggccggcg

SEQ ID NO: 8965 - RNA, 20 nt, Artificial Sequence
  Synthetic
cgagggucccgcccgcggcg

SEQ ID NO: 8966 - RNA, 20 nt, Artificial Sequence
  Synthetic
cuugcgcgccucccgcggcg

SEQ ID NO: 8967 - RNA, 20 nt, Artificial Sequence
  Synthetic
ccgugcgcuggccggcggcg

SEQ ID NO: 8968 - RNA, 20 nt, Artificial Sequence
  Synthetic
ggccgcggcgggcggcggcg

SEQ ID NO: 8969 - RNA, 20 nt, Artificial Sequence
  Synthetic
gggcucgcgccucggcggcg

SEQ ID NO: 8970 - RNA, 20 nt, Artificial Sequence
  Synthetic
gggcgcgucggcgugcggcg

SEQ ID NO: 8971 - RNA, 20 nt, Artificial Sequence
  Synthetic
cgcgggcgggacccucggcg

SEQ ID NO: 8972 - RNA, 20 nt, Artificial Sequence
  Synthetic
ccgcggcggcggcgucggcg

SEQ ID NO: 8973 - RNA, 20 nt, Artificial Sequence
  Synthetic
ugguggugguggugucggcg

SEQ ID NO: 8974 - RNA, 20 nt, Artificial Sequence
  Synthetic
gcgcccgcgggccccgggcg

SEQ ID NO: 8975 - RNA, 20 nt, Artificial Sequence
  Synthetic
cuacucgccgcugccgggcg

SEQ ID NO: 8976 - RNA, 20 nt, Artificial Sequence
  Synthetic
gcgcccggggcccgcgggcg

SEQ ID NO: 8977 - RNA, 20 nt, Artificial Sequence
  Synthetic
ggccggcgcggaggcgggcg

SEQ ID NO: 8978 - RNA, 20 nt, Artificial Sequence
  Synthetic
ccgcggcgcggaggcgggcg

SEQ ID NO: 8979 - RNA, 20 nt, Artificial Sequence
  Synthetic
ccgggccgccgccucgggcg

SEQ ID NO: 8980 - RNA, 20 nt, Artificial Sequence
  Synthetic
cugcuuccggaucucgggcg

SEQ ID NO: 8981 - RNA, 20 nt, Artificial Sequence
  Synthetic
gcggcgcccuggccggggcg

SEQ ID NO: 8982 - RNA, 20 nt, Artificial Sequence
  Synthetic
cgggucagcgccgcggggcg

SEQ ID NO: 8983 - RNA, 20 nt, Artificial Sequence
  Synthetic
ggaggggcggccgcggggcg

SEQ ID NO: 8984 - RNA, 20 nt, Artificial Sequence
  Synthetic
gcggcggcgucggcggggcg

SEQ ID NO: 8985 - RNA, 20 nt, Artificial Sequence
  Synthetic
cagcacgcgccccgggggcg

SEQ ID NO: 8986 - RNA, 20 nt, Artificial Sequence
  Synthetic
gggccccgggcgcgggggcg

SEQ ID NO: 8987 - RNA, 20 nt, Artificial Sequence
  Synthetic
cugcggcgcuggcgggggcg

SEQ ID NO: 8988 - RNA, 20 nt, Artificial Sequence
  Synthetic
gggcgcgccgccggggggcg

SEQ ID NO: 8989 - RNA, 20 nt, Artificial Sequence
  Synthetic
cgucggcggggcggggggcg

SEQ ID NO: 8990 - RNA, 20 nt, Artificial Sequence
  Synthetic
cggcucuucuucggggggcg

SEQ ID NO: 8991 - RNA, 20 nt, Artificial Sequence
  Synthetic
cguggucugcggcgcuggcg

SEQ ID NO: 8992 - RNA, 20 nt, Artificial Sequence
  Synthetic
ucaucuccggcagcguggcg

SEQ ID NO: 8993 - RNA, 20 nt, Artificial Sequence
  Synthetic
cuggugcugaugcgccugcg

SEQ ID NO: 8994 - RNA, 20 nt, Artificial Sequence
  Synthetic
gcacgccuaccuggccugcg

SEQ ID NO: 8995 - RNA, 20 nt, Artificial Sequence
  Synthetic
ggcggcccggcggagcugcg

SEQ ID NO: 8996 - RNA, 20 nt, Artificial Sequence
  Synthetic
cgacgcccagcguaucugcg

SEQ ID NO: 8997 - RNA, 20 nt, Artificial Sequence
  Synthetic
cggcgcgccggacuucugcg

SEQ ID NO: 8998 - RNA, 20 nt, Artificial Sequence
  Synthetic
cuggggcgcgacgccgugcg

SEQ ID NO: 8999 - RNA, 20 nt, Artificial Sequence
  Synthetic
gggguacaggcgcgcgugcg

SEQ ID NO: 9000 - RNA, 20 nt, Artificial Sequence
  Synthetic
cgccgcccccggggcccucg

SEQ ID NO: 9001 - RNA, 20 nt, Artificial Sequence
  Synthetic
ccgacgggcccguggucucg

SEQ ID NO: 9002 - RNA, 20 nt, Artificial Sequence
  Synthetic
cgcccagcgccgagacgucg

SEQ ID NO: 9003 - RNA, 20 nt, Artificial Sequence
  Synthetic
ccccgcugacguacccgucg

SEQ ID NO: 9004 - RNA, 20 nt, Artificial Sequence
  Synthetic
cgcgggcgucgucgccgucg

SEQ ID NO: 9005 - RNA, 20 nt, Artificial Sequence
  Synthetic
ggacccagcggcccgcgucg

SEQ ID NO: 9006 - RNA, 20 nt, Artificial Sequence
  Synthetic
ggcgcagcggcggcgcgucg

SEQ ID NO: 9007 - RNA, 20 nt, Artificial Sequence
  Synthetic
ugaagcggcccguggcgucg

SEQ ID NO: 9008 - RNA, 20 nt, Artificial Sequence
  Synthetic
uggcgucgccgccgucgucg

SEQ ID NO: 9009 - RNA, 20 nt, Artificial Sequence
  Synthetic
gccagccgcccugcgggucg

SEQ ID NO: 9010 - RNA, 20 nt, Artificial Sequence
  Synthetic
cggcggggcgccgggggucg

SEQ ID NO: 9011 - RNA, 20 nt, Artificial Sequence
  Synthetic
acaugggcaccagcgugucg

SEQ ID NO: 9012 - RNA, 20 nt, Artificial Sequence
  Synthetic
guccgcgcggcucuucuucg

SEQ ID NO: 9013 - RNA, 20 nt, Artificial Sequence
  Synthetic
ggaggcgcgggcccgguucg

SEQ ID NO: 9014 - RNA, 20 nt, Artificial Sequence
  Synthetic
ggcgcgcagcgggccgaagg

SEQ ID NO: 9015 - RNA, 20 nt, Artificial Sequence
  Synthetic
ccgccauggcguaccccagg

SEQ ID NO: 9016 - RNA, 20 nt, Artificial Sequence
  Synthetic
gguccaguugcccgcccagg

SEQ ID NO: 9017 - RNA, 20 nt, Artificial Sequence
  Synthetic
gggcccggcggcgcuccagg

SEQ ID NO: 9018 - RNA, 20 nt, Artificial Sequence
  Synthetic
cgacggugucggccagcagg

SEQ ID NO: 9019 - RNA, 20 nt, Artificial Sequence
  Synthetic
cgcgcagccaggcgcgcagg

SEQ ID NO: 9020 - RNA, 20 nt, Artificial Sequence
  Synthetic
cuccaggaucccgcggcagg

SEQ ID NO: 9021 - RNA, 20 nt, Artificial Sequence
  Synthetic
ggauuuugaugagucagagg

SEQ ID NO: 9022 - RNA, 20 nt, Artificial Sequence
  Synthetic
ggaggcggaugcagacgagg

SEQ ID NO: 9023 - RNA, 20 nt, Artificial Sequence
  Synthetic
gucgucgucgucagacgagg

SEQ ID NO: 9024 - RNA, 20 nt, Artificial Sequence
  Synthetic
ccucggcgcggacgacgagg

SEQ ID NO: 9025 - RNA, 20 nt, Artificial Sequence
  Synthetic
ggcgucgcccgcgcccgagg

SEQ ID NO: 9026 - RNA, 20 nt, Artificial Sequence
  Synthetic
ccucuggggggcgcccgagg

SEQ ID NO: 9027 - RNA, 20 nt, Artificial Sequence
  Synthetic
ggcggaugcagacgaggagg

SEQ ID NO: 9028 - RNA, 20 nt, Artificial Sequence
  Synthetic
gucgucgucagacgaggagg

SEQ ID NO: 9029 - RNA, 20 nt, Artificial Sequence
  Synthetic
cggcgcggacgacgaggagg

SEQ ID NO: 9030 - RNA, 20 nt, Artificial Sequence
  Synthetic
ggaugcagacgaggaggagg

SEQ ID NO: 9031 - RNA, 20 nt, Artificial Sequence
  Synthetic
ugcagacgaggaggaggagg

SEQ ID NO: 9032 - RNA, 20 nt, Artificial Sequence
  Synthetic
ggaggaggcggaggaggagg

SEQ ID NO: 9033 - RNA, 20 nt, Artificial Sequence
  Synthetic
ggaggaggaggcggaggagg

SEQ ID NO: 9034 - RNA, 20 nt, Artificial Sequence
  Synthetic
cggcggccggcgcgcggagg

SEQ ID NO: 9035 - RNA, 20 nt, Artificial Sequence
  Synthetic
ggccccggccggcgcggagg

SEQ ID NO: 9036 - RNA, 20 nt, Artificial Sequence
  Synthetic
cgccucccgcggcgcggagg

SEQ ID NO: 9037 - RNA, 20 nt, Artificial Sequence
  Synthetic
gggggcgcccgaggcggagg

SEQ ID NO: 9038 - RNA, 20 nt, Artificial Sequence
  Synthetic
cgaggaggaggaggcggagg

SEQ ID NO: 9039 - RNA, 20 nt, Artificial Sequence
  Synthetic
ggcgggcggcggcguggagg

SEQ ID NO: 9040 - RNA, 20 nt, Artificial Sequence
  Synthetic
cggcguugacgacgaugagg

SEQ ID NO: 9041 - RNA, 20 nt, Artificial Sequence
  Synthetic
ggcgcgcacggcggccacgg

SEQ ID NO: 9042 - RNA, 20 nt, Artificial Sequence
  Synthetic
gcggcggcucauggccacgg

SEQ ID NO: 9043 - RNA, 20 nt, Artificial Sequence
  Synthetic
caggcucacggcgcgcacgg

SEQ ID NO: 9044 - RNA, 20 nt, Artificial Sequence
  Synthetic
gcgcacggcgcacugcacgg

SEQ ID NO: 9045 - RNA, 20 nt, Artificial Sequence
  Synthetic
gcgcgaacccccgacgacgg

SEQ ID NO: 9046 - RNA, 20 nt, Artificial Sequence
  Synthetic
ccggggcgcgugcuguacgg

SEQ ID NO: 9047 - RNA, 20 nt, Artificial Sequence
  Synthetic
gcgccaggugcccgacccgg

SEQ ID NO: 9048 - RNA, 20 nt, Artificial Sequence
  Synthetic
ugcgccgccccgccccccgg

SEQ ID NO: 9049 - RNA, 20 nt, Artificial Sequence
  Synthetic
ccguacagcacgcgccccgg

SEQ ID NO: 9050 - RNA, 20 nt, Artificial Sequence
  Synthetic
ucacggccgggcggccccgg

SEQ ID NO: 9051 - RNA, 20 nt, Artificial Sequence
  Synthetic
ggugcccgcgagggccccgg

SEQ ID NO: 9052 - RNA, 20 nt, Artificial Sequence
  Synthetic
ggcguguggcugggccccgg

SEQ ID NO: 9053 - RNA, 20 nt, Artificial Sequence
  Synthetic
gggcgcggggcgccgcccgg

SEQ ID NO: 9054 - RNA, 20 nt, Artificial Sequence
  Synthetic
cgccgugcgcggcggcccgg

SEQ ID NO: 9055 - RNA, 20 nt, Artificial Sequence
  Synthetic
ccaccgccgcgcgggcccgg

SEQ ID NO: 9056 - RNA, 20 nt, Artificial Sequence
  Synthetic
ccccgcggcgccguagccgg

SEQ ID NO: 9057 - RNA, 20 nt, Artificial Sequence
  Synthetic
ggcggcgggcgcgccgccgg

SEQ ID NO: 9058 - RNA, 20 nt, Artificial Sequence
  Synthetic
cagaggcggccgagcgccgg

SEQ ID NO: 9059 - RNA, 20 nt, Artificial Sequence
  Synthetic
cuggccgcgggccgcgccgg

SEQ ID NO: 9060 - RNA, 20 nt, Artificial Sequence
  Synthetic
gccggcggggggcgcgccgg

SEQ ID NO: 9061 - RNA, 20 nt, Artificial Sequence
  Synthetic
gcgcgcguagaaggcgccgg

SEQ ID NO: 9062 - RNA, 20 nt, Artificial Sequence
  Synthetic
gacgacgacgacggcgccgg

SEQ ID NO: 9063 - RNA, 20 nt, Artificial Sequence
  Synthetic
uggugucggcggggcgccgg

SEQ ID NO: 9064 - RNA, 20 nt, Artificial Sequence
  Synthetic
cggcccgaacacgcggccgg

SEQ ID NO: 9065 - RNA, 20 nt, Artificial Sequence
  Synthetic
cggggcccucggcgggccgg

SEQ ID NO: 9066 - RNA, 20 nt, Artificial Sequence
  Synthetic
cggccgcguguucgggccgg

SEQ ID NO: 9067 - RNA, 20 nt, Artificial Sequence
  Synthetic
gugcgccgugcgcuggccgg

SEQ ID NO: 9068 - RNA, 20 nt, Artificial Sequence
  Synthetic
ggggaccugcgcguggccgg

SEQ ID NO: 9069 - RNA, 20 nt, Artificial Sequence
  Synthetic
cgcucggcggaccacuccgg

SEQ ID NO: 9070 - RNA, 20 nt, Artificial Sequence
  Synthetic
ucgucgcgcagcaccagcgg

SEQ ID NO: 9071 - RNA, 20 nt, Artificial Sequence
  Synthetic
ccgcggcagaggcgcagcgg

SEQ ID NO: 9072 - RNA, 20 nt, Artificial Sequence
  Synthetic
ucugcgcgcggucguagcgg

SEQ ID NO: 9073 - RNA, 20 nt, Artificial Sequence
  Synthetic
gcuguacacgccggacgcgg

SEQ ID NO: 9074 - RNA, 20 nt, Artificial Sequence
  Synthetic
cggcguggccagccccgcgg

SEQ ID NO: 9075 - RNA, 20 nt, Artificial Sequence
  Synthetic
cgcggccgccccucccgcgg

SEQ ID NO: 9076 - RNA, 20 nt, Artificial Sequence
  Synthetic
cgccggcuacggcgccgcgg

SEQ ID NO: 9077 - RNA, 20 nt, Artificial Sequence
  Synthetic
gcggcccgcggucgccgcgg

SEQ ID NO: 9078 - RNA, 20 nt, Artificial Sequence
  Synthetic
gcggggcgcggcggccgcgg

SEQ ID NO: 9079 - RNA, 20 nt, Artificial Sequence
  Synthetic
cggagcugcgcgggccgcgg

SEQ ID NO: 9080 - RNA, 20 nt, Artificial Sequence
  Synthetic
ggggacggugcuggccgcgg

SEQ ID NO: 9081 - RNA, 20 nt, Artificial Sequence
  Synthetic
cuggaagagcagguccgcgg

SEQ ID NO: 9082 - RNA, 20 nt, Artificial Sequence
  Synthetic
gagugguccgccgagcgcgg

SEQ ID NO: 9083 - RNA, 20 nt, Artificial Sequence
  Synthetic
gcgccgccgggcccgcgcgg

SEQ ID NO: 9084 - RNA, 20 nt, Artificial Sequence
  Synthetic
gggcccgcugcgccgcgcgg

SEQ ID NO: 9085 - RNA, 20 nt, Artificial Sequence
  Synthetic
uggcggcggccggcgcgcgg

SEQ ID NO: 9086 - RNA, 20 nt, Artificial Sequence
  Synthetic
gcgccgggagcacggcgcgg

SEQ ID NO: 9087 - RNA, 20 nt, Artificial Sequence
  Synthetic
gucggccccggccggcgcgg

SEQ ID NO: 9088 - RNA, 20 nt, Artificial Sequence
  Synthetic
gcgcgccucccgcggcgcgg

SEQ ID NO: 9089 - RNA, 20 nt, Artificial Sequence
  Synthetic
cccgcgggccccgggcgcgg

SEQ ID NO: 9090 - RNA, 20 nt, Artificial Sequence
  Synthetic
gucagcgccgcggggcgcgg

SEQ ID NO: 9091 - RNA, 20 nt, Artificial Sequence
  Synthetic
ccccgggcgcgggggcgcgg

SEQ ID NO: 9092 - RNA, 20 nt, Artificial Sequence
  Synthetic
gggcgcgacgccgugcgcgg

SEQ ID NO: 9093 - RNA, 20 nt, Artificial Sequence
  Synthetic
gcgcagcgggccgaaggcgg

SEQ ID NO: 9094 - RNA, 20 nt, Artificial Sequence
  Synthetic
gucgcccgcgcccgaggcgg

SEQ ID NO: 9095 - RNA, 20 nt, Artificial Sequence
  Synthetic
cuggggggcgcccgaggcgg

SEQ ID NO: 9096 - RNA, 20 nt, Artificial Sequence
  Synthetic
cgcggacgacgaggaggcgg

SEQ ID NO: 9097 - RNA, 20 nt, Artificial Sequence
  Synthetic
agacgaggaggaggaggcgg

SEQ ID NO: 9098 - RNA, 20 nt, Artificial Sequence
  Synthetic
ggaggcggaggaggaggcgg

SEQ ID NO: 9099 - RNA, 20 nt, Artificial Sequence
  Synthetic
cguugacgacgaugaggcgg

SEQ ID NO: 9100 - RNA, 20 nt, Artificial Sequence
  Synthetic
aggcggccgagcgccggcgg

SEQ ID NO: 9101 - RNA, 20 nt, Artificial Sequence
  Synthetic
ggcggggggcgcgccggcgg

SEQ ID NO: 9102 - RNA, 20 nt, Artificial Sequence
  Synthetic
gacgacgacggcgccggcgg

SEQ ID NO: 9103 - RNA, 20 nt, Artificial Sequence
  Synthetic
gggcgcggcggccgcggcgg

SEQ ID NO: 9104 - RNA, 20 nt, Artificial Sequence
  Synthetic
gaagagcagguccgcggcgg

SEQ ID NO: 9105 - RNA, 20 nt, Artificial Sequence
  Synthetic
ccgccgggcccgcgcggcgg

SEQ ID NO: 9106 - RNA, 20 nt, Artificial Sequence
  Synthetic
ggggggcgcgccggcggcgg

SEQ ID NO: 9107 - RNA, 20 nt, Artificial Sequence
  Synthetic
gagcagguccgcggcggcgg

SEQ ID NO: 9108 - RNA, 20 nt, Artificial Sequence
  Synthetic
cagguccgcggcggcggcgg

SEQ ID NO: 9109 - RNA, 20 nt, Artificial Sequence
  Synthetic
guccgcggcggcggcggcgg

SEQ ID NO: 9110 - RNA, 20 nt, Artificial Sequence
  Synthetic
caacggggcggcggcggcgg

SEQ ID NO: 9111 - RNA, 20 nt, Artificial Sequence
  Synthetic
cggcaacggggcggcggcgg

SEQ ID NO: 9112 - RNA, 20 nt, Artificial Sequence
  Synthetic
cgacggcaacggggcggcgg

SEQ ID NO: 9113 - RNA, 20 nt, Artificial Sequence
  Synthetic
cgccccguugccgucggcgg

SEQ ID NO: 9114 - RNA, 20 nt, Artificial Sequence
  Synthetic
gcaguaggccuccagggcgg

SEQ ID NO: 9115 - RNA, 20 nt, Artificial Sequence
  Synthetic
gugcuggccgcggcgggcgg

SEQ ID NO: 9116 - RNA, 20 nt, Artificial Sequence
  Synthetic
cgccgacggcaacggggcgg

SEQ ID NO: 9117 - RNA, 20 nt, Artificial Sequence
  Synthetic
gaggggcggccgcggggcgg

SEQ ID NO: 9118 - RNA, 20 nt, Artificial Sequence
  Synthetic
cggcggcgucggcggggcgg

SEQ ID NO: 9119 - RNA, 20 nt, Artificial Sequence
  Synthetic
agcacgcgccccgggggcgg

SEQ ID NO: 9120 - RNA, 20 nt, Artificial Sequence
  Synthetic
ccugggguacgccauggcgg

SEQ ID NO: 9121 - RNA, 20 nt, Artificial Sequence
  Synthetic
gauccuggaggcgcuggcgg

SEQ ID NO: 9122 - RNA, 20 nt, Artificial Sequence
  Synthetic
guggucugcggcgcuggcgg

SEQ ID NO: 9123 - RNA, 20 nt, Artificial Sequence
  Synthetic
ggcgccggcggugguggcgg

SEQ ID NO: 9124 - RNA, 20 nt, Artificial Sequence
  Synthetic
gacgcccagcguaucugcgg

SEQ ID NO: 9125 - RNA, 20 nt, Artificial Sequence
  Synthetic
cggggcgcgucggcgugcgg

SEQ ID NO: 9126 - RNA, 20 nt, Artificial Sequence
  Synthetic
cugcgggucggggcccucgg

SEQ ID NO: 9127 - RNA, 20 nt, Artificial Sequence
  Synthetic
uccacgggcucgcgccucgg

SEQ ID NO: 9128 - RNA, 20 nt, Artificial Sequence
  Synthetic
ggacagcccgccgcgcucgg

SEQ ID NO: 9129 - RNA, 20 nt, Artificial Sequence
  Synthetic
gcccagcgccgagacgucgg

SEQ ID NO: 9130 - RNA, 20 nt, Artificial Sequence
  Synthetic
cgagaccacgggcccgucgg

SEQ ID NO: 9131 - RNA, 20 nt, Artificial Sequence
  Synthetic
cgccgccccguugccgucgg

SEQ ID NO: 9132 - RNA, 20 nt, Artificial Sequence
  Synthetic
ggccgcggcggcggcgucgg

SEQ ID NO: 9133 - RNA, 20 nt, Artificial Sequence
  Synthetic
ggcgucgccgccgucgucgg

SEQ ID NO: 9134 - RNA, 20 nt, Artificial Sequence
  Synthetic
ggugguggugguggugucgg

SEQ ID NO: 9135 - RNA, 20 nt, Artificial Sequence
  Synthetic
uccgcgcggcucuucuucgg

SEQ ID NO: 9136 - RNA, 20 nt, Artificial Sequence
  Synthetic
ggcgcucaggcgccccaggg

SEQ ID NO: 9137 - RNA, 20 nt, Artificial Sequence
  Synthetic
ggcgcaguaggccuccaggg

SEQ ID NO: 9138 - RNA, 20 nt, Artificial Sequence
  Synthetic
gagggccccgacccgcaggg

SEQ ID NO: 9139 - RNA, 20 nt, Artificial Sequence
  Synthetic
gcggcgggcgcgccgccggg

SEQ ID NO: 9140 - RNA, 20 nt, Artificial Sequence
  Synthetic
ccggccagggcgccgccggg

SEQ ID NO: 9141 - RNA, 20 nt, Artificial Sequence
  Synthetic
cgggccgcuucacggccggg

SEQ ID NO: 9142 - RNA, 20 nt, Artificial Sequence
  Synthetic
gcucggcggaccacuccggg

SEQ ID NO: 9143 - RNA, 20 nt, Artificial Sequence
  Synthetic
acggcgcggggaagagcggg

SEQ ID NO: 9144 - RNA, 20 nt, Artificial Sequence
  Synthetic
gggggcgcggcccccgcggg

SEQ ID NO: 9145 - RNA, 20 nt, Artificial Sequence
  Synthetic
gccgcagaccacgccgcggg

SEQ ID NO: 9146 - RNA, 20 nt, Artificial Sequence
  Synthetic
gcccgccuccgcgccgcggg

SEQ ID NO: 9147 - RNA, 20 nt, Artificial Sequence
  Synthetic
ggcgcuggcgggggcgcggg

SEQ ID NO: 9148 - RNA, 20 nt, Artificial Sequence
  Synthetic
ggcggccgagcgccggcggg

SEQ ID NO: 9149 - RNA, 20 nt, Artificial Sequence
  Synthetic
acggugcuggccgcggcggg

SEQ ID NO: 9150 - RNA, 20 nt, Artificial Sequence
  Synthetic
aggggcggccgcggggcggg

SEQ ID NO: 9151 - RNA, 20 nt, Artificial Sequence
  Synthetic
ggcggcgucggcggggcggg

SEQ ID NO: 9152 - RNA, 20 nt, Artificial Sequence
  Synthetic
gcacgcgccccgggggcggg

SEQ ID NO: 9153 - RNA, 20 nt, Artificial Sequence
  Synthetic
ccgcgcggcucuucuucggg

SEQ ID NO: 9154 - RNA, 20 nt, Artificial Sequence
  Synthetic
cgcggcccccgcgggagggg

SEQ ID NO: 9155 - RNA, 20 nt, Artificial Sequence
  Synthetic
cgccgccgacggcaacgggg

SEQ ID NO: 9156 - RNA, 20 nt, Artificial Sequence
  Synthetic
gcgccccccagaggccgggg

SEQ ID NO: 9157 - RNA, 20 nt, Artificial Sequence
  Synthetic
cgcggggguccgggccgggg

SEQ ID NO: 9158 - RNA, 20 nt, Artificial Sequence
  Synthetic
cggcggcgcccuggccgggg

SEQ ID NO: 9159 - RNA, 20 nt, Artificial Sequence
  Synthetic
cucggcggaccacuccgggg

SEQ ID NO: 9160 - RNA, 20 nt, Artificial Sequence
  Synthetic
cgggaggggcggccgcgggg

SEQ ID NO: 9161 - RNA, 20 nt, Artificial Sequence
  Synthetic
cgcgucggcgugcggcgggg

SEQ ID NO: 9162 - RNA, 20 nt, Artificial Sequence
  Synthetic
cggcggcggcgucggcgggg

SEQ ID NO: 9163 - RNA, 20 nt, Artificial Sequence
  Synthetic
cgcgccgccggggggcgggg

SEQ ID NO: 9164 - RNA, 20 nt, Artificial Sequence
  Synthetic
uacagcacgcgccccggggg

SEQ ID NO: 9165 - RNA, 20 nt, Artificial Sequence
  Synthetic
gcccgcgagggccccggggg

SEQ ID NO: 9166 - RNA, 20 nt, Artificial Sequence
  Synthetic
gccgcgggccgcgccggggg

SEQ ID NO: 9167 - RNA, 20 nt, Artificial Sequence
  Synthetic
ucggcggaccacuccggggg

SEQ ID NO: 9168 - RNA, 20 nt, Artificial Sequence
  Synthetic
gcccagcguaucugcggggg

SEQ ID NO: 9169 - RNA, 20 nt, Artificial Sequence
  Synthetic
gcgggcgcgccgccgggggg

SEQ ID NO: 9170 - RNA, 20 nt, Artificial Sequence
  Synthetic
cggacgcggaggcgaugggg

SEQ ID NO: 9171 - RNA, 20 nt, Artificial Sequence
  Synthetic
ggggcgggcucggcccuggg

SEQ ID NO: 9172 - RNA, 20 nt, Artificial Sequence
  Synthetic
gcccgccacggccgccuggg

SEQ ID NO: 9173 - RNA, 20 nt, Artificial Sequence
  Synthetic
cagccgccccggccucuggg

SEQ ID NO: 9174 - RNA, 20 nt, Artificial Sequence
  Synthetic
ccaccugggguacgccaugg

SEQ ID NO: 9175 - RNA, 20 nt, Artificial Sequence
  Synthetic
gggcuucgacggcgaccugg

SEQ ID NO: 9176 - RNA, 20 nt, Artificial Sequence
  Synthetic
gcccucggccgccgcccugg

SEQ ID NO: 9177 - RNA, 20 nt, Artificial Sequence
  Synthetic
cgccugccgcgggauccugg

SEQ ID NO: 9178 - RNA, 20 nt, Artificial Sequence
  Synthetic
ggacauggacgcggagcugg

SEQ ID NO: 9179 - RNA, 20 nt, Artificial Sequence
  Synthetic
cgggauccuggaggcgcugg

SEQ ID NO: 9180 - RNA, 20 nt, Artificial Sequence
  Synthetic
ggcguggucugcggcgcugg

SEQ ID NO: 9181 - RNA, 20 nt, Artificial Sequence
  Synthetic
ggcugggccccggcggcugg

SEQ ID NO: 9182 - RNA, 20 nt, Artificial Sequence
  Synthetic
cgggcuguccugccugcugg

SEQ ID NO: 9183 - RNA, 20 nt, Artificial Sequence
  Synthetic
acagccgccccggccucugg

SEQ ID NO: 9184 - RNA, 20 nt, Artificial Sequence
  Synthetic
cuggggccuggcgcacgugg

SEQ ID NO: 9185 - RNA, 20 nt, Artificial Sequence
  Synthetic
gcccgcccaggcggccgugg

SEQ ID NO: 9186 - RNA, 20 nt, Artificial Sequence
  Synthetic
gggggucuucgcgcgcgugg

SEQ ID NO: 9187 - RNA, 20 nt, Artificial Sequence
  Synthetic
cgcggcgggcggcggcgugg

SEQ ID NO: 9188 - RNA, 20 nt, Artificial Sequence
  Synthetic
gggcgucgucgccgucgugg

SEQ ID NO: 9189 - RNA, 20 nt, Artificial Sequence
  Synthetic
gggcggcggcguggaggugg

SEQ ID NO: 9190 - RNA, 20 nt, Artificial Sequence
  Synthetic
gacgacggcgccggcggugg

SEQ ID NO: 9191 - RNA, 20 nt, Artificial Sequence
  Synthetic
gggcgcgccggcggcggugg

SEQ ID NO: 9192 - RNA, 20 nt, Artificial Sequence
  Synthetic
gacggcgccggcgguggugg

SEQ ID NO: 9193 - RNA, 20 nt, Artificial Sequence
  Synthetic
cgcgccggcggcgguggugg

SEQ ID NO: 9194 - RNA, 20 nt, Artificial Sequence
  Synthetic
gccggcggcggugguggugg

SEQ ID NO: 9195 - RNA, 20 nt, Artificial Sequence
  Synthetic
ggcggcgguggugguggugg

SEQ ID NO: 9196 - RNA, 20 nt, Artificial Sequence
  Synthetic
ggcggugguggugguggugg

SEQ ID NO: 9197 - RNA, 20 nt, Artificial Sequence
  Synthetic
gcgcgcgcgggucgaacaug

SEQ ID NO: 9198 - RNA, 20 nt, Artificial Sequence
  Synthetic
gcggcgacaggcuggccaug

SEQ ID NO: 9199 - RNA, 20 nt, Artificial Sequence
  Synthetic
gcacggcguugacgacgaug

SEQ ID NO: 9200 - RNA, 20 nt, Artificial Sequence
  Synthetic
cgccggacgcggaggcgaug

SEQ ID NO: 9201 - RNA, 20 nt, Artificial Sequence
  Synthetic
cgcgggccgugccccaccug

SEQ ID NO: 9202 - RNA, 20 nt, Artificial Sequence
  Synthetic
uggcggcgccagccgcccug

SEQ ID NO: 9203 - RNA, 20 nt, Artificial Sequence
  Synthetic
cgggggugcucgccgcccug

SEQ ID NO: 9204 - RNA, 20 nt, Artificial Sequence
  Synthetic
ccggcgccguggaguuccug

SEQ ID NO: 9205 - RNA, 20 nt, Artificial Sequence
  Synthetic
gcgccuggcugcgcgagcug

SEQ ID NO: 9206 - RNA, 20 nt, Artificial Sequence
  Synthetic
ggggccugggcgcgccgcug

SEQ ID NO: 9207 - RNA, 20 nt, Artificial Sequence
  Synthetic
caccgcgccugcgcgcgcug

SEQ ID NO: 9208 - RNA, 20 nt, Artificial Sequence
  Synthetic
ggcccgucuacguggcgcug

SEQ ID NO: 9209 - RNA, 20 nt, Artificial Sequence
  Synthetic
gcggcgggccgcuucggcug

SEQ ID NO: 9210 - RNA, 20 nt, Artificial Sequence
  Synthetic
gccgacgcccagcguaucug

SEQ ID NO: 9211 - RNA, 20 nt, Artificial Sequence
  Synthetic
gacagccgccccggccucug

SEQ ID NO: 9212 - RNA, 20 nt, Artificial Sequence
  Synthetic
gcccugggcaaccggcucug

SEQ ID NO: 9213 - RNA, 20 nt, Artificial Sequence
  Synthetic
cccgcccgcggcguggucug

SEQ ID NO: 9214 - RNA, 20 nt, Artificial Sequence
  Synthetic
ucugccgcggggccaacgug

SEQ ID NO: 9215 - RNA, 20 nt, Artificial Sequence
  Synthetic
cgggcgccccggcgcccgug

SEQ ID NO: 9216 - RNA, 20 nt, Artificial Sequence
  Synthetic
cggccgagggcgccggcgug

SEQ ID NO: 9217 - RNA, 20 nt, Artificial Sequence
  Synthetic
aggcggggcgcgucggcgug

SEQ ID NO: 9218 - RNA, 20 nt, Artificial Sequence
  Synthetic
gccauggcguaccccaggug

SEQ ID NO: 9219 - RNA, 20 nt, Artificial Sequence
  Synthetic
ggccggaggccagcacggug

SEQ ID NO: 9220 - RNA, 20 nt, Artificial Sequence
  Synthetic
gcggcggcguggagguggug

SEQ ID NO: 9221 - RNA, 20 nt, Artificial Sequence
  Synthetic
cgacgacgacggacuguuug

SEQ ID NO: 9222 - RNA, 20 nt, Artificial Sequence
  Synthetic
cgguacucgcgcggggacau

SEQ ID NO: 9223 - RNA, 20 nt, Artificial Sequence
  Synthetic
cgcggcgacaggcuggccau

SEQ ID NO: 9224 - RNA, 20 nt, Artificial Sequence
  Synthetic
acgccggacgcggaggcgau

SEQ ID NO: 9225 - RNA, 20 nt, Artificial Sequence
  Synthetic
gcgcgggccgugccccaccu

SEQ ID NO: 9226 - RNA, 20 nt, Artificial Sequence
  Synthetic
cacgccgcgggcgggacccu

SEQ ID NO: 9227 - RNA, 20 nt, Artificial Sequence
  Synthetic
gcgggggugcucgccgcccu

SEQ ID NO: 9228 - RNA, 20 nt, Artificial Sequence
  Synthetic
cagccacacgccggcgcccu

SEQ ID NO: 9229 - RNA, 20 nt, Artificial Sequence
  Synthetic
uccugccugcuggcggcccu

SEQ ID NO: 9230 - RNA, 20 nt, Artificial Sequence
  Synthetic
gccggggcgggcucggcccu

SEQ ID NO: 9231 - RNA, 20 nt, Artificial Sequence
  Synthetic
agccuggucgccggggcccu

SEQ ID NO: 9232 - RNA, 20 nt, Artificial Sequence
  Synthetic
gcccugcgggucggggcccu

SEQ ID NO: 9233 - RNA, 20 nt, Artificial Sequence
  Synthetic
ggacggccgggccgccgccu

SEQ ID NO: 9234 - RNA, 20 nt, Artificial Sequence
  Synthetic
cgggcccgccacggccgccu

SEQ ID NO: 9235 - RNA, 20 nt, Artificial Sequence
  Synthetic
ggcccgcgccuccuccgccu

SEQ ID NO: 9236 - RNA, 20 nt, Artificial Sequence
  Synthetic
cuucggcccgcugcgcgccu

SEQ ID NO: 9237 - RNA, 20 nt, Artificial Sequence
  Synthetic
auguccacgggcucgcgccu

SEQ ID NO: 9238 - RNA, 20 nt, Artificial Sequence
  Synthetic
gcgggcccgguucgaggccu

SEQ ID NO: 9239 - RNA, 20 nt, Artificial Sequence
  Synthetic
gccugcgcgcgcuggggccu

SEQ ID NO: 9240 - RNA, 20 nt, Artificial Sequence
  Synthetic
gccggcgccguggaguuccu

SEQ ID NO: 9241 - RNA, 20 nt, Artificial Sequence
  Synthetic
cugcgccgcgucgcccagcu

SEQ ID NO: 9242 - RNA, 20 nt, Artificial Sequence
  Synthetic
cccgugugggcgcccgagcu

SEQ ID NO: 9243 - RNA, 20 nt, Artificial Sequence
  Synthetic
gagcgggugguccgugagcu

SEQ ID NO: 9244 - RNA, 20 nt, Artificial Sequence
  Synthetic
cccgcccccgcagauacgcu

SEQ ID NO: 9245 - RNA, 20 nt, Artificial Sequence
  Synthetic
cgaccgcgacgcgggccgcu

SEQ ID NO: 9246 - RNA, 20 nt, Artificial Sequence
  Synthetic
gcaggacagcccgccgcgcu

SEQ ID NO: 9247 - RNA, 20 nt, Artificial Sequence
  Synthetic
gcaccgcgccugcgcgcgcu

SEQ ID NO: 9248 - RNA, 20 nt, Artificial Sequence
  Synthetic
gcgcgccccccgccggcgcu

SEQ ID NO: 9249 - RNA, 20 nt, Artificial Sequence
  Synthetic
gcccccgacgucucggcgcu

SEQ ID NO: 9250 - RNA, 20 nt, Artificial Sequence
  Synthetic
cggcccgucuacguggcgcu

SEQ ID NO: 9251 - RNA, 20 nt, Artificial Sequence
  Synthetic
ggcggcgggccgcuucggcu

SEQ ID NO: 9252 - RNA, 20 nt, Artificial Sequence
  Synthetic
cgcgugcuguacggcgggcu

SEQ ID NO: 9253 - RNA, 20 nt, Artificial Sequence
  Synthetic
gguccgggccggggcgggcu

SEQ ID NO: 9254 - RNA, 20 nt, Artificial Sequence
  Synthetic
ggcucggcccugggcgggcu

SEQ ID NO: 9255 - RNA, 20 nt, Artificial Sequence
  Synthetic
gagggcgccggcguguggcu

SEQ ID NO: 9256 - RNA, 20 nt, Artificial Sequence
  Synthetic
ccaggccugcuuccggaucu

SEQ ID NO: 9257 - RNA, 20 nt, Artificial Sequence
  Synthetic
cgacagccgccccggccucu

SEQ ID NO: 9258 - RNA, 20 nt, Artificial Sequence
  Synthetic
gaccggcgcccccgacgucu

SEQ ID NO: 9259 - RNA, 20 nt, Artificial Sequence
  Synthetic
cacggcccgcggggcgcagu

SEQ ID NO: 9260 - RNA, 20 nt, Artificial Sequence
  Synthetic
ggcgggcgcggcgagcgagu

SEQ ID NO: 9261 - RNA, 20 nt, Artificial Sequence
  Synthetic
gcgcacgcgguaccgcacgu

SEQ ID NO: 9262 - RNA, 20 nt, Artificial Sequence
  Synthetic
cgcgcccagcgccgagacgu

SEQ ID NO: 9263 - RNA, 20 nt, Artificial Sequence
  Synthetic
ccgcgagaccacgggcccgu

SEQ ID NO: 9264 - RNA, 20 nt, Artificial Sequence
  Synthetic
cagcgggggcgcgucgccgu

SEQ ID NO: 9265 - RNA, 20 nt, Artificial Sequence
  Synthetic
cgccgccgccccguugccgu

SEQ ID NO: 9266 - RNA, 20 nt, Artificial Sequence
  Synthetic
gaaggcgccggaggccgcgu

SEQ ID NO: 9267 - RNA, 20 nt, Artificial Sequence
  Synthetic
gaggcgcagcggcggcgcgu

SEQ ID NO: 9268 - RNA, 20 nt, Artificial Sequence
  Synthetic
gcgcgccagcaggggcgcgu

SEQ ID NO: 9269 - RNA, 20 nt, Artificial Sequence
  Synthetic
ggcgcgcaggcggggcgcgu

SEQ ID NO: 9270 - RNA, 20 nt, Artificial Sequence
  Synthetic
ggcggccgcggcggcggcgu

SEQ ID NO: 9271 - RNA, 20 nt, Artificial Sequence
  Synthetic
cccgcagauacgcugggcgu

SEQ ID NO: 9272 - RNA, 20 nt, Artificial Sequence
  Synthetic
ggcgggcaccgcgcgcucgu

SEQ ID NO: 9273 - RNA, 20 nt, Artificial Sequence
  Synthetic
guuggcgucgccgccgucgu

SEQ ID NO: 9274 - RNA, 20 nt, Artificial Sequence
  Synthetic
aaaauccggauccucgucgu

SEQ ID NO: 9275 - RNA, 20 nt, Artificial Sequence
  Synthetic
gucgucgucgucgucgucgu

SEQ ID NO: 9276 - RNA, 20 nt, Artificial Sequence
  Synthetic
cgccauggcguaccccaggu

SEQ ID NO: 9277 - RNA, 20 nt, Artificial Sequence
  Synthetic
cagcaccucgcaggccaggu

SEQ ID NO: 9278 - RNA, 20 nt, Artificial Sequence
  Synthetic
gucgucgccgucguggcggu

SEQ ID NO: 9279 - RNA, 20 nt, Artificial Sequence
  Synthetic
cacgcgcacguccuccgggu

SEQ ID NO: 9280 - RNA, 20 nt, Artificial Sequence
  Synthetic
gcgccagccgcccugcgggu

SEQ ID NO: 9281 - RNA, 20 nt, Artificial Sequence
  Synthetic
ggcggcggcguggagguggu

SEQ ID NO: 9282 - RNA, 20 nt, Artificial Sequence
  Synthetic
gggcgccccggcgcccgugu

SEQ ID NO: 9283 - RNA, 20 nt, Artificial Sequence
  Synthetic
ggacaugggcaccagcgugu

SEQ ID NO: 9284 - RNA, 20 nt, Artificial Sequence
  Synthetic
gucggccgcggcgacggugu

SEQ ID NO: 9285 - RNA, 20 nt, Artificial Sequence
  Synthetic
gguggugguggugguggugu

SEQ ID NO: 9286 - RNA, 20 nt, Artificial Sequence
  Synthetic
ggcggcgcgcccgccgccuu

SEQ ID NO: 9287 - RNA, 20 nt, Artificial Sequence
  Synthetic
gccauggcggcgggccgcuu

SEQ ID NO: 9288 - RNA, 20 nt, Artificial Sequence
  Synthetic
uaccgcgugcgcacgcgcuu

SEQ ID NO: 9289 - RNA, 20 nt, Artificial Sequence
  Synthetic
gcguccgcgcggcucuucuu

SEQ ID NO: 9290 - RNA, 20 nt, Artificial Sequence
  Synthetic
gacgacgacgacggacuguu

SEQ ID NO: 9291 - RNA, 20 nt, Artificial Sequence
  Synthetic
cuggccuccggccgcguguu

SEQ ID NO: 9292 - RNA, 20 nt, Artificial Sequence
  Synthetic
acgacgacgacggacuguuu

SEQ ID NO: 9293 - RNA, 21 nt, Artificial Sequence
  Synthetic
gucgcgcuccggggggggcga

SEQ ID NO: 9294 - RNA, 24 nt, Artificial Sequence
  Synthetic
gccgucgcgcuccggggggggcga

SEQ ID NO: 9295 - RNA, 21 nt, Artificial Sequence
  Synthetic
gccauaaucggcgcgcaugga

SEQ ID NO: 9296 - RNA, 19 nt, Artificial Sequence
  Synthetic
gugggcggcgguccgucgg

SEQ ID NO: 9297 - RNA, 20 nt, Artificial Sequence
  Synthetic
ggugggcggcgguccgucgg

SEQ ID NO: 9298 - RNA, 21 nt, Artificial Sequence
  Synthetic
gggugggcggcgguccgucgg

SEQ ID NO: 9299 - RNA, 22 nt, Artificial Sequence
  Synthetic
ggggugggcggcgguccgucgg

SEQ ID NO: 9300 - RNA, 18 nt, Artificial Sequence
  Synthetic
ggggcgacgguccggguu

SEQ ID NO: 9301 - RNA, 20 nt, Artificial Sequence
  Synthetic
gcggggcgacgguccggguu

SEQ ID NO: 9302 - RNA, 21 nt, Artificial Sequence
  Synthetic
ggcggggcgacgguccggguu

SEQ ID NO: 9303 - RNA, 23 nt, Artificial Sequence
  Synthetic
gcggcggggcgacgguccggguu

SEQ ID NO: 9304 - RNA, 19 nt, Artificial Sequence
  Synthetic
gcggagacgaccggcggcc

SEQ ID NO: 9305 - RNA, 20 nt, Artificial Sequence
  Synthetic
ggcggagacgaccggcggcc

SEQ ID NO: 9306 - RNA, 22 nt, Artificial Sequence
  Synthetic
gcggcggagacgaccggcggcc

SEQ ID NO: 9307 - RNA, 18 nt, Artificial Sequence
  Synthetic
gucgccccgccgcgcggc

SEQ ID NO: 9308 - RNA, 22 nt, Artificial Sequence
  Synthetic
gaccgucgccccgccgcgcggc

SEQ ID NO: 9309 - RNA, 23 nt, Artificial Sequence
  Synthetic
ggaccgucgccccgccgcgcggc

SEQ ID NO: 9310 - RNA, 19 nt, Artificial Sequence
  Synthetic
gaccggcggccccggaucu

SEQ ID NO: 9311 - RNA, 22 nt, Artificial Sequence
  Synthetic
gacgaccggcggccccggaucu

SEQ ID NO: 9312 - RNA, 24 nt, Artificial Sequence
  Synthetic
gagacgaccggcggccccggaucu

SEQ ID NO: 9313 - RNA, 21 nt, Artificial Sequence
  Synthetic
gccccgccgcgcggcccgggu

SEQ ID NO: 9314 - RNA, 24 nt, Artificial Sequence
  Synthetic
gucgccccgccgcgcggcccgggu

SEQ ID NO: 9315 - RNA, 22 nt, Artificial Sequence
  Synthetic
cgucgcgcuccggggggggcga

SEQ ID NO: 9316 - RNA, 23 nt, Artificial Sequence
  Synthetic
ccgucgcgcuccggggggggcga

SEQ ID NO: 9317 - RNA, 18 nt, Artificial Sequence
  Synthetic
auaaucggcgcgcaugga

SEQ ID NO: 9318 - RNA, 19 nt, Artificial Sequence
  Synthetic
cauaaucggcgcgcaugga

SEQ ID NO: 9319 - RNA, 20 nt, Artificial Sequence
  Synthetic
ccauaaucggcgcgcaugga

SEQ ID NO: 9320 - RNA, 22 nt, Artificial Sequence
  Synthetic
cgccauaaucggcgcgcaugga

SEQ ID NO: 9321 - RNA, 23 nt, Artificial Sequence
  Synthetic
ucgccauaaucggcgcgcaugga

SEQ ID NO: 9322 - RNA, 24 nt, Artificial Sequence
  Synthetic
cucgccauaaucggcgcgcaugga

SEQ ID NO: 9323 - RNA, 18 nt, Artificial Sequence
  Synthetic
ugggcggcgguccgucgg

SEQ ID NO: 9324 - RNA, 23 nt, Artificial Sequence
  Synthetic
cggggugggcggcgguccgucgg

SEQ ID NO: 9325 - RNA, 24 nt, Artificial Sequence
  Synthetic
ucggggugggcggcgguccgucgg

SEQ ID NO: 9326 - RNA, 19 nt, Artificial Sequence
  Synthetic
cggggcgacgguccggguu

SEQ ID NO: 9327 - RNA, 22 nt, Artificial Sequence
  Synthetic
cggcggggcgacgguccggguu

SEQ ID NO: 9328 - RNA, 24 nt, Artificial Sequence
  Synthetic
cgcggcggggcgacgguccggguu

SEQ ID NO: 9329 - RNA, 18 nt, Artificial Sequence
  Synthetic
cggagacgaccggcggcc

SEQ ID NO: 9330 - RNA, 21 nt, Artificial Sequence
  Synthetic
cggcggagacgaccggcggcc

SEQ ID NO: 9331 - RNA, 23 nt, Artificial Sequence
  Synthetic
cgcggcggagacgaccggcggcc

SEQ ID NO: 9332 - RNA, 24 nt, Artificial Sequence
  Synthetic
ccgcggcggagacgaccggcggcc

SEQ ID NO: 9333 - RNA, 19 nt, Artificial Sequence
  Synthetic
cgucgccccgccgcgcggc

SEQ ID NO: 9334 - RNA, 20 nt, Artificial Sequence
  Synthetic
ccgucgccccgccgcgcggc

SEQ ID NO: 9335 - RNA, 21 nt, Artificial Sequence
  Synthetic
accgucgccccgccgcgcggc

SEQ ID NO: 9336 - RNA, 24 nt, Artificial Sequence
  Synthetic
cggaccgucgccccgccgcgcggc

SEQ ID NO: 9337 - RNA, 18 nt, Artificial Sequence
  Synthetic
accggcggccccggaucu

SEQ ID NO: 9338 - RNA, 20 nt, Artificial Sequence
  Synthetic
cgaccggcggccccggaucu

SEQ ID NO: 9339 - RNA, 21 nt, Artificial Sequence
  Synthetic
acgaccggcggccccggaucu

SEQ ID NO: 9340 - RNA, 23 nt, Artificial Sequence
  Synthetic
agacgaccggcggccccggaucu

SEQ ID NO: 9341 - RNA, 22 nt, Artificial Sequence
  Synthetic
cgccccgccgcgcggcccgggu

SEQ ID NO: 9342 - RNA, 23 nt, Artificial Sequence
  Synthetic
ucgccccgccgcgcggcccgggu

SEQ ID NO: 9343 - RNA, 18 nt, Artificial Sequence
  Synthetic
gcgcuccggggggggcga

SEQ ID NO: 9344 - RNA, 19 nt, Artificial Sequence
  Synthetic
cgcgcuccggggggggcga

SEQ ID NO: 9345 - RNA, 20 nt, Artificial Sequence
  Synthetic
ucgcgcuccggggggggcga

SEQ ID NO: 9346 - RNA, 18 nt, Artificial Sequence
  Synthetic
gcgcggcggggcgacggu

SEQ ID NO: 9347 - RNA, 19 nt, Artificial Sequence
  Synthetic
cgcgcggcggggcgacggu

SEQ ID NO: 9348 - RNA, 20 nt, Artificial Sequence
  Synthetic
ccgcgcggcggggcgacggu

SEQ ID NO: 9349 - RNA, 21 nt, Artificial Sequence
  Synthetic
gccgcgcggcggggcgacggu

SEQ ID NO: 9350 - RNA, 22 nt, Artificial Sequence
  Synthetic
ggccgcgcggcggggcgacggu

SEQ ID NO: 9351 - RNA, 23 nt, Artificial Sequence
  Synthetic
gggccgcgcggcggggcgacggu

SEQ ID NO: 9352 - RNA, 24 nt, Artificial Sequence
  Synthetic
cgggccgcgcggcggggcgacggu

SEQ ID NO: 9353 - RNA, 18 nt, Artificial Sequence
  Synthetic
ccgccgcgcggcccgggu

SEQ ID NO: 9354 - RNA, 19 nt, Artificial Sequence
  Synthetic
cccgccgcgcggcccgggu

SEQ ID NO: 9355 - RNA, 20 nt, Artificial Sequence
  Synthetic
ccccgccgcgcggcccgggu

SEQ ID NO: 9356 - RNA, 18 nt, Artificial Sequence
  Synthetic
gaacggccucguccacca

SEQ ID NO: 9357 - RNA, 19 nt, Artificial Sequence
  Synthetic
cgaacggccucguccacca

SEQ ID NO: 9358 - RNA, 20 nt, Artificial Sequence
  Synthetic
gcgaacggccucguccacca

SEQ ID NO: 9359 - RNA, 21 nt, Artificial Sequence
  Synthetic
ugcgaacggccucguccacca

SEQ ID NO: 9360 - RNA, 22 nt, Artificial Sequence
  Synthetic
gugcgaacggccucguccacca

SEQ ID NO: 9361 - RNA, 23 nt, Artificial Sequence
  Synthetic
cgugcgaacggccucguccacca

SEQ ID NO: 9362 - RNA, 24 nt, Artificial Sequence
  Synthetic
ucgugcgaacggccucguccacca

SEQ ID NO: 9363 - RNA, 18 nt, Artificial Sequence
  Synthetic
cgccauaaucggcgcgca

SEQ ID NO: 9364 - RNA, 19 nt, Artificial Sequence
  Synthetic
ucgccauaaucggcgcgca

SEQ ID NO: 9365 - RNA, 20 nt, Artificial Sequence
  Synthetic
cucgccauaaucggcgcgca

SEQ ID NO: 9366 - RNA, 21 nt, Artificial Sequence
  Synthetic
ccucgccauaaucggcgcgca

SEQ ID NO: 9367 - RNA, 22 nt, Artificial Sequence
  Synthetic
uccucgccauaaucggcgcgca

SEQ ID NO: 9368 - RNA, 23 nt, Artificial Sequence
  Synthetic
cuccucgccauaaucggcgcgca

SEQ ID NO: 9369 - RNA, 24 nt, Artificial Sequence
  Synthetic
ucuccucgccauaaucggcgcgca

SEQ ID NO: 9370 - RNA, 18 nt, Artificial Sequence
  Synthetic
ccgcggcggagaaggcga

SEQ ID NO: 9371 - RNA, 19 nt, Artificial Sequence
  Synthetic
uccgcggcggagaaggcga

SEQ ID NO: 9372 - RNA, 20 nt, Artificial Sequence
  Synthetic
guccgcggcggagaaggcga

SEQ ID NO: 9373 - RNA, 21 nt, Artificial Sequence
  Synthetic
gguccgcggcggagaaggcga

SEQ ID NO: 9374 - RNA, 22 nt, Artificial Sequence
  Synthetic
ggguccgcggcggagaaggcga

SEQ ID NO: 9375 - RNA, 23 nt, Artificial Sequence
  Synthetic
gggguccgcggcggagaaggcga

SEQ ID NO: 9376 - RNA, 24 nt, Artificial Sequence
  Synthetic
ggggguccgcggcggagaaggcga

SEQ ID NO: 9377 - RNA, 18 nt, Artificial Sequence
  Synthetic
ccaccgugccacccgaac

SEQ ID NO: 9378 - RNA, 19 nt, Artificial Sequence
  Synthetic
cccaccgugccacccgaac

SEQ ID NO: 9379 - RNA, 20 nt, Artificial Sequence
  Synthetic
gcccaccgugccacccgaac

SEQ ID NO: 9380 - RNA, 21 nt, Artificial Sequence
  Synthetic
ggcccaccgugccacccgaac

SEQ ID NO: 9381 - RNA, 22 nt, Artificial Sequence
  Synthetic
cggcccaccgugccacccgaac

SEQ ID NO: 9382 - RNA, 23 nt, Artificial Sequence
  Synthetic
ccggcccaccgugccacccgaac

SEQ ID NO: 9383 - RNA, 24 nt, Artificial Sequence
  Synthetic
uccggcccaccgugccacccgaac

SEQ ID NO: 9384 - RNA, 18 nt, Artificial Sequence
  Synthetic
uccggcccaccgugccac

SEQ ID NO: 9385 - RNA, 19 nt, Artificial Sequence
  Synthetic
cuccggcccaccgugccac

SEQ ID NO: 9386 - RNA, 20 nt, Artificial Sequence
  Synthetic
ccuccggcccaccgugccac

SEQ ID NO: 9387 - RNA, 21 nt, Artificial Sequence
  Synthetic
uccuccggcccaccgugccac

SEQ ID NO: 9388 - RNA, 22 nt, Artificial Sequence
  Synthetic
cuccuccggcccaccgugccac

SEQ ID NO: 9389 - RNA, 23 nt, Artificial Sequence
  Synthetic
ucuccuccggcccaccgugccac

SEQ ID NO: 9390 - RNA, 24 nt, Artificial Sequence
  Synthetic
uucuccuccggcccaccgugccac

SEQ ID NO: 9391 - RNA, 18 nt, Artificial Sequence
  Synthetic
gucgucuccgccgcggcc

SEQ ID NO: 9392 - RNA, 19 nt, Artificial Sequence
  Synthetic
ggucgucuccgccgcggcc

SEQ ID NO: 9393 - RNA, 20 nt, Artificial Sequence
  Synthetic
cggucgucuccgccgcggcc

SEQ ID NO: 9394 - RNA, 21 nt, Artificial Sequence
  Synthetic
ccggucgucuccgccgcggcc

SEQ ID NO: 9395 - RNA, 22 nt, Artificial Sequence
  Synthetic
gccggucgucuccgccgcggcc

SEQ ID NO: 9396 - RNA, 23 nt, Artificial Sequence
  Synthetic
cgccggucgucuccgccgcggcc

SEQ ID NO: 9397 - RNA, 24 nt, Artificial Sequence
  Synthetic
ccgccggucgucuccgccgcggcc

SEQ ID NO: 9398 - RNA, 18 nt, Artificial Sequence
  Synthetic
ggcucgucgacggccucc

SEQ ID NO: 9399 - RNA, 19 nt, Artificial Sequence
  Synthetic
aggcucgucgacggccucc

SEQ ID NO: 9400 - RNA, 20 nt, Artificial Sequence
  Synthetic
caggcucgucgacggccucc

SEQ ID NO: 9401 - RNA, 21 nt, Artificial Sequence
  Synthetic
gcaggcucgucgacggccucc

SEQ ID NO: 9402 - RNA, 22 nt, Artificial Sequence
  Synthetic
ggcaggcucgucgacggccucc

SEQ ID NO: 9403 - RNA, 23 nt, Artificial Sequence
  Synthetic
cggcaggcucgucgacggccucc

SEQ ID NO: 9404 - RNA, 24 nt, Artificial Sequence
  Synthetic
gcggcaggcucgucgacggccucc

SEQ ID NO: 9405 - RNA, 18 nt, Artificial Sequence
  Synthetic
ugcgcgccgucgcgcucc

SEQ ID NO: 9406 - RNA, 19 nt, Artificial Sequence
  Synthetic
uugcgcgccgucgcgcucc

SEQ ID NO: 9407 - RNA, 20 nt, Artificial Sequence
  Synthetic
cuugcgcgccgucgcgcucc

SEQ ID NO: 9408 - RNA, 21 nt, Artificial Sequence
  Synthetic
ucuugcgcgccgucgcgcucc

SEQ ID NO: 9409 - RNA, 22 nt, Artificial Sequence
  Synthetic
uucuugcgcgccgucgcgcucc

SEQ ID NO: 9410 - RNA, 23 nt, Artificial Sequence
  Synthetic
cuucuugcgcgccgucgcgcucc

SEQ ID NO: 9411 - RNA, 24 nt, Artificial Sequence
  Synthetic
ucuucuugcgcgccgucgcgcucc

SEQ ID NO: 9412 - RNA, 18 nt, Artificial Sequence
  Synthetic
gacggccuccccggacgc

SEQ ID NO: 9413 - RNA, 19 nt, Artificial Sequence
  Synthetic
cgacggccuccccggacgc

SEQ ID NO: 9414 - RNA, 20 nt, Artificial Sequence
  Synthetic
ucgacggccuccccggacgc

SEQ ID NO: 9415 - RNA, 21 nt, Artificial Sequence
  Synthetic
gucgacggccuccccggacgc

SEQ ID NO: 9416 - RNA, 22 nt, Artificial Sequence
  Synthetic
cgucgacggccuccccggacgc

SEQ ID NO: 9417 - RNA, 23 nt, Artificial Sequence
  Synthetic
ucgucgacggccuccccggacgc

SEQ ID NO: 9418 - RNA, 24 nt, Artificial Sequence
  Synthetic
cucgucgacggccuccccggacgc

SEQ ID NO: 9419 - RNA, 18 nt, Artificial Sequence
  Synthetic
ucgccauaaucggcgcgc

SEQ ID NO: 9420 - RNA, 19 nt, Artificial Sequence
  Synthetic
cucgccauaaucggcgcgc

SEQ ID NO: 9421 - RNA, 20 nt, Artificial Sequence
  Synthetic
ccucgccauaaucggcgcgc

SEQ ID NO: 9422 - RNA, 21 nt, Artificial Sequence
  Synthetic
uccucgccauaaucggcgcgc

SEQ ID NO: 9423 - RNA, 22 nt, Artificial Sequence
  Synthetic
cuccucgccauaaucggcgcgc

SEQ ID NO: 9424 - RNA, 23 nt, Artificial Sequence
  Synthetic
ucuccucgccauaaucggcgcgc

SEQ ID NO: 9425 - RNA, 24 nt, Artificial Sequence
  Synthetic
uucuccucgccauaaucggcgcgc

SEQ ID NO: 9426 - RNA, 18 nt, Artificial Sequence
  Synthetic
ggucgucuccgccgcggc

SEQ ID NO: 9427 - RNA, 19 nt, Artificial Sequence
  Synthetic
cggucgucuccgccgcggc

SEQ ID NO: 9428 - RNA, 20 nt, Artificial Sequence
  Synthetic
ccggucgucuccgccgcggc

SEQ ID NO: 9429 - RNA, 21 nt, Artificial Sequence
  Synthetic
gccggucgucuccgccgcggc

SEQ ID NO: 9430 - RNA, 22 nt, Artificial Sequence
  Synthetic
cgccggucgucuccgccgcggc

SEQ ID NO: 9431 - RNA, 23 nt, Artificial Sequence
  Synthetic
ccgccggucgucuccgccgcggc

SEQ ID NO: 9432 - RNA, 24 nt, Artificial Sequence
  Synthetic
gccgccggucgucuccgccgcggc

SEQ ID NO: 9433 - RNA, 18 nt, Artificial Sequence
  Synthetic
cggcuggauccggagauc

SEQ ID NO: 9434 - RNA, 19 nt, Artificial Sequence
  Synthetic
ucggcuggauccggagauc

SEQ ID NO: 9435 - RNA, 20 nt, Artificial Sequence
  Synthetic
gucggcuggauccggagauc

SEQ ID NO: 9436 - RNA, 21 nt, Artificial Sequence
  Synthetic
cgucggcuggauccggagauc

SEQ ID NO: 9437 - RNA, 22 nt, Artificial Sequence
  Synthetic
ccgucggcuggauccggagauc

SEQ ID NO: 9438 - RNA, 23 nt, Artificial Sequence
  Synthetic
uccgucggcuggauccggagauc

SEQ ID NO: 9439 - RNA, 24 nt, Artificial Sequence
  Synthetic
guccgucggcuggauccggagauc

SEQ ID NO: 9440 - RNA, 18 nt, Artificial Sequence
  Synthetic
cgguccgucggcuggauc

SEQ ID NO: 9441 - RNA, 19 nt, Artificial Sequence
  Synthetic
gcgguccgucggcuggauc

SEQ ID NO: 9442 - RNA, 20 nt, Artificial Sequence
  Synthetic
ggcgguccgucggcuggauc

SEQ ID NO: 9443 - RNA, 21 nt, Artificial Sequence
  Synthetic
cggcgguccgucggcuggauc

SEQ ID NO: 9444 - RNA, 22 nt, Artificial Sequence
  Synthetic
gcggcgguccgucggcuggauc

SEQ ID NO: 9445 - RNA, 23 nt, Artificial Sequence
  Synthetic
ggcggcgguccgucggcuggauc

SEQ ID NO: 9446 - RNA, 24 nt, Artificial Sequence
  Synthetic
gggcggcgguccgucggcuggauc

SEQ ID NO: 9447 - RNA, 18 nt, Artificial Sequence
  Synthetic
uugcgcgccgucgcgcuc

SEQ ID NO: 9448 - RNA, 19 nt, Artificial Sequence
  Synthetic
cuugcgcgccgucgcgcuc

SEQ ID NO: 9449 - RNA, 20 nt, Artificial Sequence
  Synthetic
ucuugcgcgccgucgcgcuc

SEQ ID NO: 9450 - RNA, 21 nt, Artificial Sequence
  Synthetic
uucuugcgcgccgucgcgcuc

SEQ ID NO: 9451 - RNA, 22 nt, Artificial Sequence
  Synthetic
cuucuugcgcgccgucgcgcuc

SEQ ID NO: 9452 - RNA, 23 nt, Artificial Sequence
  Synthetic
ucuucuugcgcgccgucgcgcuc

SEQ ID NO: 9453 - RNA, 24 nt, Artificial Sequence
  Synthetic
uucuucuugcgcgccgucgcgcuc

SEQ ID NO: 9454 - RNA, 18 nt, Artificial Sequence
  Synthetic
ggguccgcggcggagaag

SEQ ID NO: 9455 - RNA, 19 nt, Artificial Sequence
  Synthetic
gggguccgcggcggagaag

SEQ ID NO: 9456 - RNA, 20 nt, Artificial Sequence
  Synthetic
ggggguccgcggcggagaag

SEQ ID NO: 9457 - RNA, 21 nt, Artificial Sequence
  Synthetic
aggggguccgcggcggagaag

SEQ ID NO: 9458 - RNA, 22 nt, Artificial Sequence
  Synthetic
gaggggguccgcggcggagaag

SEQ ID NO: 9459 - RNA, 23 nt, Artificial Sequence
  Synthetic
ggaggggguccgcggcggagaag

SEQ ID NO: 9460 - RNA, 24 nt, Artificial Sequence
  Synthetic
uggaggggguccgcggcggagaag

SEQ ID NO: 9461 - RNA, 18 nt, Artificial Sequence
  Synthetic
guccaccaucgaggccag

SEQ ID NO: 9462 - RNA, 19 nt, Artificial Sequence
  Synthetic
cguccaccaucgaggccag

SEQ ID NO: 9463 - RNA, 20 nt, Artificial Sequence
  Synthetic
ucguccaccaucgaggccag

SEQ ID NO: 9464 - RNA, 21 nt, Artificial Sequence
  Synthetic
cucguccaccaucgaggccag

SEQ ID NO: 9465 - RNA, 22 nt, Artificial Sequence
  Synthetic
ccucguccaccaucgaggccag

SEQ ID NO: 9466 - RNA, 23 nt, Artificial Sequence
  Synthetic
gccucguccaccaucgaggccag

SEQ ID NO: 9467 - RNA, 24 nt, Artificial Sequence
  Synthetic
ggccucguccaccaucgaggccag

SEQ ID NO: 9468 - RNA, 18 nt, Artificial Sequence
  Synthetic
cgacggccuccccggacg

SEQ ID NO: 9469 - RNA, 19 nt, Artificial Sequence
  Synthetic
ucgacggccuccccggacg

SEQ ID NO: 9470 - RNA, 20 nt, Artificial Sequence
  Synthetic
gucgacggccuccccggacg

SEQ ID NO: 9471 - RNA, 21 nt, Artificial Sequence
  Synthetic
cgucgacggccuccccggacg

SEQ ID NO: 9472 - RNA, 22 nt, Artificial Sequence
  Synthetic
ucgucgacggccuccccggacg

SEQ ID NO: 9473 - RNA, 23 nt, Artificial Sequence
  Synthetic
cucgucgacggccuccccggacg

SEQ ID NO: 9474 - RNA, 24 nt, Artificial Sequence
  Synthetic
gcucgucgacggccuccccggacg

SEQ ID NO: 9475 - RNA, 18 nt, Artificial Sequence
  Synthetic
gcgcgccgucgcgcuccg

SEQ ID NO: 9476 - RNA, 19 nt, Artificial Sequence
  Synthetic
ugcgcgccgucgcgcuccg

SEQ ID NO: 9477 - RNA, 20 nt, Artificial Sequence
  Synthetic
uugcgcgccgucgcgcuccg

SEQ ID NO: 9478 - RNA, 21 nt, Artificial Sequence
  Synthetic
cuugcgcgccgucgcgcuccg

SEQ ID NO: 9479 - RNA, 22 nt, Artificial Sequence
  Synthetic
ucuugcgcgccgucgcgcuccg

SEQ ID NO: 9480 - RNA, 23 nt, Artificial Sequence
  Synthetic
uucuugcgcgccgucgcgcuccg

SEQ ID NO: 9481 - RNA, 24 nt, Artificial Sequence
  Synthetic
cuucuugcgcgccgucgcgcuccg

SEQ ID NO: 9482 - RNA, 18 nt, Artificial Sequence
  Synthetic
gcagggccagcugccgcg

SEQ ID NO: 9483 - RNA, 19 nt, Artificial Sequence
  Synthetic
agcagggccagcugccgcg

SEQ ID NO: 9484 - RNA, 20 nt, Artificial Sequence
  Synthetic
cagcagggccagcugccgcg

SEQ ID NO: 9485 - RNA, 21 nt, Artificial Sequence
  Synthetic
ccagcagggccagcugccgcg

SEQ ID NO: 9486 - RNA, 22 nt, Artificial Sequence
  Synthetic
gccagcagggccagcugccgcg

SEQ ID NO: 9487 - RNA, 23 nt, Artificial Sequence
  Synthetic
ggccagcagggccagcugccgcg

SEQ ID NO: 9488 - RNA, 24 nt, Artificial Sequence
  Synthetic
aggccagcagggccagcugccgcg

SEQ ID NO: 9489 - RNA, 18 nt, Artificial Sequence
  Synthetic
gcauggaggggguccgcg

SEQ ID NO: 9490 - RNA, 19 nt, Artificial Sequence
  Synthetic
cgcauggaggggguccgcg

SEQ ID NO: 9491 - RNA, 20 nt, Artificial Sequence
  Synthetic
gcgcauggaggggguccgcg

SEQ ID NO: 9492 - RNA, 21 nt, Artificial Sequence
  Synthetic
cgcgcauggaggggguccgcg

SEQ ID NO: 9493 - RNA, 22 nt, Artificial Sequence
  Synthetic
gcgcgcauggaggggguccgcg

SEQ ID NO: 9494 - RNA, 23 nt, Artificial Sequence
  Synthetic
ggcgcgcauggaggggguccgcg

SEQ ID NO: 9495 - RNA, 24 nt, Artificial Sequence
  Synthetic
cggcgcgcauggaggggguccgcg

SEQ ID NO: 9496 - RNA, 18 nt, Artificial Sequence
  Synthetic
ccgaacccgggccgcgcg

SEQ ID NO: 9497 - RNA, 19 nt, Artificial Sequence
  Synthetic
cccgaacccgggccgcgcg

SEQ ID NO: 9498 - RNA, 20 nt, Artificial Sequence
  Synthetic
acccgaacccgggccgcgcg

SEQ ID NO: 9499 - RNA, 21 nt, Artificial Sequence
  Synthetic
cacccgaacccgggccgcgcg

SEQ ID NO: 9500 - RNA, 22 nt, Artificial Sequence
  Synthetic
ccacccgaacccgggccgcgcg

SEQ ID NO: 9501 - RNA, 23 nt, Artificial Sequence
  Synthetic
gccacccgaacccgggccgcgcg

SEQ ID NO: 9502 - RNA, 24 nt, Artificial Sequence
  Synthetic
ugccacccgaacccgggccgcgcg

SEQ ID NO: 9503 - RNA, 18 nt, Artificial Sequence
  Synthetic
uggaggggguccgcggcg

SEQ ID NO: 9504 - RNA, 19 nt, Artificial Sequence
  Synthetic
auggaggggguccgcggcg

SEQ ID NO: 9505 - RNA, 20 nt, Artificial Sequence
  Synthetic
cauggaggggguccgcggcg

SEQ ID NO: 9506 - RNA, 21 nt, Artificial Sequence
  Synthetic
gcauggaggggguccgcggcg

SEQ ID NO: 9507 - RNA, 22 nt, Artificial Sequence
  Synthetic
cgcauggaggggguccgcggcg

SEQ ID NO: 9508 - RNA, 23 nt, Artificial Sequence
  Synthetic
gcgcauggaggggguccgcggcg

SEQ ID NO: 9509 - RNA, 24 nt, Artificial Sequence
  Synthetic
cgcgcauggaggggguccgcggcg

SEQ ID NO: 9510 - RNA, 18 nt, Artificial Sequence
  Synthetic
cgcgcuccggggggggcg

SEQ ID NO: 9511 - RNA, 19 nt, Artificial Sequence
  Synthetic
ucgcgcuccggggggggcg

SEQ ID NO: 9512 - RNA, 20 nt, Artificial Sequence
  Synthetic
gucgcgcuccggggggggcg

SEQ ID NO: 9513 - RNA, 21 nt, Artificial Sequence
  Synthetic
cgucgcgcuccggggggggcg

SEQ ID NO: 9514 - RNA, 22 nt, Artificial Sequence
  Synthetic
ccgucgcgcuccggggggggcg

SEQ ID NO: 9515 - RNA, 23 nt, Artificial Sequence
  Synthetic
gccgucgcgcuccggggggggcg

SEQ ID NO: 9516 - RNA, 24 nt, Artificial Sequence
  Synthetic
cgccgucgcgcuccggggggggcg

SEQ ID NO: 9517 - RNA, 18 nt, Artificial Sequence
  Synthetic
cgcgccgucgcgcuccgg

SEQ ID NO: 9518 - RNA, 19 nt, Artificial Sequence
  Synthetic
gcgcgccgucgcgcuccgg

SEQ ID NO: 9519 - RNA, 20 nt, Artificial Sequence
  Synthetic
ugcgcgccgucgcgcuccgg

SEQ ID NO: 9520 - RNA, 21 nt, Artificial Sequence
  Synthetic
uugcgcgccgucgcgcuccgg

SEQ ID NO: 9521 - RNA, 22 nt, Artificial Sequence
  Synthetic
cuugcgcgccgucgcgcuccgg

SEQ ID NO: 9522 - RNA, 23 nt, Artificial Sequence
  Synthetic
ucuugcgcgccgucgcgcuccgg

SEQ ID NO: 9523 - RNA, 24 nt, Artificial Sequence
  Synthetic
uucuugcgcgccgucgcgcuccgg

SEQ ID NO: 9524 - RNA, 18 nt, Artificial Sequence
  Synthetic
cauggaggggguccgcgg

SEQ ID NO: 9525 - RNA, 19 nt, Artificial Sequence
  Synthetic
gcauggaggggguccgcgg

SEQ ID NO: 9526 - RNA, 20 nt, Artificial Sequence
  Synthetic
cgcauggaggggguccgcgg

SEQ ID NO: 9527 - RNA, 21 nt, Artificial Sequence
  Synthetic
gcgcauggaggggguccgcgg

SEQ ID NO: 9528 - RNA, 22 nt, Artificial Sequence
  Synthetic
cgcgcauggaggggguccgcgg

SEQ ID NO: 9529 - RNA, 23 nt, Artificial Sequence
  Synthetic
gcgcgcauggaggggguccgcgg

SEQ ID NO: 9530 - RNA, 24 nt, Artificial Sequence
  Synthetic
ggcgcgcauggaggggguccgcgg

SEQ ID NO: 9531 - RNA, 18 nt, Artificial Sequence
  Synthetic
cgaacccgggccgcgcgg

SEQ ID NO: 9532 - RNA, 19 nt, Artificial Sequence
  Synthetic
ccgaacccgggccgcgcgg

SEQ ID NO: 9533 - RNA, 20 nt, Artificial Sequence
  Synthetic
cccgaacccgggccgcgcgg

SEQ ID NO: 9534 - RNA, 21 nt, Artificial Sequence
  Synthetic
acccgaacccgggccgcgcgg

SEQ ID NO: 9535 - RNA, 22 nt, Artificial Sequence
  Synthetic
cacccgaacccgggccgcgcgg

SEQ ID NO: 9536 - RNA, 23 nt, Artificial Sequence
  Synthetic
ccacccgaacccgggccgcgcgg

SEQ ID NO: 9537 - RNA, 24 nt, Artificial Sequence
  Synthetic
gccacccgaacccgggccgcgcgg

SEQ ID NO: 9538 - RNA, 18 nt, Artificial Sequence
  Synthetic
gcgccgucgcgcuccggg

SEQ ID NO: 9539 - RNA, 19 nt, Artificial Sequence
  Synthetic
cgcgccgucgcgcuccggg

SEQ ID NO: 9540 - RNA, 20 nt, Artificial Sequence
  Synthetic
gcgcgccgucgcgcuccggg

SEQ ID NO: 9541 - RNA, 21 nt, Artificial Sequence
  Synthetic
ugcgcgccgucgcgcuccggg

SEQ ID NO: 9542 - RNA, 22 nt, Artificial Sequence
  Synthetic
uugcgcgccgucgcgcuccggg

SEQ ID NO: 9543 - RNA, 23 nt, Artificial Sequence
  Synthetic
cuugcgcgccgucgcgcuccggg

SEQ ID NO: 9544 - RNA, 24 nt, Artificial Sequence
  Synthetic
ucuugcgcgccgucgcgcuccggg

SEQ ID NO: 9545 - RNA, 18 nt, Artificial Sequence
  Synthetic
cgacgguccggguucggg

SEQ ID NO: 9546 - RNA, 19 nt, Artificial Sequence
  Synthetic
gcgacgguccggguucggg

SEQ ID NO: 9547 - RNA, 20 nt, Artificial Sequence
  Synthetic
ggcgacgguccggguucggg

SEQ ID NO: 9548 - RNA, 21 nt, Artificial Sequence
  Synthetic
gggcgacgguccggguucggg

SEQ ID NO: 9549 - RNA, 22 nt, Artificial Sequence
  Synthetic
ggggcgacgguccggguucggg

SEQ ID NO: 9550 - RNA, 23 nt, Artificial Sequence
  Synthetic
cggggcgacgguccggguucggg

SEQ ID NO: 9551 - RNA, 24 nt, Artificial Sequence
  Synthetic
gcggggcgacgguccggguucggg

SEQ ID NO: 9552 - RNA, 18 nt, Artificial Sequence
  Synthetic
cauaaucggcgcgcaugg

SEQ ID NO: 9553 - RNA, 19 nt, Artificial Sequence
  Synthetic
ccauaaucggcgcgcaugg

SEQ ID NO: 9554 - RNA, 20 nt, Artificial Sequence
  Synthetic
gccauaaucggcgcgcaugg

SEQ ID NO: 9555 - RNA, 21 nt, Artificial Sequence
  Synthetic
cgccauaaucggcgcgcaugg

SEQ ID NO: 9556 - RNA, 22 nt, Artificial Sequence
  Synthetic
ucgccauaaucggcgcgcaugg

SEQ ID NO: 9557 - RNA, 23 nt, Artificial Sequence
  Synthetic
cucgccauaaucggcgcgcaugg

SEQ ID NO: 9558 - RNA, 24 nt, Artificial Sequence
  Synthetic
ccucgccauaaucggcgcgcaugg

SEQ ID NO: 9559 - RNA, 18 nt, Artificial Sequence
  Synthetic
ccauaaucggcgcgcaug

SEQ ID NO: 9560 - RNA, 19 nt, Artificial Sequence
  Synthetic
gccauaaucggcgcgcaug

SEQ ID NO: 9561 - RNA, 20 nt, Artificial Sequence
  Synthetic
cgccauaaucggcgcgcaug

SEQ ID NO: 9562 - RNA, 21 nt, Artificial Sequence
  Synthetic
ucgccauaaucggcgcgcaug

SEQ ID NO: 9563 - RNA, 22 nt, Artificial Sequence
  Synthetic
cucgccauaaucggcgcgcaug

SEQ ID NO: 9564 - RNA, 23 nt, Artificial Sequence
  Synthetic
ccucgccauaaucggcgcgcaug

SEQ ID NO: 9565 - RNA, 24 nt, Artificial Sequence
  Synthetic
uccucgccauaaucggcgcgcaug

SEQ ID NO: 9566 - RNA, 18 nt, Artificial Sequence
  Synthetic
ucggcuggauccggagau

SEQ ID NO: 9567 - RNA, 19 nt, Artificial Sequence
  Synthetic
gucggcuggauccggagau

SEQ ID NO: 9568 - RNA, 20 nt, Artificial Sequence
  Synthetic
cgucggcuggauccggagau

SEQ ID NO: 9569 - RNA, 21 nt, Artificial Sequence
  Synthetic
ccgucggcuggauccggagau

SEQ ID NO: 9570 - RNA, 22 nt, Artificial Sequence
  Synthetic
uccgucggcuggauccggagau

SEQ ID NO: 9571 - RNA, 23 nt, Artificial Sequence
  Synthetic
guccgucggcuggauccggagau

SEQ ID NO: 9572 - RNA, 24 nt, Artificial Sequence
  Synthetic
gguccgucggcuggauccggagau

SEQ ID NO: 9573 - RNA, 18 nt, Artificial Sequence
  Synthetic
gcgguccgucggcuggau

SEQ ID NO: 9574 - RNA, 19 nt, Artificial Sequence
  Synthetic
ggcgguccgucggcuggau

SEQ ID NO: 9575 - RNA, 20 nt, Artificial Sequence
  Synthetic
cggcgguccgucggcuggau

SEQ ID NO: 9576 - RNA, 21 nt, Artificial Sequence
  Synthetic
gcggcgguccgucggcuggau

SEQ ID NO: 9577 - RNA, 22 nt, Artificial Sequence
  Synthetic
ggcggcgguccgucggcuggau

SEQ ID NO: 9578 - RNA, 23 nt, Artificial Sequence
  Synthetic
gggcggcgguccgucggcuggau

SEQ ID NO: 9579 - RNA, 24 nt, Artificial Sequence
  Synthetic
ugggcggcgguccgucggcuggau

SEQ ID NO: 9580 - RNA, 18 nt, Artificial Sequence
  Synthetic
cuugcgcgccgucgcgcu

SEQ ID NO: 9581 - RNA, 19 nt, Artificial Sequence
  Synthetic
ucuugcgcgccgucgcgcu

SEQ ID NO: 9582 - RNA, 20 nt, Artificial Sequence
  Synthetic
uucuugcgcgccgucgcgcu

SEQ ID NO: 9583 - RNA, 21 nt, Artificial Sequence
  Synthetic
cuucuugcgcgccgucgcgcu

SEQ ID NO: 9584 - RNA, 22 nt, Artificial Sequence
  Synthetic
ucuucuugcgcgccgucgcgcu

SEQ ID NO: 9585 - RNA, 23 nt, Artificial Sequence
  Synthetic
uucuucuugcgcgccgucgcgcu

SEQ ID NO: 9586 - RNA, 24 nt, Artificial Sequence
  Synthetic
cuucuucuugcgcgccgucgcgcu

SEQ ID NO: 9587 - RNA, 18 nt, Artificial Sequence
  Synthetic
ggggggcgacgggaucgu

SEQ ID NO: 9588 - RNA, 19 nt, Artificial Sequence
  Synthetic
gggggggcgacgggaucgu

SEQ ID NO: 9589 - RNA, 20 nt, Artificial Sequence
  Synthetic
ggggggggcgacgggaucgu

SEQ ID NO: 9590 - RNA, 21 nt, Artificial Sequence
  Synthetic
cggggggggcgacgggaucgu

SEQ ID NO: 9591 - RNA, 22 nt, Artificial Sequence
  Synthetic
ccggggggggcgacgggaucgu

SEQ ID NO: 9592 - RNA, 23 nt, Artificial Sequence
  Synthetic
uccggggggggcgacgggaucgu

SEQ ID NO: 9593 - RNA, 24 nt, Artificial Sequence
  Synthetic
cuccggggggggcgacgggaucgu

SEQ ID NO: 9594 - RNA, 18 nt, Artificial Sequence
  Synthetic
cggggcgacgguccgggu

SEQ ID NO: 9595 - RNA, 19 nt, Artificial Sequence
  Synthetic
gcggggcgacgguccgggu

SEQ ID NO: 9596 - RNA, 20 nt, Artificial Sequence
  Synthetic
ggcggggcgacgguccgggu

SEQ ID NO: 9597 - RNA, 21 nt, Artificial Sequence
  Synthetic
cggcggggcgacgguccgggu

SEQ ID NO: 9598 - RNA, 22 nt, Artificial Sequence
  Synthetic
gcggcggggcgacgguccgggu

SEQ ID NO: 9599 - RNA, 23 nt, Artificial Sequence
  Synthetic
cgcggcggggcgacgguccgggu

SEQ ID NO: 9600 - RNA, 24 nt, Artificial Sequence
  Synthetic
gcgcggcggggcgacgguccgggu

SEQ ID NO: 9601 - RNA, 18 nt, Artificial Sequence
  Synthetic
acggugggccggaggaga

SEQ ID NO: 9602 - RNA, 19 nt, Artificial Sequence
  Synthetic
cacggugggccggaggaga

SEQ ID NO: 9603 - RNA, 20 nt, Artificial Sequence
  Synthetic
gcacggugggccggaggaga

SEQ ID NO: 9604 - RNA, 21 nt, Artificial Sequence
  Synthetic
ggcacggugggccggaggaga

SEQ ID NO: 9605 - RNA, 22 nt, Artificial Sequence
  Synthetic
uggcacggugggccggaggaga

SEQ ID NO: 9606 - RNA, 23 nt, Artificial Sequence
  Synthetic
guggcacggugggccggaggaga

SEQ ID NO: 9607 - RNA, 24 nt, Artificial Sequence
  Synthetic
gguggcacggugggccggaggaga

SEQ ID NO: 9608 - RNA, 18 nt, Artificial Sequence
  Synthetic
cgcgauggcggacgagga

SEQ ID NO: 9609 - RNA, 19 nt, Artificial Sequence
  Synthetic
ucgcgauggcggacgagga

SEQ ID NO: 9610 - RNA, 20 nt, Artificial Sequence
  Synthetic
gucgcgauggcggacgagga

SEQ ID NO: 9611 - RNA, 21 nt, Artificial Sequence
  Synthetic
ggucgcgauggcggacgagga

SEQ ID NO: 9612 - RNA, 22 nt, Artificial Sequence
  Synthetic
aggucgcgauggcggacgagga

SEQ ID NO: 9613 - RNA, 23 nt, Artificial Sequence
  Synthetic
gaggucgcgauggcggacgagga

SEQ ID NO: 9614 - RNA, 24 nt, Artificial Sequence
  Synthetic
cgaggucgcgauggcggacgagga

SEQ ID NO: 9615 - RNA, 18 nt, Artificial Sequence
  Synthetic
ccgccgcccaccccgaac

SEQ ID NO: 9616 - RNA, 19 nt, Artificial Sequence
  Synthetic
accgccgcccaccccgaac

SEQ ID NO: 9617 - RNA, 20 nt, Artificial Sequence
  Synthetic
gaccgccgcccaccccgaac

SEQ ID NO: 9618 - RNA, 21 nt, Artificial Sequence
  Synthetic
ggaccgccgcccaccccgaac

SEQ ID NO: 9619 - RNA, 22 nt, Artificial Sequence
  Synthetic
cggaccgccgcccaccccgaac

SEQ ID NO: 9620 - RNA, 23 nt, Artificial Sequence
  Synthetic
acggaccgccgcccaccccgaac

SEQ ID NO: 9621 - RNA, 24 nt, Artificial Sequence
  Synthetic
gacggaccgccgcccaccccgaac

SEQ ID NO: 9622 - RNA, 18 nt, Artificial Sequence
  Synthetic
gcgauggcggacgaggac

SEQ ID NO: 9623 - RNA, 19 nt, Artificial Sequence
  Synthetic
cgcgauggcggacgaggac

SEQ ID NO: 9624 - RNA, 20 nt, Artificial Sequence
  Synthetic
ucgcgauggcggacgaggac

SEQ ID NO: 9625 - RNA, 21 nt, Artificial Sequence
  Synthetic
gucgcgauggcggacgaggac

SEQ ID NO: 9626 - RNA, 22 nt, Artificial Sequence
  Synthetic
ggucgcgauggcggacgaggac

SEQ ID NO: 9627 - RNA, 23 nt, Artificial Sequence
  Synthetic
aggucgcgauggcggacgaggac

SEQ ID NO: 9628 - RNA, 24 nt, Artificial Sequence
  Synthetic
gaggucgcgauggcggacgaggac

SEQ ID NO: 9629 - RNA, 18 nt, Artificial Sequence
  Synthetic
gaggucgcgauggcggac

SEQ ID NO: 9630 - RNA, 19 nt, Artificial Sequence
  Synthetic
cgaggucgcgauggcggac

SEQ ID NO: 9631 - RNA, 20 nt, Artificial Sequence
  Synthetic
ccgaggucgcgauggcggac

SEQ ID NO: 9632 - RNA, 21 nt, Artificial Sequence
  Synthetic
gccgaggucgcgauggcggac

SEQ ID NO: 9633 - RNA, 22 nt, Artificial Sequence
  Synthetic
ggccgaggucgcgauggcggac

SEQ ID NO: 9634 - RNA, 23 nt, Artificial Sequence
  Synthetic
gggccgaggucgcgauggcggac

SEQ ID NO: 9635 - RNA, 24 nt, Artificial Sequence
  Synthetic
ggggccgaggucgcgauggcggac

SEQ ID NO: 9636 - RNA, 18 nt, Artificial Sequence
  Synthetic
gacggaccgccgcccacc

SEQ ID NO: 9637 - RNA, 19 nt, Artificial Sequence
  Synthetic
cgacggaccgccgcccacc

SEQ ID NO: 9638 - RNA, 20 nt, Artificial Sequence
  Synthetic
ccgacggaccgccgcccacc

SEQ ID NO: 9639 - RNA, 21 nt, Artificial Sequence
  Synthetic
gccgacggaccgccgcccacc

SEQ ID NO: 9640 - RNA, 22 nt, Artificial Sequence
  Synthetic
agccgacggaccgccgcccacc

SEQ ID NO: 9641 - RNA, 23 nt, Artificial Sequence
  Synthetic
cagccgacggaccgccgcccacc

SEQ ID NO: 9642 - RNA, 24 nt, Artificial Sequence
  Synthetic
ccagccgacggaccgccgcccacc

SEQ ID NO: 9643 - RNA, 18 nt, Artificial Sequence
  Synthetic
cgaucccgucgccccccc

SEQ ID NO: 9644 - RNA, 19 nt, Artificial Sequence
  Synthetic
acgaucccgucgccccccc

SEQ ID NO: 9645 - RNA, 20 nt, Artificial Sequence
  Synthetic
cacgaucccgucgccccccc

SEQ ID NO: 9646 - RNA, 21 nt, Artificial Sequence
  Synthetic
gcacgaucccgucgccccccc

SEQ ID NO: 9647 - RNA, 22 nt, Artificial Sequence
  Synthetic
cgcacgaucccgucgccccccc

SEQ ID NO: 9648 - RNA, 23 nt, Artificial Sequence
  Synthetic
ucgcacgaucccgucgccccccc

SEQ ID NO: 9649 - RNA, 24 nt, Artificial Sequence
  Synthetic
uucgcacgaucccgucgccccccc

SEQ ID NO: 9650 - RNA, 18 nt, Artificial Sequence
  Synthetic
acgaucccgucgcccccc

SEQ ID NO: 9651 - RNA, 19 nt, Artificial Sequence
  Synthetic
cacgaucccgucgcccccc

SEQ ID NO: 9652 - RNA, 20 nt, Artificial Sequence
  Synthetic
gcacgaucccgucgcccccc

SEQ ID NO: 9653 - RNA, 21 nt, Artificial Sequence
  Synthetic
cgcacgaucccgucgcccccc

SEQ ID NO: 9654 - RNA, 22 nt, Artificial Sequence
  Synthetic
ucgcacgaucccgucgcccccc

SEQ ID NO: 9655 - RNA, 23 nt, Artificial Sequence
  Synthetic
uucgcacgaucccgucgcccccc

SEQ ID NO: 9656 - RNA, 24 nt, Artificial Sequence
  Synthetic
guucgcacgaucccgucgcccccc

SEQ ID NO: 9657 - RNA, 18 nt, Artificial Sequence
  Synthetic
ccgcucgccuucuccgcc

SEQ ID NO: 9658 - RNA, 19 nt, Artificial Sequence
  Synthetic
cccgcucgccuucuccgcc

SEQ ID NO: 9659 - RNA, 20 nt, Artificial Sequence
  Synthetic
gcccgcucgccuucuccgcc

SEQ ID NO: 9660 - RNA, 21 nt, Artificial Sequence
  Synthetic
ggcccgcucgccuucuccgcc

SEQ ID NO: 9661 - RNA, 22 nt, Artificial Sequence
  Synthetic
cggcccgcucgccuucuccgcc

SEQ ID NO: 9662 - RNA, 23 nt, Artificial Sequence
  Synthetic
gcggcccgcucgccuucuccgcc

SEQ ID NO: 9663 - RNA, 24 nt, Artificial Sequence
  Synthetic
agcggcccgcucgccuucuccgcc

SEQ ID NO: 9664 - RNA, 18 nt, Artificial Sequence
  Synthetic
cgacgacgacgcagggcc

SEQ ID NO: 9665 - RNA, 19 nt, Artificial Sequence
  Synthetic
acgacgacgacgcagggcc

SEQ ID NO: 9666 - RNA, 20 nt, Artificial Sequence
  Synthetic
gacgacgacgacgcagggcc

SEQ ID NO: 9667 - RNA, 21 nt, Artificial Sequence
  Synthetic
cgacgacgacgacgcagggcc

SEQ ID NO: 9668 - RNA, 22 nt, Artificial Sequence
  Synthetic
acgacgacgacgacgcagggcc

SEQ ID NO: 9669 - RNA, 23 nt, Artificial Sequence
  Synthetic
gacgacgacgacgacgcagggcc

SEQ ID NO: 9670 - RNA, 24 nt, Artificial Sequence
  Synthetic
agacgacgacgacgacgcagggcc

SEQ ID NO: 9671 - RNA, 18 nt, Artificial Sequence
  Synthetic
gccgucgacgagccugcc

SEQ ID NO: 9672 - RNA, 19 nt, Artificial Sequence
  Synthetic
ggccgucgacgagccugcc

SEQ ID NO: 9673 - RNA, 20 nt, Artificial Sequence
  Synthetic
aggccgucgacgagccugcc

SEQ ID NO: 9674 - RNA, 21 nt, Artificial Sequence
  Synthetic
gaggccgucgacgagccugcc

SEQ ID NO: 9675 - RNA, 22 nt, Artificial Sequence
  Synthetic
ggaggccgucgacgagccugcc

SEQ ID NO: 9676 - RNA, 23 nt, Artificial Sequence
  Synthetic
gggaggccgucgacgagccugcc

SEQ ID NO: 9677 - RNA, 24 nt, Artificial Sequence
  Synthetic
ggggaggccgucgacgagccugcc

SEQ ID NO: 9678 - RNA, 18 nt, Artificial Sequence
  Synthetic
gaggcggccccggcgucc

SEQ ID NO: 9679 - RNA, 19 nt, Artificial Sequence
  Synthetic
cgaggcggccccggcgucc

SEQ ID NO: 9680 - RNA, 20 nt, Artificial Sequence
  Synthetic
acgaggcggccccggcgucc

SEQ ID NO: 9681 - RNA, 21 nt, Artificial Sequence
  Synthetic
gacgaggcggccccggcgucc

SEQ ID NO: 9682 - RNA, 22 nt, Artificial Sequence
  Synthetic
cgacgaggcggccccggcgucc

SEQ ID NO: 9683 - RNA, 23 nt, Artificial Sequence
  Synthetic
ccgacgaggcggccccggcgucc

SEQ ID NO: 9684 - RNA, 24 nt, Artificial Sequence
  Synthetic
gccgacgaggcggccccggcgucc

SEQ ID NO: 9685 - RNA, 18 nt, Artificial Sequence
  Synthetic
cggagcgcgacggcgcgc

SEQ ID NO: 9686 - RNA, 19 nt, Artificial Sequence
  Synthetic
ccggagcgcgacggcgcgc

SEQ ID NO: 9687 - RNA, 20 nt, Artificial Sequence
  Synthetic
cccggagcgcgacggcgcgc

SEQ ID NO: 9688 - RNA, 21 nt, Artificial Sequence
  Synthetic
ccccggagcgcgacggcgcgc

SEQ ID NO: 9689 - RNA, 22 nt, Artificial Sequence
  Synthetic
cccccggagcgcgacggcgcgc

SEQ ID NO: 9690 - RNA, 23 nt, Artificial Sequence
  Synthetic
ccccccggagcgcgacggcgcgc

SEQ ID NO: 9691 - RNA, 24 nt, Artificial Sequence
  Synthetic
cccccccggagcgcgacggcgcgc

SEQ ID NO: 9692 - RNA, 18 nt, Artificial Sequence
  Synthetic
ucggguggcacggugggc

SEQ ID NO: 9693 - RNA, 19 nt, Artificial Sequence
  Synthetic
uucggguggcacggugggc

SEQ ID NO: 9694 - RNA, 20 nt, Artificial Sequence
  Synthetic
guucggguggcacggugggc

SEQ ID NO: 9695 - RNA, 21 nt, Artificial Sequence
  Synthetic
gguucggguggcacggugggc

SEQ ID NO: 9696 - RNA, 22 nt, Artificial Sequence
  Synthetic
ggguucggguggcacggugggc

SEQ ID NO: 9697 - RNA, 23 nt, Artificial Sequence
  Synthetic
cggguucggguggcacggugggc

SEQ ID NO: 9698 - RNA, 24 nt, Artificial Sequence
  Synthetic
ccggguucggguggcacggugggc

SEQ ID NO: 9699 - RNA, 18 nt, Artificial Sequence
  Synthetic
augcgcgccgauuauggc

SEQ ID NO: 9700 - RNA, 19 nt, Artificial Sequence
  Synthetic
caugcgcgccgauuauggc

SEQ ID NO: 9701 - RNA, 20 nt, Artificial Sequence
  Synthetic
ccaugcgcgccgauuauggc

SEQ ID NO: 9702 - RNA, 21 nt, Artificial Sequence
  Synthetic
uccaugcgcgccgauuauggc

SEQ ID NO: 9703 - RNA, 22 nt, Artificial Sequence
  Synthetic
cuccaugcgcgccgauuauggc

SEQ ID NO: 9704 - RNA, 23 nt, Artificial Sequence
  Synthetic
ccuccaugcgcgccgauuauggc

SEQ ID NO: 9705 - RNA, 24 nt, Artificial Sequence
  Synthetic
cccuccaugcgcgccgauuauggc

SEQ ID NO: 9706 - RNA, 18 nt, Artificial Sequence
  Synthetic
cgaggcggccccggcguc

SEQ ID NO: 9707 - RNA, 19 nt, Artificial Sequence
  Synthetic
acgaggcggccccggcguc

SEQ ID NO: 9708 - RNA, 20 nt, Artificial Sequence
  Synthetic
gacgaggcggccccggcguc

SEQ ID NO: 9709 - RNA, 21 nt, Artificial Sequence
  Synthetic
cgacgaggcggccccggcguc

SEQ ID NO: 9710 - RNA, 22 nt, Artificial Sequence
  Synthetic
ccgacgaggcggccccggcguc

SEQ ID NO: 9711 - RNA, 23 nt, Artificial Sequence
  Synthetic
gccgacgaggcggccccggcguc

SEQ ID NO: 9712 - RNA, 24 nt, Artificial Sequence
  Synthetic
ugccgacgaggcggccccggcguc

SEQ ID NO: 9713 - RNA, 18 nt, Artificial Sequence
  Synthetic
agcgcgacggcgcgcaag

SEQ ID NO: 9714 - RNA, 19 nt, Artificial Sequence
  Synthetic
gagcgcgacggcgcgcaag

SEQ ID NO: 9715 - RNA, 20 nt, Artificial Sequence
  Synthetic
ggagcgcgacggcgcgcaag

SEQ ID NO: 9716 - RNA, 21 nt, Artificial Sequence
  Synthetic
cggagcgcgacggcgcgcaag

SEQ ID NO: 9717 - RNA, 22 nt, Artificial Sequence
  Synthetic
ccggagcgcgacggcgcgcaag

SEQ ID NO: 9718 - RNA, 23 nt, Artificial Sequence
  Synthetic
cccggagcgcgacggcgcgcaag

SEQ ID NO: 9719 - RNA, 24 nt, Artificial Sequence
  Synthetic
ccccggagcgcgacggcgcgcaag

SEQ ID NO: 9720 - RNA, 18 nt, Artificial Sequence
  Synthetic
gcggagcagcggaagaag

SEQ ID NO: 9721 - RNA, 19 nt, Artificial Sequence
  Synthetic
ggcggagcagcggaagaag

SEQ ID NO: 9722 - RNA, 20 nt, Artificial Sequence
  Synthetic
cggcggagcagcggaagaag

SEQ ID NO: 9723 - RNA, 21 nt, Artificial Sequence
  Synthetic
ucggcggagcagcggaagaag

SEQ ID NO: 9724 - RNA, 22 nt, Artificial Sequence
  Synthetic
gucggcggagcagcggaagaag

SEQ ID NO: 9725 - RNA, 23 nt, Artificial Sequence
  Synthetic
ugucggcggagcagcggaagaag

SEQ ID NO: 9726 - RNA, 24 nt, Artificial Sequence
  Synthetic
augucggcggagcagcggaagaag

SEQ ID NO: 9727 - RNA, 18 nt, Artificial Sequence
  Synthetic
ggccggaggagaacgaag

SEQ ID NO: 9728 - RNA, 19 nt, Artificial Sequence
  Synthetic
gggccggaggagaacgaag

SEQ ID NO: 9729 - RNA, 20 nt, Artificial Sequence
  Synthetic
ugggccggaggagaacgaag

SEQ ID NO: 9730 - RNA, 21 nt, Artificial Sequence
  Synthetic
gugggccggaggagaacgaag

SEQ ID NO: 9731 - RNA, 22 nt, Artificial Sequence
  Synthetic
ggugggccggaggagaacgaag

SEQ ID NO: 9732 - RNA, 23 nt, Artificial Sequence
  Synthetic
cggugggccggaggagaacgaag

SEQ ID NO: 9733 - RNA, 24 nt, Artificial Sequence
  Synthetic
acggugggccggaggagaacgaag

SEQ ID NO: 9734 - RNA, 18 nt, Artificial Sequence
  Synthetic
ucggcggagcagcggaag

SEQ ID NO: 9735 - RNA, 19 nt, Artificial Sequence
  Synthetic
gucggcggagcagcggaag

SEQ ID NO: 9736 - RNA, 20 nt, Artificial Sequence
  Synthetic
ugucggcggagcagcggaag

SEQ ID NO: 9737 - RNA, 18 nt, Artificial Sequence
  Synthetic
cgcgccgauuauggcgag

SEQ ID NO: 9738 - RNA, 19 nt, Artificial Sequence
  Synthetic
gcgcgccgauuauggcgag

SEQ ID NO: 9739 - RNA, 20 nt, Artificial Sequence
  Synthetic
ugcgcgccgauuauggcgag

SEQ ID NO: 9740 - RNA, 21 nt, Artificial Sequence
  Synthetic
augcgcgccgauuauggcgag

SEQ ID NO: 9741 - RNA, 22 nt, Artificial Sequence
  Synthetic
caugcgcgccgauuauggcgag

SEQ ID NO: 9742 - RNA, 23 nt, Artificial Sequence
  Synthetic
ccaugcgcgccgauuauggcgag

SEQ ID NO: 9743 - RNA, 24 nt, Artificial Sequence
  Synthetic
uccaugcgcgccgauuauggcgag

SEQ ID NO: 9744 - RNA, 18 nt, Artificial Sequence
  Synthetic
uggcacggugggccggag

SEQ ID NO: 9745 - RNA, 19 nt, Artificial Sequence
  Synthetic
guggcacggugggccggag

SEQ ID NO: 9746 - RNA, 20 nt, Artificial Sequence
  Synthetic
gguggcacggugggccggag

SEQ ID NO: 9747 - RNA, 21 nt, Artificial Sequence
  Synthetic
ggguggcacggugggccggag

SEQ ID NO: 9748 - RNA, 22 nt, Artificial Sequence
  Synthetic
cggguggcacggugggccggag

SEQ ID NO: 9749 - RNA, 23 nt, Artificial Sequence
  Synthetic
ucggguggcacggugggccggag

SEQ ID NO: 9750 - RNA, 24 nt, Artificial Sequence
  Synthetic
uucggguggcacggugggccggag

SEQ ID NO: 9751 - RNA, 18 nt, Artificial Sequence
  Synthetic
ccggguucggguggcacg

SEQ ID NO: 9752 - RNA, 19 nt, Artificial Sequence
  Synthetic
cccggguucggguggcacg

SEQ ID NO: 9753 - RNA, 20 nt, Artificial Sequence
  Synthetic
gcccggguucggguggcacg

SEQ ID NO: 9754 - RNA, 21 nt, Artificial Sequence
  Synthetic
ggcccggguucggguggcacg

SEQ ID NO: 9755 - RNA, 22 nt, Artificial Sequence
  Synthetic
cggcccggguucggguggcacg

SEQ ID NO: 9756 - RNA, 23 nt, Artificial Sequence
  Synthetic
gcggcccggguucggguggcacg

SEQ ID NO: 9757 - RNA, 24 nt, Artificial Sequence
  Synthetic
cgcggcccggguucggguggcacg

SEQ ID NO: 9758 - RNA, 18 nt, Artificial Sequence
  Synthetic
aagacgacgacgacgacg

SEQ ID NO: 9759 - RNA, 19 nt, Artificial Sequence
  Synthetic
gaagacgacgacgacgacg

SEQ ID NO: 9760 - RNA, 20 nt, Artificial Sequence
  Synthetic
agaagacgacgacgacgacg

SEQ ID NO: 9761 - RNA, 21 nt, Artificial Sequence
  Synthetic
aagaagacgacgacgacgacg

SEQ ID NO: 9762 - RNA, 22 nt, Artificial Sequence
  Synthetic
gaagaagacgacgacgacgacg

SEQ ID NO: 9763 - RNA, 23 nt, Artificial Sequence
  Synthetic
agaagaagacgacgacgacgacg

SEQ ID NO: 9764 - RNA, 24 nt, Artificial Sequence
  Synthetic
aagaagaagacgacgacgacgacg

SEQ ID NO: 9765 - RNA, 18 nt, Artificial Sequence
  Synthetic
cgauggcggacgaggacg

SEQ ID NO: 9766 - RNA, 19 nt, Artificial Sequence
  Synthetic
gcgauggcggacgaggacg

SEQ ID NO: 9767 - RNA, 20 nt, Artificial Sequence
  Synthetic
cgcgauggcggacgaggacg

SEQ ID NO: 9768 - RNA, 21 nt, Artificial Sequence
  Synthetic
ucgcgauggcggacgaggacg

SEQ ID NO: 9769 - RNA, 22 nt, Artificial Sequence
  Synthetic
gucgcgauggcggacgaggacg

SEQ ID NO: 9770 - RNA, 23 nt, Artificial Sequence
  Synthetic
ggucgcgauggcggacgaggacg

SEQ ID NO: 9771 - RNA, 24 nt, Artificial Sequence
  Synthetic
aggucgcgauggcggacgaggacg

SEQ ID NO: 9772 - RNA, 18 nt, Artificial Sequence
  Synthetic
gaucuccggauccagccg

SEQ ID NO: 9773 - RNA, 19 nt, Artificial Sequence
  Synthetic
ggaucuccggauccagccg

SEQ ID NO: 9774 - RNA, 20 nt, Artificial Sequence
  Synthetic
cggaucuccggauccagccg

SEQ ID NO: 9775 - RNA, 21 nt, Artificial Sequence
  Synthetic
ccggaucuccggauccagccg

SEQ ID NO: 9776 - RNA, 22 nt, Artificial Sequence
  Synthetic
cccggaucuccggauccagccg

SEQ ID NO: 9777 - RNA, 23 nt, Artificial Sequence
  Synthetic
ccccggaucuccggauccagccg

SEQ ID NO: 9778 - RNA, 24 nt, Artificial Sequence
  Synthetic
gccccggaucuccggauccagccg

SEQ ID NO: 9779 - RNA, 18 nt, Artificial Sequence
  Synthetic
gacgacgacgcagggccg

SEQ ID NO: 9780 - RNA, 19 nt, Artificial Sequence
  Synthetic
cgacgacgacgcagggccg

SEQ ID NO: 9781 - RNA, 20 nt, Artificial Sequence
  Synthetic
acgacgacgacgcagggccg

SEQ ID NO: 9782 - RNA, 21 nt, Artificial Sequence
  Synthetic
gacgacgacgacgcagggccg

SEQ ID NO: 9783 - RNA, 22 nt, Artificial Sequence
  Synthetic
cgacgacgacgacgcagggccg

SEQ ID NO: 9784 - RNA, 23 nt, Artificial Sequence
  Synthetic
acgacgacgacgacgcagggccg

SEQ ID NO: 9785 - RNA, 24 nt, Artificial Sequence
  Synthetic
gacgacgacgacgacgcagggccg

SEQ ID NO: 9786 - RNA, 18 nt, Artificial Sequence
  Synthetic
ggguggcacggugggccg

SEQ ID NO: 9787 - RNA, 19 nt, Artificial Sequence
  Synthetic
cggguggcacggugggccg

SEQ ID NO: 9788 - RNA, 20 nt, Artificial Sequence
  Synthetic
ucggguggcacggugggccg

SEQ ID NO: 9789 - RNA, 21 nt, Artificial Sequence
  Synthetic
uucggguggcacggugggccg

SEQ ID NO: 9790 - RNA, 22 nt, Artificial Sequence
  Synthetic
guucggguggcacggugggccg

SEQ ID NO: 9791 - RNA, 23 nt, Artificial Sequence
  Synthetic
gguucggguggcacggugggccg

SEQ ID NO: 9792 - RNA, 24 nt, Artificial Sequence
  Synthetic
ggguucggguggcacggugggccg

SEQ ID NO: 9793 - RNA, 18 nt, Artificial Sequence
  Synthetic
ccgccgaugccgaugccg

SEQ ID NO: 9794 - RNA, 19 nt, Artificial Sequence
  Synthetic
gccgccgaugccgaugccg

SEQ ID NO: 9795 - RNA, 20 nt, Artificial Sequence
  Synthetic
cgccgccgaugccgaugccg

SEQ ID NO: 9796 - RNA, 21 nt, Artificial Sequence
  Synthetic
ccgccgccgaugccgaugccg

SEQ ID NO: 9797 - RNA, 22 nt, Artificial Sequence
  Synthetic
gccgccgccgaugccgaugccg

SEQ ID NO: 9798 - RNA, 23 nt, Artificial Sequence
  Synthetic
cgccgccgccgaugccgaugccg

SEQ ID NO: 9799 - RNA, 24 nt, Artificial Sequence
  Synthetic
acgccgccgccgaugccgaugccg

SEQ ID NO: 9800 - RNA, 18 nt, Artificial Sequence
  Synthetic
aggcggccccggcguccg

SEQ ID NO: 9801 - RNA, 19 nt, Artificial Sequence
  Synthetic
gaggcggccccggcguccg

SEQ ID NO: 9802 - RNA, 20 nt, Artificial Sequence
  Synthetic
cgaggcggccccggcguccg

SEQ ID NO: 9803 - RNA, 21 nt, Artificial Sequence
  Synthetic
acgaggcggccccggcguccg

SEQ ID NO: 9804 - RNA, 22 nt, Artificial Sequence
  Synthetic
gacgaggcggccccggcguccg

SEQ ID NO: 9805 - RNA, 23 nt, Artificial Sequence
  Synthetic
cgacgaggcggccccggcguccg

SEQ ID NO: 9806 - RNA, 24 nt, Artificial Sequence
  Synthetic
ccgacgaggcggccccggcguccg

SEQ ID NO: 9807 - RNA, 18 nt, Artificial Sequence
  Synthetic
ggacgucuccgggccgcg

SEQ ID NO: 9808 - RNA, 19 nt, Artificial Sequence
  Synthetic
gggacgucuccgggccgcg

SEQ ID NO: 9809 - RNA, 20 nt, Artificial Sequence
  Synthetic
ggggacgucuccgggccgcg

SEQ ID NO: 9810 - RNA, 21 nt, Artificial Sequence
  Synthetic
gggggacgucuccgggccgcg

SEQ ID NO: 9811 - RNA, 22 nt, Artificial Sequence
  Synthetic
cgggggacgucuccgggccgcg

SEQ ID NO: 9812 - RNA, 23 nt, Artificial Sequence
  Synthetic
acgggggacgucuccgggccgcg

SEQ ID NO: 9813 - RNA, 24 nt, Artificial Sequence
  Synthetic
gacgggggacgucuccgggccgcg

SEQ ID NO: 9814 - RNA, 18 nt, Artificial Sequence
  Synthetic
ugcgcgccgauuauggcg

SEQ ID NO: 9815 - RNA, 19 nt, Artificial Sequence
  Synthetic
augcgcgccgauuauggcg

SEQ ID NO: 9816 - RNA, 20 nt, Artificial Sequence
  Synthetic
caugcgcgccgauuauggcg

SEQ ID NO: 9817 - RNA, 21 nt, Artificial Sequence
  Synthetic
ccaugcgcgccgauuauggcg

SEQ ID NO: 9818 - RNA, 22 nt, Artificial Sequence
  Synthetic
uccaugcgcgccgauuauggcg

SEQ ID NO: 9819 - RNA, 23 nt, Artificial Sequence
  Synthetic
cuccaugcgcgccgauuauggcg

SEQ ID NO: 9820 - RNA, 24 nt, Artificial Sequence
  Synthetic
ccuccaugcgcgccgauuauggcg

SEQ ID NO: 9821 - RNA, 18 nt, Artificial Sequence
  Synthetic
cguccggggaggccgucg

SEQ ID NO: 9822 - RNA, 19 nt, Artificial Sequence
  Synthetic
gcguccggggaggccgucg

SEQ ID NO: 9823 - RNA, 20 nt, Artificial Sequence
  Synthetic
ggcguccggggaggccgucg

SEQ ID NO: 9824 - RNA, 21 nt, Artificial Sequence
  Synthetic
cggcguccggggaggccgucg

SEQ ID NO: 9825 - RNA, 22 nt, Artificial Sequence
  Synthetic
ccggcguccggggaggccgucg

SEQ ID NO: 9826 - RNA, 23 nt, Artificial Sequence
  Synthetic
cccggcguccggggaggccgucg

SEQ ID NO: 9827 - RNA, 24 nt, Artificial Sequence
  Synthetic
ccccggcguccggggaggccgucg

SEQ ID NO: 9828 - RNA, 18 nt, Artificial Sequence
  Synthetic
ucgcgauggcggacgagg

SEQ ID NO: 9829 - RNA, 19 nt, Artificial Sequence
  Synthetic
gucgcgauggcggacgagg

SEQ ID NO: 9830 - RNA, 20 nt, Artificial Sequence
  Synthetic
ggucgcgauggcggacgagg

SEQ ID NO: 9831 - RNA, 21 nt, Artificial Sequence
  Synthetic
aggucgcgauggcggacgagg

SEQ ID NO: 9832 - RNA, 22 nt, Artificial Sequence
  Synthetic
gaggucgcgauggcggacgagg

SEQ ID NO: 9833 - RNA, 23 nt, Artificial Sequence
  Synthetic
cgaggucgcgauggcggacgagg

SEQ ID NO: 9834 - RNA, 24 nt, Artificial Sequence
  Synthetic
ccgaggucgcgauggcggacgagg

SEQ ID NO: 9835 - RNA, 18 nt, Artificial Sequence
  Synthetic
gguggcacggugggccgg

SEQ ID NO: 9836 - RNA, 19 nt, Artificial Sequence
  Synthetic
ggguggcacggugggccgg

SEQ ID NO: 9837 - RNA, 20 nt, Artificial Sequence
  Synthetic
cggguggcacggugggccgg

SEQ ID NO: 9838 - RNA, 21 nt, Artificial Sequence
  Synthetic
ucggguggcacggugggccgg

SEQ ID NO: 9839 - RNA, 22 nt, Artificial Sequence
  Synthetic
uucggguggcacggugggccgg

SEQ ID NO: 9840 - RNA, 23 nt, Artificial Sequence
  Synthetic
guucggguggcacggugggccgg

SEQ ID NO: 9841 - RNA, 24 nt, Artificial Sequence
  Synthetic
gguucggguggcacggugggccgg

SEQ ID NO: 9842 - RNA, 18 nt, Artificial Sequence
  Synthetic
gacgucuccgggccgcgg

SEQ ID NO: 9843 - RNA, 19 nt, Artificial Sequence
  Synthetic
ggacgucuccgggccgcgg

SEQ ID NO: 9844 - RNA, 20 nt, Artificial Sequence
  Synthetic
gggacgucuccgggccgcgg

SEQ ID NO: 9845 - RNA, 21 nt, Artificial Sequence
  Synthetic
ggggacgucuccgggccgcgg

SEQ ID NO: 9846 - RNA, 22 nt, Artificial Sequence
  Synthetic
gggggacgucuccgggccgcgg

SEQ ID NO: 9847 - RNA, 23 nt, Artificial Sequence
  Synthetic
cgggggacgucuccgggccgcgg

SEQ ID NO: 9848 - RNA, 24 nt, Artificial Sequence
  Synthetic
acgggggacgucuccgggccgcgg

SEQ ID NO: 9849 - RNA, 18 nt, Artificial Sequence
  Synthetic
ccgaggucgcgauggcgg

SEQ ID NO: 9850 - RNA, 19 nt, Artificial Sequence
  Synthetic
gccgaggucgcgauggcgg

SEQ ID NO: 9851 - RNA, 20 nt, Artificial Sequence
  Synthetic
ggccgaggucgcgauggcgg

SEQ ID NO: 9852 - RNA, 21 nt, Artificial Sequence
  Synthetic
gggccgaggucgcgauggcgg

SEQ ID NO: 9853 - RNA, 22 nt, Artificial Sequence
  Synthetic
ggggccgaggucgcgauggcgg

SEQ ID NO: 9854 - RNA, 23 nt, Artificial Sequence
  Synthetic
cggggccgaggucgcgauggcgg

SEQ ID NO: 9855 - RNA, 24 nt, Artificial Sequence
  Synthetic
gcggggccgaggucgcgauggcgg

SEQ ID NO: 9856 - RNA, 18 nt, Artificial Sequence
  Synthetic
cgacgcagggccgcgggg

SEQ ID NO: 9857 - RNA, 19 nt, Artificial Sequence
  Synthetic
acgacgcagggccgcgggg

SEQ ID NO: 9858 - RNA, 20 nt, Artificial Sequence
  Synthetic
gacgacgcagggccgcgggg

SEQ ID NO: 9859 - RNA, 21 nt, Artificial Sequence
  Synthetic
cgacgacgcagggccgcgggg

SEQ ID NO: 9860 - RNA, 22 nt, Artificial Sequence
  Synthetic
acgacgacgcagggccgcgggg

SEQ ID NO: 9861 - RNA, 23 nt, Artificial Sequence
  Synthetic
gacgacgacgcagggccgcgggg

SEQ ID NO: 9862 - RNA, 24 nt, Artificial Sequence
  Synthetic
cgacgacgacgcagggccgcgggg

SEQ ID NO: 9863 - RNA, 18 nt, Artificial Sequence
  Synthetic
uucggguggcacgguggg

SEQ ID NO: 9864 - RNA, 19 nt, Artificial Sequence
  Synthetic
guucggguggcacgguggg

SEQ ID NO: 9865 - RNA, 20 nt, Artificial Sequence
  Synthetic
gguucggguggcacgguggg

SEQ ID NO: 9866 - RNA, 21 nt, Artificial Sequence
  Synthetic
ggguucggguggcacgguggg

SEQ ID NO: 9867 - RNA, 22 nt, Artificial Sequence
  Synthetic
cggguucggguggcacgguggg

SEQ ID NO: 9868 - RNA, 23 nt, Artificial Sequence
  Synthetic
ccggguucggguggcacgguggg

SEQ ID NO: 9869 - RNA, 24 nt, Artificial Sequence
  Synthetic
cccggguucggguggcacgguggg

SEQ ID NO: 9870 - RNA, 18 nt, Artificial Sequence
  Synthetic
ugcuggccucgauggugg

SEQ ID NO: 9871 - RNA, 19 nt, Artificial Sequence
  Synthetic
cugcuggccucgauggugg

SEQ ID NO: 9872 - RNA, 20 nt, Artificial Sequence
  Synthetic
ccugcuggccucgauggugg

SEQ ID NO: 9873 - RNA, 21 nt, Artificial Sequence
  Synthetic
cccugcuggccucgauggugg

SEQ ID NO: 9874 - RNA, 22 nt, Artificial Sequence
  Synthetic
gcccugcuggccucgauggugg

SEQ ID NO: 9875 - RNA, 23 nt, Artificial Sequence
  Synthetic
ggcccugcuggccucgauggugg

SEQ ID NO: 9876 - RNA, 24 nt, Artificial Sequence
  Synthetic
uggcccugcuggccucgauggugg

SEQ ID NO: 9877 - RNA, 18 nt, Artificial Sequence
  Synthetic
ggggccgaggucgcgaug

SEQ ID NO: 9878 - RNA, 19 nt, Artificial Sequence
  Synthetic
cggggccgaggucgcgaug

SEQ ID NO: 9879 - RNA, 20 nt, Artificial Sequence
  Synthetic
gcggggccgaggucgcgaug

SEQ ID NO: 9880 - RNA, 21 nt, Artificial Sequence
  Synthetic
cgcggggccgaggucgcgaug

SEQ ID NO: 9881 - RNA, 22 nt, Artificial Sequence
  Synthetic
ccgcggggccgaggucgcgaug

SEQ ID NO: 9882 - RNA, 23 nt, Artificial Sequence
  Synthetic
gccgcggggccgaggucgcgaug

SEQ ID NO: 9883 - RNA, 24 nt, Artificial Sequence
  Synthetic
ggccgcggggccgaggucgcgaug

SEQ ID NO: 9884 - RNA, 18 nt, Artificial Sequence
  Synthetic
gcccugcuggccucgaug

SEQ ID NO: 9885 - RNA, 19 nt, Artificial Sequence
  Synthetic
ggcccugcuggccucgaug

SEQ ID NO: 9886 - RNA, 20 nt, Artificial Sequence
  Synthetic
uggcccugcuggccucgaug

SEQ ID NO: 9887 - RNA, 21 nt, Artificial Sequence
  Synthetic
cuggcccugcuggccucgaug

SEQ ID NO: 9888 - RNA, 22 nt, Artificial Sequence
  Synthetic
gcuggcccugcuggccucgaug

SEQ ID NO: 9889 - RNA, 23 nt, Artificial Sequence
  Synthetic
agcuggcccugcuggccucgaug

SEQ ID NO: 9890 - RNA, 24 nt, Artificial Sequence
  Synthetic
cagcuggcccugcuggccucgaug

SEQ ID NO: 9891 - RNA, 18 nt, Artificial Sequence
  Synthetic
ccaugcgcgccgauuaug

SEQ ID NO: 9892 - RNA, 19 nt, Artificial Sequence
  Synthetic
uccaugcgcgccgauuaug

SEQ ID NO: 9893 - RNA, 20 nt, Artificial Sequence
  Synthetic
cuccaugcgcgccgauuaug

SEQ ID NO: 9894 - RNA, 21 nt, Artificial Sequence
  Synthetic
ccuccaugcgcgccgauuaug

SEQ ID NO: 9895 - RNA, 22 nt, Artificial Sequence
  Synthetic
cccuccaugcgcgccgauuaug

SEQ ID NO: 9896 - RNA, 23 nt, Artificial Sequence
  Synthetic
ccccuccaugcgcgccgauuaug

SEQ ID NO: 9897 - RNA, 24 nt, Artificial Sequence
  Synthetic
cccccuccaugcgcgccgauuaug

SEQ ID NO: 9898 - RNA, 18 nt, Artificial Sequence
  Synthetic
cgaggacgggggacgucu

SEQ ID NO: 9899 - RNA, 19 nt, Artificial Sequence
  Synthetic
acgaggacgggggacgucu

SEQ ID NO: 9900 - RNA, 20 nt, Artificial Sequence
  Synthetic
gacgaggacgggggacgucu

SEQ ID NO: 9901 - RNA, 21 nt, Artificial Sequence
  Synthetic
ggacgaggacgggggacgucu

SEQ ID NO: 9902 - RNA, 22 nt, Artificial Sequence
  Synthetic
cggacgaggacgggggacgucu

SEQ ID NO: 9903 - RNA, 23 nt, Artificial Sequence
  Synthetic
gcggacgaggacgggggacgucu

SEQ ID NO: 9904 - RNA, 24 nt, Artificial Sequence
  Synthetic
ggcggacgaggacgggggacgucu

SEQ ID NO: 9905 - RNA, 18 nt, Artificial Sequence
  Synthetic
acgaggcggccccggcgu

SEQ ID NO: 9906 - RNA, 19 nt, Artificial Sequence
  Synthetic
gacgaggcggccccggcgu

SEQ ID NO: 9907 - RNA, 20 nt, Artificial Sequence
  Synthetic
cgacgaggcggccccggcgu

SEQ ID NO: 9908 - RNA, 21 nt, Artificial Sequence
  Synthetic
ccgacgaggcggccccggcgu

SEQ ID NO: 9909 - RNA, 22 nt, Artificial Sequence
  Synthetic
gccgacgaggcggccccggcgu

SEQ ID NO: 9910 - RNA, 23 nt, Artificial Sequence
  Synthetic
ugccgacgaggcggccccggcgu

SEQ ID NO: 9911 - RNA, 24 nt, Artificial Sequence
  Synthetic
augccgacgaggcggccccggcgu

SEQ ID NO: 9912 - RNA, 18 nt, Artificial Sequence
  Synthetic
gcggcgacaggcuggcca

SEQ ID NO: 9913 - RNA, 21 nt, Artificial Sequence
  Synthetic
gucgcggcgacaggcuggcca

SEQ ID NO: 9914 - RNA, 22 nt, Artificial Sequence
  Synthetic
ggucgcggcgacaggcuggcca

SEQ ID NO: 9915 - RNA, 23 nt, Artificial Sequence
  Synthetic
gggucgcggcgacaggcuggcca

SEQ ID NO: 9916 - RNA, 24 nt, Artificial Sequence
  Synthetic
ggggucgcggcgacaggcuggcca

SEQ ID NO: 9917 - RNA, 18 nt, Artificial Sequence
  Synthetic
gccacggcgcggggaaga

SEQ ID NO: 9918 - RNA, 20 nt, Artificial Sequence
  Synthetic
gcgccacggcgcggggaaga

SEQ ID NO: 9919 - RNA, 21 nt, Artificial Sequence
  Synthetic
ggcgccacggcgcggggaaga

SEQ ID NO: 9920 - RNA, 22 nt, Artificial Sequence
  Synthetic
gggcgccacggcgcggggaaga

SEQ ID NO: 9921 - RNA, 19 nt, Artificial Sequence
  Synthetic
gcggaggcgggcgcggcga

SEQ ID NO: 9922 - RNA, 21 nt, Artificial Sequence
  Synthetic
gcgcggaggcgggcgcggcga

SEQ ID NO: 9923 - RNA, 22 nt, Artificial Sequence
  Synthetic
ggcgcggaggcgggcgcggcga

SEQ ID NO: 9924 - RNA, 24 nt, Artificial Sequence
  Synthetic
gcggcgcggaggcgggcgcggcga

SEQ ID NO: 9925 - RNA, 18 nt, Artificial Sequence
  Synthetic
gcccggcagcggcgagua

SEQ ID NO: 9926 - RNA, 24 nt, Artificial Sequence
  Synthetic
guccucgcccggcagcggcgagua

SEQ ID NO: 9927 - RNA, 18 nt, Artificial Sequence
  Synthetic
gcggaggacgccgacgac

SEQ ID NO: 9928 - RNA, 19 nt, Artificial Sequence
  Synthetic
ggcggaggacgccgacgac

SEQ ID NO: 9929 - RNA, 21 nt, Artificial Sequence
  Synthetic
gaggcggaggacgccgacgac

SEQ ID NO: 9930 - RNA, 22 nt, Artificial Sequence
  Synthetic
ggaggcggaggacgccgacgac

SEQ ID NO: 9931 - RNA, 24 nt, Artificial Sequence
  Synthetic
gaggaggcggaggacgccgacgac

SEQ ID NO: 9932 - RNA, 20 nt, Artificial Sequence
  Synthetic
gccuccucgucguccgcgcc

SEQ ID NO: 9933 - RNA, 19 nt, Artificial Sequence
  Synthetic
guggugucggcggggcgcc

SEQ ID NO: 9934 - RNA, 20 nt, Artificial Sequence
  Synthetic
gguggugucggcggggcgcc

SEQ ID NO: 9935 - RNA, 22 nt, Artificial Sequence
  Synthetic
gugguggugucggcggggcgcc

SEQ ID NO: 9936 - RNA, 23 nt, Artificial Sequence
  Synthetic
ggugguggugucggcggggcgcc

SEQ ID NO: 9937 - RNA, 22 nt, Artificial Sequence
  Synthetic
gccacguccccgggcgccacgc

SEQ ID NO: 9938 - RNA, 24 nt, Artificial Sequence
  Synthetic
gcgccacguccccgggcgccacgc

SEQ ID NO: 9939 - RNA, 18 nt, Artificial Sequence
  Synthetic
gcggcccgcggucgccgc

SEQ ID NO: 9940 - RNA, 19 nt, Artificial Sequence
  Synthetic
ggcggcccgcggucgccgc

SEQ ID NO: 9941 - RNA, 19 nt, Artificial Sequence
  Synthetic
gccagcgaggccagcgcgc

SEQ ID NO: 9942 - RNA, 20 nt, Artificial Sequence
  Synthetic
ggccagcgaggccagcgcgc

SEQ ID NO: 9943 - RNA, 22 nt, Artificial Sequence
  Synthetic
gcggccagcgaggccagcgcgc

SEQ ID NO: 9944 - RNA, 24 nt, Artificial Sequence
  Synthetic
gcgcggccagcgaggccagcgcgc

SEQ ID NO: 9945 - RNA, 18 nt, Artificial Sequence
  Synthetic
gcccuccgccagcgccuc

SEQ ID NO: 9946 - RNA, 21 nt, Artificial Sequence
  Synthetic
gaagcccuccgccagcgccuc

SEQ ID NO: 9947 - RNA, 24 nt, Artificial Sequence
  Synthetic
gucgaagcccuccgccagcgccuc

SEQ ID NO: 9948 - RNA, 18 nt, Artificial Sequence
  Synthetic
ggcgucgccgccgucguc

SEQ ID NO: 9949 - RNA, 21 nt, Artificial Sequence
  Synthetic
guuggcgucgccgccgucguc

SEQ ID NO: 9950 - RNA, 22 nt, Artificial Sequence
  Synthetic
gguuggcgucgccgccgucguc

SEQ ID NO: 9951 - RNA, 24 nt, Artificial Sequence
  Synthetic
gcgguuggcgucgccgccgucguc

SEQ ID NO: 9952 - RNA, 19 nt, Artificial Sequence
  Synthetic
gucgucgucagacgaggag

SEQ ID NO: 9953 - RNA, 22 nt, Artificial Sequence
  Synthetic
gucgucgucgucagacgaggag

SEQ ID NO: 9954 - RNA, 18 nt, Artificial Sequence
  Synthetic
ggggcccucggcgggccg

SEQ ID NO: 9955 - RNA, 21 nt, Artificial Sequence
  Synthetic
gucggggcccucggcgggccg

SEQ ID NO: 9956 - RNA, 22 nt, Artificial Sequence
  Synthetic
ggucggggcccucggcgggccg

SEQ ID NO: 9957 - RNA, 23 nt, Artificial Sequence
  Synthetic
gggucggggcccucggcgggccg

SEQ ID NO: 9958 - RNA, 18 nt, Artificial Sequence
  Synthetic
gguccucgcccggcagcg

SEQ ID NO: 9959 - RNA, 22 nt, Artificial Sequence
  Synthetic
gccagguccucgcccggcagcg

SEQ ID NO: 9960 - RNA, 23 nt, Artificial Sequence
  Synthetic
ggccagguccucgcccggcagcg

SEQ ID NO: 9961 - RNA, 19 nt, Artificial Sequence
  Synthetic
gacgaggauccggauuuug

SEQ ID NO: 9962 - RNA, 22 nt, Artificial Sequence
  Synthetic
gacgacgaggauccggauuuug

SEQ ID NO: 9963 - RNA, 18 nt, Artificial Sequence
  Synthetic
gacgccgacgacgaggau

SEQ ID NO: 9964 - RNA, 19 nt, Artificial Sequence
  Synthetic
ggacgccgacgacgaggau

SEQ ID NO: 9965 - RNA, 21 nt, Artificial Sequence
  Synthetic
gaggacgccgacgacgaggau

SEQ ID NO: 9966 - RNA, 22 nt, Artificial Sequence
  Synthetic
ggaggacgccgacgacgaggau

SEQ ID NO: 9967 - RNA, 24 nt, Artificial Sequence
  Synthetic
gcggaggacgccgacgacgaggau

SEQ ID NO: 9968 - RNA, 18 nt, Artificial Sequence
  Synthetic
ggcggcgccagccgcccu

SEQ ID NO: 9969 - RNA, 21 nt, Artificial Sequence
  Synthetic
gcuggcggcgccagccgcccu

SEQ ID NO: 9970 - RNA, 22 nt, Artificial Sequence
  Synthetic
ggcuggcggcgccagccgcccu

SEQ ID NO: 9971 - RNA, 24 nt, Artificial Sequence
  Synthetic
gcggcuggcggcgccagccgcccu

SEQ ID NO: 9972 - RNA, 20 nt, Artificial Sequence
  Synthetic
gaucaccacgcgcacguccu

SEQ ID NO: 9973 - RNA, 21 nt, Artificial Sequence
  Synthetic
ggaucaccacgcgcacguccu

SEQ ID NO: 9974 - RNA, 23 nt, Artificial Sequence
  Synthetic
gaggaucaccacgcgcacguccu

SEQ ID NO: 9975 - RNA, 18 nt, Artificial Sequence
  Synthetic
ggcgcagcggcggcgcgu

SEQ ID NO: 9976 - RNA, 20 nt, Artificial Sequence
  Synthetic
gaggcgcagcggcggcgcgu

SEQ ID NO: 9977 - RNA, 23 nt, Artificial Sequence
  Synthetic
gcagaggcgcagcggcggcgcgu

SEQ ID NO: 9978 - RNA, 24 nt, Artificial Sequence
  Synthetic
ggcagaggcgcagcggcggcgcgu

SEQ ID NO: 9979 - RNA, 23 nt, Artificial Sequence
  Synthetic
gccccagcgcgcgcaggcgcggu

SEQ ID NO: 9980 - RNA, 24 nt, Artificial Sequence
  Synthetic
ggccccagcgcgcgcaggcgcggu

SEQ ID NO: 9981 - RNA, 19 nt, Artificial Sequence
  Synthetic
gacaggcuggccauggggu

SEQ ID NO: 9982 - RNA, 21 nt, Artificial Sequence
  Synthetic
gcgacaggcuggccauggggu

SEQ ID NO: 9983 - RNA, 22 nt, Artificial Sequence
  Synthetic
ggcgacaggcuggccauggggu

SEQ ID NO: 9984 - RNA, 24 nt, Artificial Sequence
  Synthetic
gcggcgacaggcuggccauggggu

SEQ ID NO: 9985 - RNA, 23 nt, Artificial Sequence
  Synthetic
guacacgccggacgcggaggcga

SEQ ID NO: 9986 - RNA, 19 nt, Artificial Sequence
  Synthetic
gcgcgggccgugccccacc

SEQ ID NO: 9987 - RNA, 20 nt, Artificial Sequence
  Synthetic
ggcgcgggccgugccccacc

SEQ ID NO: 9988 - RNA, 22 nt, Artificial Sequence
  Synthetic
guggcgcgggccgugccccacc

SEQ ID NO: 9989 - RNA, 24 nt, Artificial Sequence
  Synthetic
gcguggcgcgggccgugccccacc

SEQ ID NO: 9990 - RNA, 19 nt, Artificial Sequence
  Synthetic
gccgggggcgggccccccc

SEQ ID NO: 9991 - RNA, 21 nt, Artificial Sequence
  Synthetic
gcgccgggggcgggccccccc

SEQ ID NO: 9992 - RNA, 24 nt, Artificial Sequence
  Synthetic
gccgcgccgggggcgggccccccc

SEQ ID NO: 9993 - RNA, 23 nt, Artificial Sequence
  Synthetic
gccuccggccgcguguucgggcc

SEQ ID NO: 9994 - RNA, 24 nt, Artificial Sequence
  Synthetic
ggccuccggccgcguguucgggcc

SEQ ID NO: 9995 - RNA, 20 nt, Artificial Sequence
  Synthetic
gcuggugcccauguccccgc

SEQ ID NO: 9996 - RNA, 21 nt, Artificial Sequence
  Synthetic
gcccgccggcuacggcgccgc

SEQ ID NO: 9997 - RNA, 23 nt, Artificial Sequence
  Synthetic
gugcccgccggcuacggcgccgc

SEQ ID NO: 9998 - RNA, 24 nt, Artificial Sequence
  Synthetic
ggugcccgccggcuacggcgccgc

SEQ ID NO: 9999 - RNA, 19 nt, Artificial Sequence
  Synthetic
gcgcggacgacgaggaggc

SEQ ID NO: 10000 - RNA, 20 nt, Artificial Sequence
  Synthetic
ggcgcggacgacgaggaggc

SEQ ID NO: 10001 - RNA, 19 nt, Artificial Sequence
  Synthetic
gagcugcgcgggccgcggc

SEQ ID NO: 10002 - RNA, 20 nt, Artificial Sequence
  Synthetic
ggagcugcgcgggccgcggc

SEQ ID NO: 10003 - RNA, 22 nt, Artificial Sequence
  Synthetic
gcggagcugcgcgggccgcggc

SEQ ID NO: 10004 - RNA, 23 nt, Artificial Sequence
  Synthetic
ggcggagcugcgcgggccgcggc

SEQ ID NO: 10005 - RNA, 18 nt, Artificial Sequence
  Synthetic
gcugcgccgcgcggcggc

SEQ ID NO: 10006 - RNA, 22 nt, Artificial Sequence
  Synthetic
gcccgcugcgccgcgcggcggc

SEQ ID NO: 10007 - RNA, 23 nt, Artificial Sequence
  Synthetic
ggcccgcugcgccgcgcggcggc

SEQ ID NO: 10008 - RNA, 24 nt, Artificial Sequence
  Synthetic
gggcccgcugcgccgcgcggcggc

SEQ ID NO: 10009 - RNA, 22 nt, Artificial Sequence
  Synthetic
gcuucacggccgggcggccccg

SEQ ID NO: 10010 - RNA, 22 nt, Artificial Sequence
  Synthetic
gaccuggccuucgccggcgccg

SEQ ID NO: 10011 - RNA, 23 nt, Artificial Sequence
  Synthetic
ggaccuggccuucgccggcgccg

SEQ ID NO: 10012 - RNA, 24 nt, Artificial Sequence
  Synthetic
gggaccuggccuucgccggcgccg

SEQ ID NO: 10013 - RNA, 20 nt, Artificial Sequence
  Synthetic
gacgaccgcgacgcgggccg

SEQ ID NO: 10014 - RNA, 23 nt, Artificial Sequence
  Synthetic
gacgacgaccgcgacgcgggccg

SEQ ID NO: 10015 - RNA, 19 nt, Artificial Sequence
  Synthetic
gaggcgggccgcguggccg

SEQ ID NO: 10016 - RNA, 20 nt, Artificial Sequence
  Synthetic
ggaggcgggccgcguggccg

SEQ ID NO: 10017 - RNA, 22 nt, Artificial Sequence
  Synthetic
gcggaggcgggccgcguggccg

SEQ ID NO: 10018 - RNA, 24 nt, Artificial Sequence
  Synthetic
gcgcggaggcgggccgcguggccg

SEQ ID NO: 10019 - RNA, 18 nt, Artificial Sequence
  Synthetic
gugccuggccgccugccg

SEQ ID NO: 10020 - RNA, 20 nt, Artificial Sequence
  Synthetic
gagugccuggccgccugccg

SEQ ID NO: 10021 - RNA, 21 nt, Artificial Sequence
  Synthetic
ggagugccuggccgccugccg

SEQ ID NO: 10022 - RNA, 23 nt, Artificial Sequence
  Synthetic
guggagugccuggccgccugccg

SEQ ID NO: 10023 - RNA, 22 nt, Artificial Sequence
  Synthetic
gccuucuacgcgcgcuaccgcg

SEQ ID NO: 10024 - RNA, 24 nt, Artificial Sequence
  Synthetic
gcgccuucuacgcgcgcuaccgcg

SEQ ID NO: 10025 - RNA, 19 nt, Artificial Sequence
  Synthetic
gacgacgacggacuguuug

SEQ ID NO: 10026 - RNA, 22 nt, Artificial Sequence
  Synthetic
gacgacgacgacggacuguuug

SEQ ID NO: 10027 - RNA, 23 nt, Artificial Sequence
  Synthetic
ggacgacgacgacggacuguuug

SEQ ID NO: 10028 - RNA, 19 nt, Artificial Sequence
  Synthetic
gccucugacucaucaaaau

SEQ ID NO: 10029 - RNA, 22 nt, Artificial Sequence
  Synthetic
gccgccucugacucaucaaaau

SEQ ID NO: 10030 - RNA, 23 nt, Artificial Sequence
  Synthetic
ggccgccucugacucaucaaaau

SEQ ID NO: 10031 - RNA, 18 nt, Artificial Sequence
  Synthetic
gcuggaccaggccugcuu

SEQ ID NO: 10032 - RNA, 20 nt, Artificial Sequence
  Synthetic
gcgcuggaccaggccugcuu

SEQ ID NO: 10033 - RNA, 21 nt, Artificial Sequence
  Synthetic
ggcgcuggaccaggccugcuu

SEQ ID NO: 10034 - RNA, 23 nt, Artificial Sequence
  Synthetic
guggcgcuggaccaggccugcuu

SEQ ID NO: 10035 - RNA, 19 nt, Artificial Sequence
  Synthetic
cgcggcgacaggcuggcca

SEQ ID NO: 10036 - RNA, 20 nt, Artificial Sequence
  Synthetic
ucgcggcgacaggcuggcca

SEQ ID NO: 10037 - RNA, 19 nt, Artificial Sequence
  Synthetic
cgccacggcgcggggaaga

SEQ ID NO: 10038 - RNA, 23 nt, Artificial Sequence
  Synthetic
cgggcgccacggcgcggggaaga

SEQ ID NO: 10039 - RNA, 24 nt, Artificial Sequence
  Synthetic
ccgggcgccacggcgcggggaaga

SEQ ID NO: 10040 - RNA, 18 nt, Artificial Sequence
  Synthetic
cggaggcgggcgcggcga

SEQ ID NO: 10041 - RNA, 20 nt, Artificial Sequence
  Synthetic
cgcggaggcgggcgcggcga

SEQ ID NO: 10042 - RNA, 23 nt, Artificial Sequence
  Synthetic
cggcgcggaggcgggcgcggcga

SEQ ID NO: 10043 - RNA, 19 nt, Artificial Sequence
  Synthetic
cgcccggcagcggcgagua

SEQ ID NO: 10044 - RNA, 20 nt, Artificial Sequence
  Synthetic
ucgcccggcagcggcgagua

SEQ ID NO: 10045 - RNA, 21 nt, Artificial Sequence
  Synthetic
cucgcccggcagcggcgagua

SEQ ID NO: 10046 - RNA, 22 nt, Artificial Sequence
  Synthetic
ccucgcccggcagcggcgagua

SEQ ID NO: 10047 - RNA, 23 nt, Artificial Sequence
  Synthetic
uccucgcccggcagcggcgagua

SEQ ID NO: 10048 - RNA, 20 nt, Artificial Sequence
  Synthetic
aggcggaggacgccgacgac

SEQ ID NO: 10049 - RNA, 23 nt, Artificial Sequence
  Synthetic
aggaggcggaggacgccgacgac

SEQ ID NO: 10050 - RNA, 18 nt, Artificial Sequence
  Synthetic
cuccucgucguccgcgcc

SEQ ID NO: 10051 - RNA, 19 nt, Artificial Sequence
  Synthetic
ccuccucgucguccgcgcc

SEQ ID NO: 10052 - RNA, 21 nt, Artificial Sequence
  Synthetic
cgccuccucgucguccgcgcc

SEQ ID NO: 10053 - RNA, 22 nt, Artificial Sequence
  Synthetic
ccgccuccucgucguccgcgcc

SEQ ID NO: 10054 - RNA, 23 nt, Artificial Sequence
  Synthetic
cccgccuccucgucguccgcgcc

SEQ ID NO: 10055 - RNA, 24 nt, Artificial Sequence
  Synthetic
ccccgccuccucgucguccgcgcc

SEQ ID NO: 10056 - RNA, 18 nt, Artificial Sequence
  Synthetic
uggugucggcggggcgcc

SEQ ID NO: 10057 - RNA, 21 nt, Artificial Sequence
  Synthetic
ugguggugucggcggggcgcc

SEQ ID NO: 10058 - RNA, 24 nt, Artificial Sequence
  Synthetic
uggugguggugucggcggggcgcc

SEQ ID NO: 10059 - RNA, 18 nt, Artificial Sequence
  Synthetic
cguccccgggcgccacgc

SEQ ID NO: 10060 - RNA, 19 nt, Artificial Sequence
  Synthetic
acguccccgggcgccacgc

SEQ ID NO: 10061 - RNA, 20 nt, Artificial Sequence
  Synthetic
cacguccccgggcgccacgc

SEQ ID NO: 10062 - RNA, 21 nt, Artificial Sequence
  Synthetic
ccacguccccgggcgccacgc

SEQ ID NO: 10063 - RNA, 23 nt, Artificial Sequence
  Synthetic
cgccacguccccgggcgccacgc

SEQ ID NO: 10064 - RNA, 20 nt, Artificial Sequence
  Synthetic
aggcggcccgcggucgccgc

SEQ ID NO: 10065 - RNA, 21 nt, Artificial Sequence
  Synthetic
caggcggcccgcggucgccgc

SEQ ID NO: 10066 - RNA, 22 nt, Artificial Sequence
  Synthetic
ccaggcggcccgcggucgccgc

SEQ ID NO: 10067 - RNA, 23 nt, Artificial Sequence
  Synthetic
uccaggcggcccgcggucgccgc

SEQ ID NO: 10068 - RNA, 24 nt, Artificial Sequence
  Synthetic
cuccaggcggcccgcggucgccgc

SEQ ID NO: 10069 - RNA, 18 nt, Artificial Sequence
  Synthetic
ccagcgaggccagcgcgc

SEQ ID NO: 10070 - RNA, 21 nt, Artificial Sequence
  Synthetic
cggccagcgaggccagcgcgc

SEQ ID NO: 10071 - RNA, 23 nt, Artificial Sequence
  Synthetic
cgcggccagcgaggccagcgcgc

SEQ ID NO: 10072 - RNA, 19 nt, Artificial Sequence
  Synthetic
agcccuccgccagcgccuc

SEQ ID NO: 10073 - RNA, 20 nt, Artificial Sequence
  Synthetic
aagcccuccgccagcgccuc

SEQ ID NO: 10074 - RNA, 22 nt, Artificial Sequence
  Synthetic
cgaagcccuccgccagcgccuc

SEQ ID NO: 10075 - RNA, 23 nt, Artificial Sequence
  Synthetic
ucgaagcccuccgccagcgccuc

SEQ ID NO: 10076 - RNA, 19 nt, Artificial Sequence
  Synthetic
uggcgucgccgccgucguc

SEQ ID NO: 10077 - RNA, 20 nt, Artificial Sequence
  Synthetic
uuggcgucgccgccgucguc

SEQ ID NO: 10078 - RNA, 23 nt, Artificial Sequence
  Synthetic
cgguuggcgucgccgccgucguc

SEQ ID NO: 10079 - RNA, 18 nt, Artificial Sequence
  Synthetic
ucgucgucagacgaggag

SEQ ID NO: 10080 - RNA, 20 nt, Artificial Sequence
  Synthetic
cgucgucgucagacgaggag

SEQ ID NO: 10081 - RNA, 21 nt, Artificial Sequence
  Synthetic
ucgucgucgucagacgaggag

SEQ ID NO: 10082 - RNA, 23 nt, Artificial Sequence
  Synthetic
cgucgucgucgucagacgaggag

SEQ ID NO: 10083 - RNA, 24 nt, Artificial Sequence
  Synthetic
ucgucgucgucgucagacgaggag

SEQ ID NO: 10084 - RNA, 19 nt, Artificial Sequence
  Synthetic
cggggcccucggcgggccg

SEQ ID NO: 10085 - RNA, 20 nt, Artificial Sequence
  Synthetic
ucggggcccucggcgggccg

SEQ ID NO: 10086 - RNA, 24 nt, Artificial Sequence
  Synthetic
cgggucggggcccucggcgggccg

SEQ ID NO: 10087 - RNA, 19 nt, Artificial Sequence
  Synthetic
agguccucgcccggcagcg

SEQ ID NO: 10088 - RNA, 20 nt, Artificial Sequence
  Synthetic
cagguccucgcccggcagcg

SEQ ID NO: 10089 - RNA, 21 nt, Artificial Sequence
  Synthetic
ccagguccucgcccggcagcg

SEQ ID NO: 10090 - RNA, 24 nt, Artificial Sequence
  Synthetic
cggccagguccucgcccggcagcg

SEQ ID NO: 10091 - RNA, 18 nt, Artificial Sequence
  Synthetic
acgaggauccggauuuug

SEQ ID NO: 10092 - RNA, 20 nt, Artificial Sequence
  Synthetic
cgacgaggauccggauuuug

SEQ ID NO: 10093 - RNA, 21 nt, Artificial Sequence
  Synthetic
acgacgaggauccggauuuug

SEQ ID NO: 10094 - RNA, 23 nt, Artificial Sequence
  Synthetic
cgacgacgaggauccggauuuug

SEQ ID NO: 10095 - RNA, 24 nt, Artificial Sequence
  Synthetic
ccgacgacgaggauccggauuuug

SEQ ID NO: 10096 - RNA, 20 nt, Artificial Sequence
  Synthetic
aggacgccgacgacgaggau

SEQ ID NO: 10097 - RNA, 23 nt, Artificial Sequence
  Synthetic
cggaggacgccgacgacgaggau

SEQ ID NO: 10098 - RNA, 19 nt, Artificial Sequence
  Synthetic
uggcggcgccagccgcccu

SEQ ID NO: 10099 - RNA, 20 nt, Artificial Sequence
  Synthetic
cuggcggcgccagccgcccu

SEQ ID NO: 10100 - RNA, 23 nt, Artificial Sequence
  Synthetic
cggcuggcggcgccagccgcccu

SEQ ID NO: 10101 - RNA, 18 nt, Artificial Sequence
  Synthetic
ucaccacgcgcacguccu

SEQ ID NO: 10102 - RNA, 19 nt, Artificial Sequence
  Synthetic
aucaccacgcgcacguccu

SEQ ID NO: 10103 - RNA, 22 nt, Artificial Sequence
  Synthetic
aggaucaccacgcgcacguccu

SEQ ID NO: 10104 - RNA, 24 nt, Artificial Sequence
  Synthetic
agaggaucaccacgcgcacguccu

SEQ ID NO: 10105 - RNA, 19 nt, Artificial Sequence
  Synthetic
aggcgcagcggcggcgcgu

SEQ ID NO: 10106 - RNA, 21 nt, Artificial Sequence
  Synthetic
agaggcgcagcggcggcgcgu

SEQ ID NO: 10107 - RNA, 22 nt, Artificial Sequence
  Synthetic
cagaggcgcagcggcggcgcgu

SEQ ID NO: 10108 - RNA, 18 nt, Artificial Sequence
  Synthetic
agcgcgcgcaggcgcggu

SEQ ID NO: 10109 - RNA, 19 nt, Artificial Sequence
  Synthetic
cagcgcgcgcaggcgcggu

SEQ ID NO: 10110 - RNA, 20 nt, Artificial Sequence
  Synthetic
ccagcgcgcgcaggcgcggu

SEQ ID NO: 10111 - RNA, 21 nt, Artificial Sequence
  Synthetic
cccagcgcgcgcaggcgcggu

SEQ ID NO: 10112 - RNA, 22 nt, Artificial Sequence
  Synthetic
ccccagcgcgcgcaggcgcggu

SEQ ID NO: 10113 - RNA, 18 nt, Artificial Sequence
  Synthetic
acaggcuggccauggggu

SEQ ID NO: 10114 - RNA, 20 nt, Artificial Sequence
  Synthetic
cgacaggcuggccauggggu

SEQ ID NO: 10115 - RNA, 23 nt, Artificial Sequence
  Synthetic
cggcgacaggcuggccauggggu

SEQ ID NO: 10116 - RNA, 18 nt, Artificial Sequence
  Synthetic
cgccggacgcggaggcga

SEQ ID NO: 10117 - RNA, 19 nt, Artificial Sequence
  Synthetic
acgccggacgcggaggcga

SEQ ID NO: 10118 - RNA, 20 nt, Artificial Sequence
  Synthetic
cacgccggacgcggaggcga

SEQ ID NO: 10119 - RNA, 21 nt, Artificial Sequence
  Synthetic
acacgccggacgcggaggcga

SEQ ID NO: 10120 - RNA, 22 nt, Artificial Sequence
  Synthetic
uacacgccggacgcggaggcga

SEQ ID NO: 10121 - RNA, 24 nt, Artificial Sequence
  Synthetic
uguacacgccggacgcggaggcga

SEQ ID NO: 10122 - RNA, 18 nt, Artificial Sequence
  Synthetic
cgcgggccgugccccacc

SEQ ID NO: 10123 - RNA, 21 nt, Artificial Sequence
  Synthetic
uggcgcgggccgugccccacc

SEQ ID NO: 10124 - RNA, 23 nt, Artificial Sequence
  Synthetic
cguggcgcgggccgugccccacc

SEQ ID NO: 10125 - RNA, 18 nt, Artificial Sequence
  Synthetic
ccgggggcgggccccccc

SEQ ID NO: 10126 - RNA, 20 nt, Artificial Sequence
  Synthetic
cgccgggggcgggccccccc

SEQ ID NO: 10127 - RNA, 22 nt, Artificial Sequence
  Synthetic
cgcgccgggggcgggccccccc

SEQ ID NO: 10128 - RNA, 23 nt, Artificial Sequence
  Synthetic
ccgcgccgggggcgggccccccc

SEQ ID NO: 10129 - RNA, 18 nt, Artificial Sequence
  Synthetic
cggccgcguguucgggcc

SEQ ID NO: 10130 - RNA, 19 nt, Artificial Sequence
  Synthetic
ccggccgcguguucgggcc

SEQ ID NO: 10131 - RNA, 20 nt, Artificial Sequence
  Synthetic
uccggccgcguguucgggcc

SEQ ID NO: 10132 - RNA, 21 nt, Artificial Sequence
  Synthetic
cuccggccgcguguucgggcc

SEQ ID NO: 10133 - RNA, 22 nt, Artificial Sequence
  Synthetic
ccuccggccgcguguucgggcc

SEQ ID NO: 10134 - RNA, 18 nt, Artificial Sequence
  Synthetic
uggugcccauguccccgc

SEQ ID NO: 10135 - RNA, 19 nt, Artificial Sequence
  Synthetic
cuggugcccauguccccgc

SEQ ID NO: 10136 - RNA, 21 nt, Artificial Sequence
  Synthetic
cgcuggugcccauguccccgc

SEQ ID NO: 10137 - RNA, 22 nt, Artificial Sequence
  Synthetic
acgcuggugcccauguccccgc

SEQ ID NO: 10138 - RNA, 23 nt, Artificial Sequence
  Synthetic
cacgcuggugcccauguccccgc

SEQ ID NO: 10139 - RNA, 24 nt, Artificial Sequence
  Synthetic
acacgcuggugcccauguccccgc

SEQ ID NO: 10140 - RNA, 18 nt, Artificial Sequence
  Synthetic
cgccggcuacggcgccgc

SEQ ID NO: 10141 - RNA, 19 nt, Artificial Sequence
  Synthetic
ccgccggcuacggcgccgc

SEQ ID NO: 10142 - RNA, 20 nt, Artificial Sequence
  Synthetic
cccgccggcuacggcgccgc

SEQ ID NO: 10143 - RNA, 22 nt, Artificial Sequence
  Synthetic
ugcccgccggcuacggcgccgc

SEQ ID NO: 10144 - RNA, 18 nt, Artificial Sequence
  Synthetic
cgcggacgacgaggaggc

SEQ ID NO: 10145 - RNA, 21 nt, Artificial Sequence
  Synthetic
cggcgcggacgacgaggaggc

SEQ ID NO: 10146 - RNA, 22 nt, Artificial Sequence
  Synthetic
ucggcgcggacgacgaggaggc

SEQ ID NO: 10147 - RNA, 23 nt, Artificial Sequence
  Synthetic
cucggcgcggacgacgaggaggc

SEQ ID NO: 10148 - RNA, 24 nt, Artificial Sequence
  Synthetic
ccucggcgcggacgacgaggaggc

SEQ ID NO: 10149 - RNA, 18 nt, Artificial Sequence
  Synthetic
agcugcgcgggccgcggc

SEQ ID NO: 10150 - RNA, 21 nt, Artificial Sequence
  Synthetic
cggagcugcgcgggccgcggc

SEQ ID NO: 10151 - RNA, 24 nt, Artificial Sequence
  Synthetic
cggcggagcugcgcgggccgcggc

SEQ ID NO: 10152 - RNA, 19 nt, Artificial Sequence
  Synthetic
cgcugcgccgcgcggcggc

SEQ ID NO: 10153 - RNA, 20 nt, Artificial Sequence
  Synthetic
ccgcugcgccgcgcggcggc

SEQ ID NO: 10154 - RNA, 21 nt, Artificial Sequence
  Synthetic
cccgcugcgccgcgcggcggc

SEQ ID NO: 10155 - RNA, 18 nt, Artificial Sequence
  Synthetic
cacggccgggcggccccg

SEQ ID NO: 10156 - RNA, 19 nt, Artificial Sequence
  Synthetic
ucacggccgggcggccccg

SEQ ID NO: 10157 - RNA, 20 nt, Artificial Sequence
  Synthetic
uucacggccgggcggccccg

SEQ ID NO: 10158 - RNA, 21 nt, Artificial Sequence
  Synthetic
cuucacggccgggcggccccg

SEQ ID NO: 10159 - RNA, 23 nt, Artificial Sequence
  Synthetic
cgcuucacggccgggcggccccg

SEQ ID NO: 10160 - RNA, 24 nt, Artificial Sequence
  Synthetic
ccgcuucacggccgggcggccccg

SEQ ID NO: 10161 - RNA, 18 nt, Artificial Sequence
  Synthetic
uggccuucgccggcgccg

SEQ ID NO: 10162 - RNA, 19 nt, Artificial Sequence
  Synthetic
cuggccuucgccggcgccg

SEQ ID NO: 10163 - RNA, 20 nt, Artificial Sequence
  Synthetic
ccuggccuucgccggcgccg

SEQ ID NO: 10164 - RNA, 21 nt, Artificial Sequence
  Synthetic
accuggccuucgccggcgccg

SEQ ID NO: 10165 - RNA, 18 nt, Artificial Sequence
  Synthetic
cgaccgcgacgcgggccg

SEQ ID NO: 10166 - RNA, 19 nt, Artificial Sequence
  Synthetic
acgaccgcgacgcgggccg

SEQ ID NO: 10167 - RNA, 21 nt, Artificial Sequence
  Synthetic
cgacgaccgcgacgcgggccg

SEQ ID NO: 10168 - RNA, 22 nt, Artificial Sequence
  Synthetic
acgacgaccgcgacgcgggccg

SEQ ID NO: 10169 - RNA, 24 nt, Artificial Sequence
  Synthetic
ugacgacgaccgcgacgcgggccg

SEQ ID NO: 10170 - RNA, 18 nt, Artificial Sequence
  Synthetic
aggcgggccgcguggccg

SEQ ID NO: 10171 - RNA, 21 nt, Artificial Sequence
  Synthetic
cggaggcgggccgcguggccg

SEQ ID NO: 10172 - RNA, 23 nt, Artificial Sequence
  Synthetic
cgcggaggcgggccgcguggccg

SEQ ID NO: 10173 - RNA, 19 nt, Artificial Sequence
  Synthetic
agugccuggccgccugccg

SEQ ID NO: 10174 - RNA, 22 nt, Artificial Sequence
  Synthetic
uggagugccuggccgccugccg

SEQ ID NO: 10175 - RNA, 24 nt, Artificial Sequence
  Synthetic
cguggagugccuggccgccugccg

SEQ ID NO: 10176 - RNA, 18 nt, Artificial Sequence
  Synthetic
ucuacgcgcgcuaccgcg

SEQ ID NO: 10177 - RNA, 19 nt, Artificial Sequence
  Synthetic
uucuacgcgcgcuaccgcg

SEQ ID NO: 10178 - RNA, 20 nt, Artificial Sequence
  Synthetic
cuucuacgcgcgcuaccgcg

SEQ ID NO: 10179 - RNA, 21 nt, Artificial Sequence
  Synthetic
ccuucuacgcgcgcuaccgcg

SEQ ID NO: 10180 - RNA, 23 nt, Artificial Sequence
  Synthetic
cgccuucuacgcgcgcuaccgcg

SEQ ID NO: 10181 - RNA, 18 nt, Artificial Sequence
  Synthetic
acgacgacggacuguuug

SEQ ID NO: 10182 - RNA, 20 nt, Artificial Sequence
  Synthetic
cgacgacgacggacuguuug

SEQ ID NO: 10183 - RNA, 21 nt, Artificial Sequence
  Synthetic
acgacgacgacggacuguuug

SEQ ID NO: 10184 - RNA, 24 nt, Artificial Sequence
  Synthetic
aggacgacgacgacggacuguuug

SEQ ID NO: 10185 - RNA, 18 nt, Artificial Sequence
  Synthetic
ccucugacucaucaaaau

SEQ ID NO: 10186 - RNA, 20 nt, Artificial Sequence
  Synthetic
cgccucugacucaucaaaau

SEQ ID NO: 10187 - RNA, 21 nt, Artificial Sequence
  Synthetic
ccgccucugacucaucaaaau

SEQ ID NO: 10188 - RNA, 24 nt, Artificial Sequence
  Synthetic
cggccgccucugacucaucaaaau

SEQ ID NO: 10189 - RNA, 19 nt, Artificial Sequence
  Synthetic
cgcuggaccaggccugcuu

SEQ ID NO: 10190 - RNA, 22 nt, Artificial Sequence
  Synthetic
uggcgcuggaccaggccugcuu

SEQ ID NO: 10191 - RNA, 24 nt, Artificial Sequence
  Synthetic
cguggcgcuggaccaggccugcuu

SEQ ID NO: 10192 - RNA, 18 nt, Artificial Sequence
  Synthetic
cgccgccgccgacggcaa

SEQ ID NO: 10193 - RNA, 19 nt, Artificial Sequence
  Synthetic
acgccgccgccgacggcaa

SEQ ID NO: 10194 - RNA, 20 nt, Artificial Sequence
  Synthetic
gacgccgccgccgacggcaa

SEQ ID NO: 10195 - RNA, 21 nt, Artificial Sequence
  Synthetic
cgacgccgccgccgacggcaa

SEQ ID NO: 10196 - RNA, 22 nt, Artificial Sequence
  Synthetic
gcgacgccgccgccgacggcaa

SEQ ID NO: 10197 - RNA, 23 nt, Artificial Sequence
  Synthetic
ggcgacgccgccgccgacggcaa

SEQ ID NO: 10198 - RNA, 24 nt, Artificial Sequence
  Synthetic
cggcgacgccgccgccgacggcaa

SEQ ID NO: 10199 - RNA, 18 nt, Artificial Sequence
  Synthetic
ggcgcccgaggccucgaa

SEQ ID NO: 10200 - RNA, 19 nt, Artificial Sequence
  Synthetic
gggcgcccgaggccucgaa

SEQ ID NO: 10201 - RNA, 20 nt, Artificial Sequence
  Synthetic
ggggcgcccgaggccucgaa

SEQ ID NO: 10202 - RNA, 21 nt, Artificial Sequence
  Synthetic
cggggcgcccgaggccucgaa

SEQ ID NO: 10203 - RNA, 22 nt, Artificial Sequence
  Synthetic
ccggggcgcccgaggccucgaa

SEQ ID NO: 10204 - RNA, 23 nt, Artificial Sequence
  Synthetic
gccggggcgcccgaggccucgaa

SEQ ID NO: 10205 - RNA, 24 nt, Artificial Sequence
  Synthetic
cgccggggcgcccgaggccucgaa

SEQ ID NO: 10206 - RNA, 18 nt, Artificial Sequence
  Synthetic
cgucgucgcgcagcacca

SEQ ID NO: 10207 - RNA, 19 nt, Artificial Sequence
  Synthetic
gcgucgucgcgcagcacca

SEQ ID NO: 10208 - RNA, 20 nt, Artificial Sequence
  Synthetic
cgcgucgucgcgcagcacca

SEQ ID NO: 10209 - RNA, 21 nt, Artificial Sequence
  Synthetic
ccgcgucgucgcgcagcacca

SEQ ID NO: 10210 - RNA, 22 nt, Artificial Sequence
  Synthetic
uccgcgucgucgcgcagcacca

SEQ ID NO: 10211 - RNA, 23 nt, Artificial Sequence
  Synthetic
guccgcgucgucgcgcagcacca

SEQ ID NO: 10212 - RNA, 24 nt, Artificial Sequence
  Synthetic
cguccgcgucgucgcgcagcacca

SEQ ID NO: 10213 - RNA, 18 nt, Artificial Sequence
  Synthetic
cggcgcagcgcgcggcca

SEQ ID NO: 10214 - RNA, 19 nt, Artificial Sequence
  Synthetic
gcggcgcagcgcgcggcca

SEQ ID NO: 10215 - RNA, 20 nt, Artificial Sequence
  Synthetic
ggcggcgcagcgcgcggcca

SEQ ID NO: 10216 - RNA, 21 nt, Artificial Sequence
  Synthetic
gggcggcgcagcgcgcggcca

SEQ ID NO: 10217 - RNA, 22 nt, Artificial Sequence
  Synthetic
ggggcggcgcagcgcgcggcca

SEQ ID NO: 10218 - RNA, 23 nt, Artificial Sequence
  Synthetic
cggggcggcgcagcgcgcggcca

SEQ ID NO: 10219 - RNA, 24 nt, Artificial Sequence
  Synthetic
gcggggcggcgcagcgcgcggcca

SEQ ID NO: 10220 - RNA, 18 nt, Artificial Sequence
  Synthetic
cgacggugucggccagca

SEQ ID NO: 10221 - RNA, 19 nt, Artificial Sequence
  Synthetic
gcgacggugucggccagca

SEQ ID NO: 10222 - RNA, 20 nt, Artificial Sequence
  Synthetic
ggcgacggugucggccagca

SEQ ID NO: 10223 - RNA, 21 nt, Artificial Sequence
  Synthetic
cggcgacggugucggccagca

SEQ ID NO: 10224 - RNA, 22 nt, Artificial Sequence
  Synthetic
gcggcgacggugucggccagca

SEQ ID NO: 10225 - RNA, 23 nt, Artificial Sequence
  Synthetic
cgcggcgacggugucggccagca

SEQ ID NO: 10226 - RNA, 24 nt, Artificial Sequence
  Synthetic
ccgcggcgacggugucggccagca

SEQ ID NO: 10227 - RNA, 18 nt, Artificial Sequence
  Synthetic
gcgggcccgaggcgcgca

SEQ ID NO: 10228 - RNA, 19 nt, Artificial Sequence
  Synthetic
agcgggcccgaggcgcgca

SEQ ID NO: 10229 - RNA, 20 nt, Artificial Sequence
  Synthetic
cagcgggcccgaggcgcgca

SEQ ID NO: 10230 - RNA, 21 nt, Artificial Sequence
  Synthetic
gcagcgggcccgaggcgcgca

SEQ ID NO: 10231 - RNA, 22 nt, Artificial Sequence
  Synthetic
cgcagcgggcccgaggcgcgca

SEQ ID NO: 10232 - RNA, 23 nt, Artificial Sequence
  Synthetic
gcgcagcgggcccgaggcgcgca

SEQ ID NO: 10233 - RNA, 24 nt, Artificial Sequence
  Synthetic
ggcgcagcgggcccgaggcgcgca

SEQ ID NO: 10234 - RNA, 18 nt, Artificial Sequence
  Synthetic
aggccgccgcgcggcgca

SEQ ID NO: 10235 - RNA, 19 nt, Artificial Sequence
  Synthetic
caggccgccgcgcggcgca

SEQ ID NO: 10236 - RNA, 20 nt, Artificial Sequence
  Synthetic
ccaggccgccgcgcggcgca

SEQ ID NO: 10237 - RNA, 21 nt, Artificial Sequence
  Synthetic
uccaggccgccgcgcggcgca

SEQ ID NO: 10238 - RNA, 22 nt, Artificial Sequence
  Synthetic
auccaggccgccgcgcggcgca

SEQ ID NO: 10239 - RNA, 23 nt, Artificial Sequence
  Synthetic
cauccaggccgccgcgcggcgca

SEQ ID NO: 10240 - RNA, 24 nt, Artificial Sequence
  Synthetic
gcauccaggccgccgcgcggcgca

SEQ ID NO: 10241 - RNA, 18 nt, Artificial Sequence
  Synthetic
acgccgccgccgacggca

SEQ ID NO: 10242 - RNA, 19 nt, Artificial Sequence
  Synthetic
gacgccgccgccgacggca

SEQ ID NO: 10243 - RNA, 20 nt, Artificial Sequence
  Synthetic
cgacgccgccgccgacggca

SEQ ID NO: 10244 - RNA, 21 nt, Artificial Sequence
  Synthetic
gcgacgccgccgccgacggca

SEQ ID NO: 10245 - RNA, 22 nt, Artificial Sequence
  Synthetic
ggcgacgccgccgccgacggca

SEQ ID NO: 10246 - RNA, 23 nt, Artificial Sequence
  Synthetic
cggcgacgccgccgccgacggca

SEQ ID NO: 10247 - RNA, 24 nt, Artificial Sequence
  Synthetic
ccggcgacgccgccgccgacggca

SEQ ID NO: 10248 - RNA, 18 nt, Artificial Sequence
  Synthetic
ccacgcugccggagauga

SEQ ID NO: 10249 - RNA, 19 nt, Artificial Sequence
  Synthetic
gccacgcugccggagauga

SEQ ID NO: 10250 - RNA, 20 nt, Artificial Sequence
  Synthetic
cgccacgcugccggagauga

SEQ ID NO: 10251 - RNA, 21 nt, Artificial Sequence
  Synthetic
gcgccacgcugccggagauga

SEQ ID NO: 10252 - RNA, 22 nt, Artificial Sequence
  Synthetic
cgcgccacgcugccggagauga

SEQ ID NO: 10253 - RNA, 23 nt, Artificial Sequence
  Synthetic
ccgcgccacgcugccggagauga

SEQ ID NO: 10254 - RNA, 24 nt, Artificial Sequence
  Synthetic
cccgcgccacgcugccggagauga

SEQ ID NO: 10255 - RNA, 18 nt, Artificial Sequence
  Synthetic
agcgcgcgcgggucgaac

SEQ ID NO: 10256 - RNA, 19 nt, Artificial Sequence
  Synthetic
cagcgcgcgcgggucgaac

SEQ ID NO: 10257 - RNA, 20 nt, Artificial Sequence
  Synthetic
ccagcgcgcgcgggucgaac

SEQ ID NO: 10258 - RNA, 21 nt, Artificial Sequence
  Synthetic
gccagcgcgcgcgggucgaac

SEQ ID NO: 10259 - RNA, 22 nt, Artificial Sequence
  Synthetic
ggccagcgcgcgcgggucgaac

SEQ ID NO: 10260 - RNA, 23 nt, Artificial Sequence
  Synthetic
aggccagcgcgcgcgggucgaac

SEQ ID NO: 10261 - RNA, 24 nt, Artificial Sequence
  Synthetic
gaggccagcgcgcgcgggucgaac

SEQ ID NO: 10262 - RNA, 18 nt, Artificial Sequence
  Synthetic
cccagcucgggcgcccac

SEQ ID NO: 10263 - RNA, 19 nt, Artificial Sequence
  Synthetic
gcccagcucgggcgcccac

SEQ ID NO: 10264 - RNA, 20 nt, Artificial Sequence
  Synthetic
cgcccagcucgggcgcccac

SEQ ID NO: 10265 - RNA, 21 nt, Artificial Sequence
  Synthetic
ucgcccagcucgggcgcccac

SEQ ID NO: 10266 - RNA, 22 nt, Artificial Sequence
  Synthetic
gucgcccagcucgggcgcccac

SEQ ID NO: 10267 - RNA, 23 nt, Artificial Sequence
  Synthetic
cgucgcccagcucgggcgcccac

SEQ ID NO: 10268 - RNA, 24 nt, Artificial Sequence
  Synthetic
gcgucgcccagcucgggcgcccac

SEQ ID NO: 10269 - RNA, 18 nt, Artificial Sequence
  Synthetic
gaggaggcggaugcagac

SEQ ID NO: 10270 - RNA, 19 nt, Artificial Sequence
  Synthetic
cgaggaggcggaugcagac

SEQ ID NO: 10271 - RNA, 20 nt, Artificial Sequence
  Synthetic
acgaggaggcggaugcagac

SEQ ID NO: 10272 - RNA, 21 nt, Artificial Sequence
  Synthetic
gacgaggaggcggaugcagac

SEQ ID NO: 10273 - RNA, 22 nt, Artificial Sequence
  Synthetic
agacgaggaggcggaugcagac

SEQ ID NO: 10274 - RNA, 23 nt, Artificial Sequence
  Synthetic
cagacgaggaggcggaugcagac

SEQ ID NO: 10275 - RNA, 24 nt, Artificial Sequence
  Synthetic
ucagacgaggaggcggaugcagac

SEQ ID NO: 10276 - RNA, 18 nt, Artificial Sequence
  Synthetic
ucgucgucgucgucagac

SEQ ID NO: 10277 - RNA, 19 nt, Artificial Sequence
  Synthetic
gucgucgucgucgucagac

SEQ ID NO: 10278 - RNA, 20 nt, Artificial Sequence
  Synthetic
cgucgucgucgucgucagac

SEQ ID NO: 10279 - RNA, 21 nt, Artificial Sequence
  Synthetic
ucgucgucgucgucgucagac

SEQ ID NO: 10280 - RNA, 22 nt, Artificial Sequence
  Synthetic
gucgucgucgucgucgucagac

SEQ ID NO: 10281 - RNA, 23 nt, Artificial Sequence
  Synthetic
cgucgucgucgucgucgucagac

SEQ ID NO: 10282 - RNA, 24 nt, Artificial Sequence
  Synthetic
ucgucgucgucgucgucgucagac

SEQ ID NO: 10283 - RNA, 18 nt, Artificial Sequence
  Synthetic
cgguacucgcgcggggac

SEQ ID NO: 10284 - RNA, 19 nt, Artificial Sequence
  Synthetic
gcgguacucgcgcggggac

SEQ ID NO: 10285 - RNA, 20 nt, Artificial Sequence
  Synthetic
ggcgguacucgcgcggggac

SEQ ID NO: 10286 - RNA, 21 nt, Artificial Sequence
  Synthetic
cggcgguacucgcgcggggac

SEQ ID NO: 10287 - RNA, 22 nt, Artificial Sequence
  Synthetic
gcggcgguacucgcgcggggac

SEQ ID NO: 10288 - RNA, 23 nt, Artificial Sequence
  Synthetic
cgcggcgguacucgcgcggggac

SEQ ID NO: 10289 - RNA, 24 nt, Artificial Sequence
  Synthetic
gcgcggcgguacucgcgcggggac

SEQ ID NO: 10290 - RNA, 18 nt, Artificial Sequence
  Synthetic
gcgugcugccgcgagacc

SEQ ID NO: 10291 - RNA, 19 nt, Artificial Sequence
  Synthetic
ggcgugcugccgcgagacc

SEQ ID NO: 10292 - RNA, 20 nt, Artificial Sequence
  Synthetic
aggcgugcugccgcgagacc

SEQ ID NO: 10293 - RNA, 21 nt, Artificial Sequence
  Synthetic
uaggcgugcugccgcgagacc

SEQ ID NO: 10294 - RNA, 22 nt, Artificial Sequence
  Synthetic
guaggcgugcugccgcgagacc

SEQ ID NO: 10295 - RNA, 23 nt, Artificial Sequence
  Synthetic
gguaggcgugcugccgcgagacc

SEQ ID NO: 10296 - RNA, 24 nt, Artificial Sequence
  Synthetic
agguaggcgugcugccgcgagacc

SEQ ID NO: 10297 - RNA, 18 nt, Artificial Sequence
  Synthetic
ggguacgccccgcggacc

SEQ ID NO: 10298 - RNA, 19 nt, Artificial Sequence
  Synthetic
cggguacgccccgcggacc

SEQ ID NO: 10299 - RNA, 20 nt, Artificial Sequence
  Synthetic
ccggguacgccccgcggacc

SEQ ID NO: 10300 - RNA, 21 nt, Artificial Sequence
  Synthetic
uccggguacgccccgcggacc

SEQ ID NO: 10301 - RNA, 22 nt, Artificial Sequence
  Synthetic
guccggguacgccccgcggacc

SEQ ID NO: 10302 - RNA, 23 nt, Artificial Sequence
  Synthetic
gguccggguacgccccgcggacc

SEQ ID NO: 10303 - RNA, 24 nt, Artificial Sequence
  Synthetic
ggguccggguacgccccgcggacc

SEQ ID NO: 10304 - RNA, 18 nt, Artificial Sequence
  Synthetic
uccgccucgggcgccccc

SEQ ID NO: 10305 - RNA, 19 nt, Artificial Sequence
  Synthetic
cuccgccucgggcgccccc

SEQ ID NO: 10306 - RNA, 20 nt, Artificial Sequence
  Synthetic
ccuccgccucgggcgccccc

SEQ ID NO: 10307 - RNA, 21 nt, Artificial Sequence
  Synthetic
uccuccgccucgggcgccccc

SEQ ID NO: 10308 - RNA, 22 nt, Artificial Sequence
  Synthetic
cuccuccgccucgggcgccccc

SEQ ID NO: 10309 - RNA, 23 nt, Artificial Sequence
  Synthetic
ccuccuccgccucgggcgccccc

SEQ ID NO: 10310 - RNA, 24 nt, Artificial Sequence
  Synthetic
gccuccuccgccucgggcgccccc

SEQ ID NO: 10311 - RNA, 18 nt, Artificial Sequence
  Synthetic
gcggggggcgcggccccc

SEQ ID NO: 10312 - RNA, 19 nt, Artificial Sequence
  Synthetic
ggcggggggcgcggccccc

SEQ ID NO: 10313 - RNA, 20 nt, Artificial Sequence
  Synthetic
gggcggggggcgcggccccc

SEQ ID NO: 10314 - RNA, 21 nt, Artificial Sequence
  Synthetic
ggggcggggggcgcggccccc

SEQ ID NO: 10315 - RNA, 22 nt, Artificial Sequence
  Synthetic
cggggcggggggcgcggccccc

SEQ ID NO: 10316 - RNA, 23 nt, Artificial Sequence
  Synthetic
gcggggcggggggcgcggccccc

SEQ ID NO: 10317 - RNA, 24 nt, Artificial Sequence
  Synthetic
ggcggggcggggggcgcggccccc

SEQ ID NO: 10318 - RNA, 18 nt, Artificial Sequence
  Synthetic
gcgccggccagcagcccc

SEQ ID NO: 10319 - RNA, 19 nt, Artificial Sequence
  Synthetic
ggcgccggccagcagcccc

SEQ ID NO: 10320 - RNA, 20 nt, Artificial Sequence
  Synthetic
aggcgccggccagcagcccc

SEQ ID NO: 10321 - RNA, 21 nt, Artificial Sequence
  Synthetic
caggcgccggccagcagcccc

SEQ ID NO: 10322 - RNA, 22 nt, Artificial Sequence
  Synthetic
gcaggcgccggccagcagcccc

SEQ ID NO: 10323 - RNA, 23 nt, Artificial Sequence
  Synthetic
cgcaggcgccggccagcagcccc

SEQ ID NO: 10324 - RNA, 24 nt, Artificial Sequence
  Synthetic
ucgcaggcgccggccagcagcccc

SEQ ID NO: 10325 - RNA, 18 nt, Artificial Sequence
  Synthetic
gggguccggguacgcccc

SEQ ID NO: 10326 - RNA, 19 nt, Artificial Sequence
  Synthetic
ugggguccggguacgcccc

SEQ ID NO: 10327 - RNA, 20 nt, Artificial Sequence
  Synthetic
augggguccggguacgcccc

SEQ ID NO: 10328 - RNA, 21 nt, Artificial Sequence
  Synthetic
caugggguccggguacgcccc

SEQ ID NO: 10329 - RNA, 22 nt, Artificial Sequence
  Synthetic
ccaugggguccggguacgcccc

SEQ ID NO: 10330 - RNA, 23 nt, Artificial Sequence
  Synthetic
gccaugggguccggguacgcccc

SEQ ID NO: 10331 - RNA, 24 nt, Artificial Sequence
  Synthetic
ggccaugggguccggguacgcccc

SEQ ID NO: 10332 - RNA, 18 nt, Artificial Sequence
  Synthetic
cggccggggcgccgcccc

SEQ ID NO: 10333 - RNA, 19 nt, Artificial Sequence
  Synthetic
ucggccggggcgccgcccc

SEQ ID NO: 10334 - RNA, 20 nt, Artificial Sequence
  Synthetic
cucggccggggcgccgcccc

SEQ ID NO: 10335 - RNA, 21 nt, Artificial Sequence
  Synthetic
gcucggccggggcgccgcccc

SEQ ID NO: 10336 - RNA, 22 nt, Artificial Sequence
  Synthetic
ggcucggccggggcgccgcccc

SEQ ID NO: 10337 - RNA, 23 nt, Artificial Sequence
  Synthetic
gggcucggccggggcgccgcccc

SEQ ID NO: 10338 - RNA, 24 nt, Artificial Sequence
  Synthetic
cgggcucggccggggcgccgcccc

SEQ ID NO: 10339 - RNA, 18 nt, Artificial Sequence
  Synthetic
ccguacagcacgcgcccc

SEQ ID NO: 10340 - RNA, 19 nt, Artificial Sequence
  Synthetic
gccguacagcacgcgcccc

SEQ ID NO: 10341 - RNA, 20 nt, Artificial Sequence
  Synthetic
cgccguacagcacgcgcccc

SEQ ID NO: 10342 - RNA, 21 nt, Artificial Sequence
  Synthetic
ccgccguacagcacgcgcccc

SEQ ID NO: 10343 - RNA, 22 nt, Artificial Sequence
  Synthetic
cccgccguacagcacgcgcccc

SEQ ID NO: 10344 - RNA, 23 nt, Artificial Sequence
  Synthetic
gcccgccguacagcacgcgcccc

SEQ ID NO: 10345 - RNA, 24 nt, Artificial Sequence
  Synthetic
agcccgccguacagcacgcgcccc

SEQ ID NO: 10346 - RNA, 18 nt, Artificial Sequence
  Synthetic
ggcgccggccagcagccc

SEQ ID NO: 10347 - RNA, 19 nt, Artificial Sequence
  Synthetic
aggcgccggccagcagccc

SEQ ID NO: 10348 - RNA, 20 nt, Artificial Sequence
  Synthetic
caggcgccggccagcagccc

SEQ ID NO: 10349 - RNA, 21 nt, Artificial Sequence
  Synthetic
gcaggcgccggccagcagccc

SEQ ID NO: 10350 - RNA, 22 nt, Artificial Sequence
  Synthetic
cgcaggcgccggccagcagccc

SEQ ID NO: 10351 - RNA, 23 nt, Artificial Sequence
  Synthetic
ucgcaggcgccggccagcagccc

SEQ ID NO: 10352 - RNA, 24 nt, Artificial Sequence
  Synthetic
gucgcaggcgccggccagcagccc

SEQ ID NO: 10353 - RNA, 18 nt, Artificial Sequence
  Synthetic
ucggccggggcgccgccc

SEQ ID NO: 10354 - RNA, 19 nt, Artificial Sequence
  Synthetic
cucggccggggcgccgccc

SEQ ID NO: 10355 - RNA, 20 nt, Artificial Sequence
  Synthetic
gcucggccggggcgccgccc

SEQ ID NO: 10356 - RNA, 21 nt, Artificial Sequence
  Synthetic
ggcucggccggggcgccgccc

SEQ ID NO: 10357 - RNA, 22 nt, Artificial Sequence
  Synthetic
gggcucggccggggcgccgccc

SEQ ID NO: 10358 - RNA, 23 nt, Artificial Sequence
  Synthetic
cgggcucggccggggcgccgccc

SEQ ID NO: 10359 - RNA, 24 nt, Artificial Sequence
  Synthetic
gcgggcucggccggggcgccgccc

SEQ ID NO: 10360 - RNA, 18 nt, Artificial Sequence
  Synthetic
gccguacagcacgcgccc

SEQ ID NO: 10361 - RNA, 19 nt, Artificial Sequence
  Synthetic
cgccguacagcacgcgccc

SEQ ID NO: 10362 - RNA, 20 nt, Artificial Sequence
  Synthetic
ccgccguacagcacgcgccc

SEQ ID NO: 10363 - RNA, 21 nt, Artificial Sequence
  Synthetic
cccgccguacagcacgcgccc

SEQ ID NO: 10364 - RNA, 22 nt, Artificial Sequence
  Synthetic
gcccgccguacagcacgcgccc

SEQ ID NO: 10365 - RNA, 23 nt, Artificial Sequence
  Synthetic
agcccgccguacagcacgcgccc

SEQ ID NO: 10366 - RNA, 24 nt, Artificial Sequence
  Synthetic
cagcccgccguacagcacgcgccc

SEQ ID NO: 10367 - RNA, 18 nt, Artificial Sequence
  Synthetic
ggcggggcggccgcgccc

SEQ ID NO: 10368 - RNA, 19 nt, Artificial Sequence
  Synthetic
cggcggggcggccgcgccc

SEQ ID NO: 10369 - RNA, 20 nt, Artificial Sequence
  Synthetic
gcggcggggcggccgcgccc

SEQ ID NO: 10370 - RNA, 21 nt, Artificial Sequence
  Synthetic
ugcggcggggcggccgcgccc

SEQ ID NO: 10371 - RNA, 22 nt, Artificial Sequence
  Synthetic
gugcggcggggcggccgcgccc

SEQ ID NO: 10372 - RNA, 23 nt, Artificial Sequence
  Synthetic
cgugcggcggggcggccgcgccc

SEQ ID NO: 10373 - RNA, 24 nt, Artificial Sequence
  Synthetic
gcgugcggcggggcggccgcgccc

SEQ ID NO: 10374 - RNA, 18 nt, Artificial Sequence
  Synthetic
cgcggcgcucaggcgccc

SEQ ID NO: 10375 - RNA, 19 nt, Artificial Sequence
  Synthetic
gcgcggcgcucaggcgccc

SEQ ID NO: 10376 - RNA, 20 nt, Artificial Sequence
  Synthetic
ggcgcggcgcucaggcgccc

SEQ ID NO: 10377 - RNA, 21 nt, Artificial Sequence
  Synthetic
gggcgcggcgcucaggcgccc

SEQ ID NO: 10378 - RNA, 22 nt, Artificial Sequence
  Synthetic
cgggcgcggcgcucaggcgccc

SEQ ID NO: 10379 - RNA, 23 nt, Artificial Sequence
  Synthetic
gcgggcgcggcgcucaggcgccc

SEQ ID NO: 10380 - RNA, 24 nt, Artificial Sequence
  Synthetic
ggcgggcgcggcgcucaggcgccc

SEQ ID NO: 10381 - RNA, 18 nt, Artificial Sequence
  Synthetic
ugagcucggccacggccc

SEQ ID NO: 10382 - RNA, 19 nt, Artificial Sequence
  Synthetic
gugagcucggccacggccc

SEQ ID NO: 10383 - RNA, 20 nt, Artificial Sequence
  Synthetic
cgugagcucggccacggccc

SEQ ID NO: 10384 - RNA, 21 nt, Artificial Sequence
  Synthetic
ccgugagcucggccacggccc

SEQ ID NO: 10385 - RNA, 22 nt, Artificial Sequence
  Synthetic
uccgugagcucggccacggccc

SEQ ID NO: 10386 - RNA, 23 nt, Artificial Sequence
  Synthetic
guccgugagcucggccacggccc

SEQ ID NO: 10387 - RNA, 24 nt, Artificial Sequence
  Synthetic
gguccgugagcucggccacggccc

SEQ ID NO: 10388 - RNA, 18 nt, Artificial Sequence
  Synthetic
ggcggcggcgggcuuccc

SEQ ID NO: 10389 - RNA, 19 nt, Artificial Sequence
  Synthetic
cggcggcggcgggcuuccc

SEQ ID NO: 10390 - RNA, 20 nt, Artificial Sequence
  Synthetic
gcggcggcggcgggcuuccc

SEQ ID NO: 10391 - RNA, 21 nt, Artificial Sequence
  Synthetic
ggcggcggcggcgggcuuccc

SEQ ID NO: 10392 - RNA, 22 nt, Artificial Sequence
  Synthetic
cggcggcggcggcgggcuuccc

SEQ ID NO: 10393 - RNA, 23 nt, Artificial Sequence
  Synthetic
gcggcggcggcggcgggcuuccc

SEQ ID NO: 10394 - RNA, 24 nt, Artificial Sequence
  Synthetic
ggcggcggcggcggcgggcuuccc

SEQ ID NO: 10395 - RNA, 18 nt, Artificial Sequence
  Synthetic
ggcggcgggcgcgccgcc

SEQ ID NO: 10396 - RNA, 19 nt, Artificial Sequence
  Synthetic
aggcggcgggcgcgccgcc

SEQ ID NO: 10397 - RNA, 20 nt, Artificial Sequence
  Synthetic
aaggcggcgggcgcgccgcc

SEQ ID NO: 10398 - RNA, 21 nt, Artificial Sequence
  Synthetic
gaaggcggcgggcgcgccgcc

SEQ ID NO: 10399 - RNA, 22 nt, Artificial Sequence
  Synthetic
cgaaggcggcgggcgcgccgcc

SEQ ID NO: 10400 - RNA, 23 nt, Artificial Sequence
  Synthetic
ccgaaggcggcgggcgcgccgcc

SEQ ID NO: 10401 - RNA, 24 nt, Artificial Sequence
  Synthetic
gccgaaggcggcgggcgcgccgcc

SEQ ID NO: 10402 - RNA, 18 nt, Artificial Sequence
  Synthetic
gcccgcgccuccuccgcc

SEQ ID NO: 10403 - RNA, 19 nt, Artificial Sequence
  Synthetic
ggcccgcgccuccuccgcc

SEQ ID NO: 10404 - RNA, 20 nt, Artificial Sequence
  Synthetic
gggcccgcgccuccuccgcc

SEQ ID NO: 10405 - RNA, 21 nt, Artificial Sequence
  Synthetic
cgggcccgcgccuccuccgcc

SEQ ID NO: 10406 - RNA, 22 nt, Artificial Sequence
  Synthetic
ccgggcccgcgccuccuccgcc

SEQ ID NO: 10407 - RNA, 23 nt, Artificial Sequence
  Synthetic
accgggcccgcgccuccuccgcc

SEQ ID NO: 10408 - RNA, 24 nt, Artificial Sequence
  Synthetic
aaccgggcccgcgccuccuccgcc

SEQ ID NO: 10409 - RNA, 18 nt, Artificial Sequence
  Synthetic
gcccggccguccagcgcc

SEQ ID NO: 10410 - RNA, 19 nt, Artificial Sequence
  Synthetic
ggcccggccguccagcgcc

SEQ ID NO: 10411 - RNA, 20 nt, Artificial Sequence
  Synthetic
cggcccggccguccagcgcc

SEQ ID NO: 10412 - RNA, 21 nt, Artificial Sequence
  Synthetic
gcggcccggccguccagcgcc

SEQ ID NO: 10413 - RNA, 22 nt, Artificial Sequence
  Synthetic
ggcggcccggccguccagcgcc

SEQ ID NO: 10414 - RNA, 23 nt, Artificial Sequence
  Synthetic
cggcggcccggccguccagcgcc

SEQ ID NO: 10415 - RNA, 24 nt, Artificial Sequence
  Synthetic
gcggcggcccggccguccagcgcc

SEQ ID NO: 10416 - RNA, 18 nt, Artificial Sequence
  Synthetic
ggccggcgggucagcgcc

SEQ ID NO: 10417 - RNA, 19 nt, Artificial Sequence
  Synthetic
gggccggcgggucagcgcc

SEQ ID NO: 10418 - RNA, 20 nt, Artificial Sequence
  Synthetic
cgggccggcgggucagcgcc

SEQ ID NO: 10419 - RNA, 21 nt, Artificial Sequence
  Synthetic
gcgggccggcgggucagcgcc

SEQ ID NO: 10420 - RNA, 22 nt, Artificial Sequence
  Synthetic
ggcgggccggcgggucagcgcc

SEQ ID NO: 10421 - RNA, 23 nt, Artificial Sequence
  Synthetic
cggcgggccggcgggucagcgcc

SEQ ID NO: 10422 - RNA, 24 nt, Artificial Sequence
  Synthetic
ucggcgggccggcgggucagcgcc

SEQ ID NO: 10423 - RNA, 18 nt, Artificial Sequence
  Synthetic
cgccguacagcacgcgcc

SEQ ID NO: 10424 - RNA, 19 nt, Artificial Sequence
  Synthetic
ccgccguacagcacgcgcc

SEQ ID NO: 10425 - RNA, 20 nt, Artificial Sequence
  Synthetic
cccgccguacagcacgcgcc

SEQ ID NO: 10426 - RNA, 21 nt, Artificial Sequence
  Synthetic
gcccgccguacagcacgcgcc

SEQ ID NO: 10427 - RNA, 22 nt, Artificial Sequence
  Synthetic
agcccgccguacagcacgcgcc

SEQ ID NO: 10428 - RNA, 23 nt, Artificial Sequence
  Synthetic
cagcccgccguacagcacgcgcc

SEQ ID NO: 10429 - RNA, 24 nt, Artificial Sequence
  Synthetic
ccagcccgccguacagcacgcgcc

SEQ ID NO: 10430 - RNA, 18 nt, Artificial Sequence
  Synthetic
aggcggcccgcggucgcc

SEQ ID NO: 10431 - RNA, 19 nt, Artificial Sequence
  Synthetic
caggcggcccgcggucgcc

SEQ ID NO: 10432 - RNA, 20 nt, Artificial Sequence
  Synthetic
ccaggcggcccgcggucgcc

SEQ ID NO: 10433 - RNA, 21 nt, Artificial Sequence
  Synthetic
uccaggcggcccgcggucgcc

SEQ ID NO: 10434 - RNA, 22 nt, Artificial Sequence
  Synthetic
cuccaggcggcccgcggucgcc

SEQ ID NO: 10435 - RNA, 23 nt, Artificial Sequence
  Synthetic
gcuccaggcggcccgcggucgcc

SEQ ID NO: 10436 - RNA, 24 nt, Artificial Sequence
  Synthetic
cgcuccaggcggcccgcggucgcc

SEQ ID NO: 10437 - RNA, 18 nt, Artificial Sequence
  Synthetic
gccggggcgcccgaggcc

SEQ ID NO: 10438 - RNA, 19 nt, Artificial Sequence
  Synthetic
cgccggggcgcccgaggcc

SEQ ID NO: 10439 - RNA, 20 nt, Artificial Sequence
  Synthetic
gcgccggggcgcccgaggcc

SEQ ID NO: 10440 - RNA, 21 nt, Artificial Sequence
  Synthetic
ggcgccggggcgcccgaggcc

SEQ ID NO: 10441 - RNA, 22 nt, Artificial Sequence
  Synthetic
gggcgccggggcgcccgaggcc

SEQ ID NO: 10442 - RNA, 23 nt, Artificial Sequence
  Synthetic
cgggcgccggggcgcccgaggcc

SEQ ID NO: 10443 - RNA, 24 nt, Artificial Sequence
  Synthetic
acgggcgccggggcgcccgaggcc

SEQ ID NO: 10444 - RNA, 18 nt, Artificial Sequence
  Synthetic
cgccggggccgcccggcc

SEQ ID NO: 10445 - RNA, 19 nt, Artificial Sequence
  Synthetic
ccgccggggccgcccggcc

SEQ ID NO: 10446 - RNA, 20 nt, Artificial Sequence
  Synthetic
cccgccggggccgcccggcc

SEQ ID NO: 10447 - RNA, 21 nt, Artificial Sequence
  Synthetic
acccgccggggccgcccggcc

SEQ ID NO: 10448 - RNA, 22 nt, Artificial Sequence
  Synthetic
gacccgccggggccgcccggcc

SEQ ID NO: 10449 - RNA, 23 nt, Artificial Sequence
  Synthetic
cgacccgccggggccgcccggcc

SEQ ID NO: 10450 - RNA, 24 nt, Artificial Sequence
  Synthetic
ucgacccgccggggccgcccggcc

SEQ ID NO: 10451 - RNA, 18 nt, Artificial Sequence
  Synthetic
gggggcggggggccggcc

SEQ ID NO: 10452 - RNA, 19 nt, Artificial Sequence
  Synthetic
cgggggcggggggccggcc

SEQ ID NO: 10453 - RNA, 20 nt, Artificial Sequence
  Synthetic
ccgggggcggggggccggcc

SEQ ID NO: 10454 - RNA, 21 nt, Artificial Sequence
  Synthetic
cccgggggcggggggccggcc

SEQ ID NO: 10455 - RNA, 22 nt, Artificial Sequence
  Synthetic
ccccgggggcggggggccggcc

SEQ ID NO: 10456 - RNA, 23 nt, Artificial Sequence
  Synthetic
gccccgggggcggggggccggcc

SEQ ID NO: 10457 - RNA, 24 nt, Artificial Sequence
  Synthetic
cgccccgggggcggggggccggcc

SEQ ID NO: 10458 - RNA, 18 nt, Artificial Sequence
  Synthetic
gccuccagggcggcggcc

SEQ ID NO: 10459 - RNA, 19 nt, Artificial Sequence
  Synthetic
ggccuccagggcggcggcc

SEQ ID NO: 10460 - RNA, 20 nt, Artificial Sequence
  Synthetic
aggccuccagggcggcggcc

SEQ ID NO: 10461 - RNA, 21 nt, Artificial Sequence
  Synthetic
uaggccuccagggcggcggcc

SEQ ID NO: 10462 - RNA, 22 nt, Artificial Sequence
  Synthetic
guaggccuccagggcggcggcc

SEQ ID NO: 10463 - RNA, 23 nt, Artificial Sequence
  Synthetic
aguaggccuccagggcggcggcc

SEQ ID NO: 10464 - RNA, 24 nt, Artificial Sequence
  Synthetic
caguaggccuccagggcggcggcc

SEQ ID NO: 10465 - RNA, 18 nt, Artificial Sequence
  Synthetic
cccgcgggaggggcggcc

SEQ ID NO: 10466 - RNA, 19 nt, Artificial Sequence
  Synthetic
ccccgcgggaggggcggcc

SEQ ID NO: 10467 - RNA, 20 nt, Artificial Sequence
  Synthetic
cccccgcgggaggggcggcc

SEQ ID NO: 10468 - RNA, 21 nt, Artificial Sequence
  Synthetic
gcccccgcgggaggggcggcc

SEQ ID NO: 10469 - RNA, 22 nt, Artificial Sequence
  Synthetic
ggcccccgcgggaggggcggcc

SEQ ID NO: 10470 - RNA, 23 nt, Artificial Sequence
  Synthetic
cggcccccgcgggaggggcggcc

SEQ ID NO: 10471 - RNA, 24 nt, Artificial Sequence
  Synthetic
gcggcccccgcgggaggggcggcc

SEQ ID NO: 10472 - RNA, 18 nt, Artificial Sequence
  Synthetic
gccggggcgggcucggcc

SEQ ID NO: 10473 - RNA, 19 nt, Artificial Sequence
  Synthetic
ggccggggcgggcucggcc

SEQ ID NO: 10474 - RNA, 20 nt, Artificial Sequence
  Synthetic
gggccggggcgggcucggcc

SEQ ID NO: 10475 - RNA, 21 nt, Artificial Sequence
  Synthetic
cgggccggggcgggcucggcc

SEQ ID NO: 10476 - RNA, 22 nt, Artificial Sequence
  Synthetic
ccgggccggggcgggcucggcc

SEQ ID NO: 10477 - RNA, 23 nt, Artificial Sequence
  Synthetic
uccgggccggggcgggcucggcc

SEQ ID NO: 10478 - RNA, 24 nt, Artificial Sequence
  Synthetic
guccgggccggggcgggcucggcc

SEQ ID NO: 10479 - RNA, 18 nt, Artificial Sequence
  Synthetic
ccgcggcagcgccgggcc

SEQ ID NO: 10480 - RNA, 19 nt, Artificial Sequence
  Synthetic
uccgcggcagcgccgggcc

SEQ ID NO: 10481 - RNA, 20 nt, Artificial Sequence
  Synthetic
cuccgcggcagcgccgggcc

SEQ ID NO: 10482 - RNA, 21 nt, Artificial Sequence
  Synthetic
gcuccgcggcagcgccgggcc

SEQ ID NO: 10483 - RNA, 22 nt, Artificial Sequence
  Synthetic
ggcuccgcggcagcgccgggcc

SEQ ID NO: 10484 - RNA, 23 nt, Artificial Sequence
  Synthetic
gggcuccgcggcagcgccgggcc

SEQ ID NO: 10485 - RNA, 24 nt, Artificial Sequence
  Synthetic
cgggcuccgcggcagcgccgggcc

SEQ ID NO: 10486 - RNA, 18 nt, Artificial Sequence
  Synthetic
cggccgcgcccgcgggcc

SEQ ID NO: 10487 - RNA, 19 nt, Artificial Sequence
  Synthetic
gcggccgcgcccgcgggcc

SEQ ID NO: 10488 - RNA, 20 nt, Artificial Sequence
  Synthetic
ggcggccgcgcccgcgggcc

SEQ ID NO: 10489 - RNA, 21 nt, Artificial Sequence
  Synthetic
gggcggccgcgcccgcgggcc

SEQ ID NO: 10490 - RNA, 22 nt, Artificial Sequence
  Synthetic
ggggcggccgcgcccgcgggcc

SEQ ID NO: 10491 - RNA, 23 nt, Artificial Sequence
  Synthetic
cggggcggccgcgcccgcgggcc

SEQ ID NO: 10492 - RNA, 24 nt, Artificial Sequence
  Synthetic
gcggggcggccgcgcccgcgggcc

SEQ ID NO: 10493 - RNA, 18 nt, Artificial Sequence
  Synthetic
cgcggcgacaggcuggcc

SEQ ID NO: 10494 - RNA, 19 nt, Artificial Sequence
  Synthetic
ucgcggcgacaggcuggcc

SEQ ID NO: 10495 - RNA, 20 nt, Artificial Sequence
  Synthetic
gucgcggcgacaggcuggcc

SEQ ID NO: 10496 - RNA, 21 nt, Artificial Sequence
  Synthetic
ggucgcggcgacaggcuggcc

SEQ ID NO: 10497 - RNA, 22 nt, Artificial Sequence
  Synthetic
gggucgcggcgacaggcuggcc

SEQ ID NO: 10498 - RNA, 23 nt, Artificial Sequence
  Synthetic
ggggucgcggcgacaggcuggcc

SEQ ID NO: 10499 - RNA, 24 nt, Artificial Sequence
  Synthetic
gggggucgcggcgacaggcuggcc

SEQ ID NO: 10500 - RNA, 18 nt, Artificial Sequence
  Synthetic
ccagguaggcgugcugcc

SEQ ID NO: 10501 - RNA, 19 nt, Artificial Sequence
  Synthetic
gccagguaggcgugcugcc

SEQ ID NO: 10502 - RNA, 20 nt, Artificial Sequence
  Synthetic
ggccagguaggcgugcugcc

SEQ ID NO: 10503 - RNA, 21 nt, Artificial Sequence
  Synthetic
aggccagguaggcgugcugcc

SEQ ID NO: 10504 - RNA, 22 nt, Artificial Sequence
  Synthetic
caggccagguaggcgugcugcc

SEQ ID NO: 10505 - RNA, 23 nt, Artificial Sequence
  Synthetic
gcaggccagguaggcgugcugcc

SEQ ID NO: 10506 - RNA, 24 nt, Artificial Sequence
  Synthetic
cgcaggccagguaggcgugcugcc

SEQ ID NO: 10507 - RNA, 18 nt, Artificial Sequence
  Synthetic
cccgcagagccgguugcc

SEQ ID NO: 10508 - RNA, 19 nt, Artificial Sequence
  Synthetic
gcccgcagagccgguugcc

SEQ ID NO: 10509 - RNA, 20 nt, Artificial Sequence
  Synthetic
ggcccgcagagccgguugcc

SEQ ID NO: 10510 - RNA, 21 nt, Artificial Sequence
  Synthetic
gggcccgcagagccgguugcc

SEQ ID NO: 10511 - RNA, 22 nt, Artificial Sequence
  Synthetic
cgggcccgcagagccgguugcc

SEQ ID NO: 10512 - RNA, 23 nt, Artificial Sequence
  Synthetic
gcgggcccgcagagccgguugcc

SEQ ID NO: 10513 - RNA, 24 nt, Artificial Sequence
  Synthetic
ggcgggcccgcagagccgguugcc

SEQ ID NO: 10514 - RNA, 18 nt, Artificial Sequence
  Synthetic
cgcucggcggaccacucc

SEQ ID NO: 10515 - RNA, 19 nt, Artificial Sequence
  Synthetic
gcgcucggcggaccacucc

SEQ ID NO: 10516 - RNA, 20 nt, Artificial Sequence
  Synthetic
cgcgcucggcggaccacucc

SEQ ID NO: 10517 - RNA, 21 nt, Artificial Sequence
  Synthetic
ccgcgcucggcggaccacucc

SEQ ID NO: 10518 - RNA, 22 nt, Artificial Sequence
  Synthetic
gccgcgcucggcggaccacucc

SEQ ID NO: 10519 - RNA, 23 nt, Artificial Sequence
  Synthetic
cgccgcgcucggcggaccacucc

SEQ ID NO: 10520 - RNA, 24 nt, Artificial Sequence
  Synthetic
ccgccgcgcucggcggaccacucc

SEQ ID NO: 10521 - RNA, 18 nt, Artificial Sequence
  Synthetic
ugguccagcgccacgucc

SEQ ID NO: 10522 - RNA, 19 nt, Artificial Sequence
  Synthetic
cugguccagcgccacgucc

SEQ ID NO: 10523 - RNA, 20 nt, Artificial Sequence
  Synthetic
ccugguccagcgccacgucc

SEQ ID NO: 10524 - RNA, 21 nt, Artificial Sequence
  Synthetic
gccugguccagcgccacgucc

SEQ ID NO: 10525 - RNA, 22 nt, Artificial Sequence
  Synthetic
ggccugguccagcgccacgucc

SEQ ID NO: 10526 - RNA, 23 nt, Artificial Sequence
  Synthetic
aggccugguccagcgccacgucc

SEQ ID NO: 10527 - RNA, 24 nt, Artificial Sequence
  Synthetic
caggccugguccagcgccacgucc

SEQ ID NO: 10528 - RNA, 18 nt, Artificial Sequence
  Synthetic
ggacgucgucuccggucc

SEQ ID NO: 10529 - RNA, 19 nt, Artificial Sequence
  Synthetic
cggacgucgucuccggucc

SEQ ID NO: 10530 - RNA, 20 nt, Artificial Sequence
  Synthetic
gcggacgucgucuccggucc

SEQ ID NO: 10531 - RNA, 21 nt, Artificial Sequence
  Synthetic
cgcggacgucgucuccggucc

SEQ ID NO: 10532 - RNA, 22 nt, Artificial Sequence
  Synthetic
ccgcggacgucgucuccggucc

SEQ ID NO: 10533 - RNA, 23 nt, Artificial Sequence
  Synthetic
accgcggacgucgucuccggucc

SEQ ID NO: 10534 - RNA, 24 nt, Artificial Sequence
  Synthetic
gaccgcggacgucgucuccggucc

SEQ ID NO: 10535 - RNA, 18 nt, Artificial Sequence
  Synthetic
gggaagagcggguggucc

SEQ ID NO: 10536 - RNA, 19 nt, Artificial Sequence
  Synthetic
ggggaagagcggguggucc

SEQ ID NO: 10537 - RNA, 20 nt, Artificial Sequence
  Synthetic
cggggaagagcggguggucc

SEQ ID NO: 10538 - RNA, 21 nt, Artificial Sequence
  Synthetic
gcggggaagagcggguggucc

SEQ ID NO: 10539 - RNA, 22 nt, Artificial Sequence
  Synthetic
cgcggggaagagcggguggucc

SEQ ID NO: 10540 - RNA, 23 nt, Artificial Sequence
  Synthetic
gcgcggggaagagcggguggucc

SEQ ID NO: 10541 - RNA, 24 nt, Artificial Sequence
  Synthetic
ggcgcggggaagagcggguggucc

SEQ ID NO: 10542 - RNA, 18 nt, Artificial Sequence
  Synthetic
agcuccgcguccaugucc

SEQ ID NO: 10543 - RNA, 19 nt, Artificial Sequence
  Synthetic
cagcuccgcguccaugucc

SEQ ID NO: 10544 - RNA, 20 nt, Artificial Sequence
  Synthetic
ccagcuccgcguccaugucc

SEQ ID NO: 10545 - RNA, 21 nt, Artificial Sequence
  Synthetic
uccagcuccgcguccaugucc

SEQ ID NO: 10546 - RNA, 22 nt, Artificial Sequence
  Synthetic
cuccagcuccgcguccaugucc

SEQ ID NO: 10547 - RNA, 23 nt, Artificial Sequence
  Synthetic
ccuccagcuccgcguccaugucc

SEQ ID NO: 10548 - RNA, 24 nt, Artificial Sequence
  Synthetic
uccuccagcuccgcguccaugucc

SEQ ID NO: 10549 - RNA, 18 nt, Artificial Sequence
  Synthetic
ucgucgcgcagcaccagc

SEQ ID NO: 10550 - RNA, 19 nt, Artificial Sequence
  Synthetic
gucgucgcgcagcaccagc

SEQ ID NO: 10551 - RNA, 20 nt, Artificial Sequence
  Synthetic
cgucgucgcgcagcaccagc

SEQ ID NO: 10552 - RNA, 21 nt, Artificial Sequence
  Synthetic
gcgucgucgcgcagcaccagc

SEQ ID NO: 10553 - RNA, 22 nt, Artificial Sequence
  Synthetic
cgcgucgucgcgcagcaccagc

SEQ ID NO: 10554 - RNA, 23 nt, Artificial Sequence
  Synthetic
ccgcgucgucgcgcagcaccagc

SEQ ID NO: 10555 - RNA, 24 nt, Artificial Sequence
  Synthetic
uccgcgucgucgcgcagcaccagc

SEQ ID NO: 10556 - RNA, 18 nt, Artificial Sequence
  Synthetic
ugcgccgcgucgcccagc

SEQ ID NO: 10557 - RNA, 19 nt, Artificial Sequence
  Synthetic
cugcgccgcgucgcccagc

SEQ ID NO: 10558 - RNA, 20 nt, Artificial Sequence
  Synthetic
gcugcgccgcgucgcccagc

SEQ ID NO: 10559 - RNA, 21 nt, Artificial Sequence
  Synthetic
ugcugcgccgcgucgcccagc

SEQ ID NO: 10560 - RNA, 22 nt, Artificial Sequence
  Synthetic
cugcugcgccgcgucgcccagc

SEQ ID NO: 10561 - RNA, 23 nt, Artificial Sequence
  Synthetic
acugcugcgccgcgucgcccagc

SEQ ID NO: 10562 - RNA, 24 nt, Artificial Sequence
  Synthetic
uacugcugcgccgcgucgcccagc

SEQ ID NO: 10563 - RNA, 18 nt, Artificial Sequence
  Synthetic
gcguucucgcgcgccagc

SEQ ID NO: 10564 - RNA, 19 nt, Artificial Sequence
  Synthetic
cgcguucucgcgcgccagc

SEQ ID NO: 10565 - RNA, 20 nt, Artificial Sequence
  Synthetic
ccgcguucucgcgcgccagc

SEQ ID NO: 10566 - RNA, 21 nt, Artificial Sequence
  Synthetic
gccgcguucucgcgcgccagc

SEQ ID NO: 10567 - RNA, 22 nt, Artificial Sequence
  Synthetic
cgccgcguucucgcgcgccagc

SEQ ID NO: 10568 - RNA, 23 nt, Artificial Sequence
  Synthetic
gcgccgcguucucgcgcgccagc

SEQ ID NO: 10569 - RNA, 24 nt, Artificial Sequence
  Synthetic
agcgccgcguucucgcgcgccagc

SEQ ID NO: 10570 - RNA, 18 nt, Artificial Sequence
  Synthetic
gcgacggugucggccagc

SEQ ID NO: 10571 - RNA, 19 nt, Artificial Sequence
  Synthetic
ggcgacggugucggccagc

SEQ ID NO: 10572 - RNA, 20 nt, Artificial Sequence
  Synthetic
cggcgacggugucggccagc

SEQ ID NO: 10573 - RNA, 21 nt, Artificial Sequence
  Synthetic
gcggcgacggugucggccagc

SEQ ID NO: 10574 - RNA, 22 nt, Artificial Sequence
  Synthetic
cgcggcgacggugucggccagc

SEQ ID NO: 10575 - RNA, 23 nt, Artificial Sequence
  Synthetic
ccgcggcgacggugucggccagc

SEQ ID NO: 10576 - RNA, 24 nt, Artificial Sequence
  Synthetic
gccgcggcgacggugucggccagc

SEQ ID NO: 10577 - RNA, 18 nt, Artificial Sequence
  Synthetic
cggcgcaggcuggucagc

SEQ ID NO: 10578 - RNA, 19 nt, Artificial Sequence
  Synthetic
gcggcgcaggcuggucagc

SEQ ID NO: 10579 - RNA, 20 nt, Artificial Sequence
  Synthetic
cgcggcgcaggcuggucagc

SEQ ID NO: 10580 - RNA, 21 nt, Artificial Sequence
  Synthetic
gcgcggcgcaggcuggucagc

SEQ ID NO: 10581 - RNA, 22 nt, Artificial Sequence
  Synthetic
ggcgcggcgcaggcuggucagc

SEQ ID NO: 10582 - RNA, 23 nt, Artificial Sequence
  Synthetic
aggcgcggcgcaggcuggucagc

SEQ ID NO: 10583 - RNA, 24 nt, Artificial Sequence
  Synthetic
uaggcgcggcgcaggcuggucagc

SEQ ID NO: 10584 - RNA, 18 nt, Artificial Sequence
  Synthetic
gcguccagcucgacccgc

SEQ ID NO: 10585 - RNA, 19 nt, Artificial Sequence
  Synthetic
ggcguccagcucgacccgc

SEQ ID NO: 10586 - RNA, 20 nt, Artificial Sequence
  Synthetic
cggcguccagcucgacccgc

SEQ ID NO: 10587 - RNA, 21 nt, Artificial Sequence
  Synthetic
ucggcguccagcucgacccgc

SEQ ID NO: 10588 - RNA, 22 nt, Artificial Sequence
  Synthetic
gucggcguccagcucgacccgc

SEQ ID NO: 10589 - RNA, 23 nt, Artificial Sequence
  Synthetic
cgucggcguccagcucgacccgc

SEQ ID NO: 10590 - RNA, 24 nt, Artificial Sequence
  Synthetic
gcgucggcguccagcucgacccgc

SEQ ID NO: 10591 - RNA, 18 nt, Artificial Sequence
  Synthetic
ggggggcgcggcccccgc

SEQ ID NO: 10592 - RNA, 19 nt, Artificial Sequence
  Synthetic
cggggggcgcggcccccgc

SEQ ID NO: 10593 - RNA, 20 nt, Artificial Sequence
  Synthetic
gcggggggcgcggcccccgc

SEQ ID NO: 10594 - RNA, 21 nt, Artificial Sequence
  Synthetic
ggcggggggcgcggcccccgc

SEQ ID NO: 10595 - RNA, 22 nt, Artificial Sequence
  Synthetic
gggcggggggcgcggcccccgc

SEQ ID NO: 10596 - RNA, 23 nt, Artificial Sequence
  Synthetic
ggggcggggggcgcggcccccgc

SEQ ID NO: 10597 - RNA, 24 nt, Artificial Sequence
  Synthetic
cggggcggggggcgcggcccccgc

SEQ ID NO: 10598 - RNA, 18 nt, Artificial Sequence
  Synthetic
gcgaaggccaggucccgc

SEQ ID NO: 10599 - RNA, 19 nt, Artificial Sequence
  Synthetic
ggcgaaggccaggucccgc

SEQ ID NO: 10600 - RNA, 20 nt, Artificial Sequence
  Synthetic
cggcgaaggccaggucccgc

SEQ ID NO: 10601 - RNA, 21 nt, Artificial Sequence
  Synthetic
ccggcgaaggccaggucccgc

SEQ ID NO: 10602 - RNA, 22 nt, Artificial Sequence
  Synthetic
gccggcgaaggccaggucccgc

SEQ ID NO: 10603 - RNA, 23 nt, Artificial Sequence
  Synthetic
cgccggcgaaggccaggucccgc

SEQ ID NO: 10604 - RNA, 24 nt, Artificial Sequence
  Synthetic
gcgccggcgaaggccaggucccgc

SEQ ID NO: 10605 - RNA, 18 nt, Artificial Sequence
  Synthetic
gcggccggccaccgccgc

SEQ ID NO: 10606 - RNA, 19 nt, Artificial Sequence
  Synthetic
cgcggccggccaccgccgc

SEQ ID NO: 10607 - RNA, 20 nt, Artificial Sequence
  Synthetic
ucgcggccggccaccgccgc

SEQ ID NO: 10608 - RNA, 21 nt, Artificial Sequence
  Synthetic
gucgcggccggccaccgccgc

SEQ ID NO: 10609 - RNA, 22 nt, Artificial Sequence
  Synthetic
cgucgcggccggccaccgccgc

SEQ ID NO: 10610 - RNA, 23 nt, Artificial Sequence
  Synthetic
gcgucgcggccggccaccgccgc

SEQ ID NO: 10611 - RNA, 24 nt, Artificial Sequence
  Synthetic
ggcgucgcggccggccaccgccgc

SEQ ID NO: 10612 - RNA, 18 nt, Artificial Sequence
  Synthetic
aggcggcgggcgcgccgc

SEQ ID NO: 10613 - RNA, 19 nt, Artificial Sequence
  Synthetic
aaggcggcgggcgcgccgc

SEQ ID NO: 10614 - RNA, 20 nt, Artificial Sequence
  Synthetic
gaaggcggcgggcgcgccgc

SEQ ID NO: 10615 - RNA, 21 nt, Artificial Sequence
  Synthetic
cgaaggcggcgggcgcgccgc

SEQ ID NO: 10616 - RNA, 22 nt, Artificial Sequence
  Synthetic
ccgaaggcggcgggcgcgccgc

SEQ ID NO: 10617 - RNA, 23 nt, Artificial Sequence
  Synthetic
gccgaaggcggcgggcgcgccgc

SEQ ID NO: 10618 - RNA, 24 nt, Artificial Sequence
  Synthetic
ggccgaaggcggcgggcgcgccgc

SEQ ID NO: 10619 - RNA, 18 nt, Artificial Sequence
  Synthetic
ggcccggccguccagcgc

SEQ ID NO: 10620 - RNA, 19 nt, Artificial Sequence
  Synthetic
cggcccggccguccagcgc

SEQ ID NO: 10621 - RNA, 20 nt, Artificial Sequence
  Synthetic
gcggcccggccguccagcgc

SEQ ID NO: 10622 - RNA, 21 nt, Artificial Sequence
  Synthetic
ggcggcccggccguccagcgc

SEQ ID NO: 10623 - RNA, 22 nt, Artificial Sequence
  Synthetic
cggcggcccggccguccagcgc

SEQ ID NO: 10624 - RNA, 23 nt, Artificial Sequence
  Synthetic
gcggcggcccggccguccagcgc

SEQ ID NO: 10625 - RNA, 24 nt, Artificial Sequence
  Synthetic
ggcggcggcccggccguccagcgc

SEQ ID NO: 10626 - RNA, 18 nt, Artificial Sequence
  Synthetic
ugcgcggccuccacgcgc

SEQ ID NO: 10627 - RNA, 19 nt, Artificial Sequence
  Synthetic
gugcgcggccuccacgcgc

SEQ ID NO: 10628 - RNA, 20 nt, Artificial Sequence
  Synthetic
cgugcgcggccuccacgcgc

SEQ ID NO: 10629 - RNA, 21 nt, Artificial Sequence
  Synthetic
gcgugcgcggccuccacgcgc

SEQ ID NO: 10630 - RNA, 22 nt, Artificial Sequence
  Synthetic
cgcgugcgcggccuccacgcgc

SEQ ID NO: 10631 - RNA, 23 nt, Artificial Sequence
  Synthetic
gcgcgugcgcggccuccacgcgc

SEQ ID NO: 10632 - RNA, 24 nt, Artificial Sequence
  Synthetic
cgcgcgugcgcggccuccacgcgc

SEQ ID NO: 10633 - RNA, 18 nt, Artificial Sequence
  Synthetic
ccauggcgucgcccgcgc

SEQ ID NO: 10634 - RNA, 19 nt, Artificial Sequence
  Synthetic
gccauggcgucgcccgcgc

SEQ ID NO: 10635 - RNA, 20 nt, Artificial Sequence
  Synthetic
cgccauggcgucgcccgcgc

SEQ ID NO: 10636 - RNA, 21 nt, Artificial Sequence
  Synthetic
gcgccauggcgucgcccgcgc

SEQ ID NO: 10637 - RNA, 22 nt, Artificial Sequence
  Synthetic
ggcgccauggcgucgcccgcgc

SEQ ID NO: 10638 - RNA, 23 nt, Artificial Sequence
  Synthetic
gggcgccauggcgucgcccgcgc

SEQ ID NO: 10639 - RNA, 24 nt, Artificial Sequence
  Synthetic
cgggcgccauggcgucgcccgcgc

SEQ ID NO: 10640 - RNA, 18 nt, Artificial Sequence
  Synthetic
ugcuguugcgcgccgcgc

SEQ ID NO: 10641 - RNA, 19 nt, Artificial Sequence
  Synthetic
cugcuguugcgcgccgcgc

SEQ ID NO: 10642 - RNA, 20 nt, Artificial Sequence
  Synthetic
gcugcuguugcgcgccgcgc

SEQ ID NO: 10643 - RNA, 21 nt, Artificial Sequence
  Synthetic
agcugcuguugcgcgccgcgc

SEQ ID NO: 10644 - RNA, 22 nt, Artificial Sequence
  Synthetic
gagcugcuguugcgcgccgcgc

SEQ ID NO: 10645 - RNA, 23 nt, Artificial Sequence
  Synthetic
ggagcugcuguugcgcgccgcgc

SEQ ID NO: 10646 - RNA, 24 nt, Artificial Sequence
  Synthetic
aggagcugcuguugcgcgccgcgc

SEQ ID NO: 10647 - RNA, 18 nt, Artificial Sequence
  Synthetic
gcgcggcgguacucgcgc

SEQ ID NO: 10648 - RNA, 19 nt, Artificial Sequence
  Synthetic
ggcgcggcgguacucgcgc

SEQ ID NO: 10649 - RNA, 20 nt, Artificial Sequence
  Synthetic
cggcgcggcgguacucgcgc

SEQ ID NO: 10650 - RNA, 21 nt, Artificial Sequence
  Synthetic
acggcgcggcgguacucgcgc

SEQ ID NO: 10651 - RNA, 22 nt, Artificial Sequence
  Synthetic
cacggcgcggcgguacucgcgc

SEQ ID NO: 10652 - RNA, 23 nt, Artificial Sequence
  Synthetic
gcacggcgcggcgguacucgcgc

SEQ ID NO: 10653 - RNA, 24 nt, Artificial Sequence
  Synthetic
agcacggcgcggcgguacucgcgc

SEQ ID NO: 10654 - RNA, 18 nt, Artificial Sequence
  Synthetic
agcaccagcgcgucgcgc

SEQ ID NO: 10655 - RNA, 19 nt, Artificial Sequence
  Synthetic
cagcaccagcgcgucgcgc

SEQ ID NO: 10656 - RNA, 20 nt, Artificial Sequence
  Synthetic
ucagcaccagcgcgucgcgc

SEQ ID NO: 10657 - RNA, 21 nt, Artificial Sequence
  Synthetic
aucagcaccagcgcgucgcgc

SEQ ID NO: 10658 - RNA, 22 nt, Artificial Sequence
  Synthetic
caucagcaccagcgcgucgcgc

SEQ ID NO: 10659 - RNA, 23 nt, Artificial Sequence
  Synthetic
gcaucagcaccagcgcgucgcgc

SEQ ID NO: 10660 - RNA, 24 nt, Artificial Sequence
  Synthetic
cgcaucagcaccagcgcgucgcgc

SEQ ID NO: 10661 - RNA, 18 nt, Artificial Sequence
  Synthetic
agcgcgcguagaaggcgc

SEQ ID NO: 10662 - RNA, 19 nt, Artificial Sequence
  Synthetic
uagcgcgcguagaaggcgc

SEQ ID NO: 10663 - RNA, 20 nt, Artificial Sequence
  Synthetic
guagcgcgcguagaaggcgc

SEQ ID NO: 10664 - RNA, 21 nt, Artificial Sequence
  Synthetic
gguagcgcgcguagaaggcgc

SEQ ID NO: 10665 - RNA, 22 nt, Artificial Sequence
  Synthetic
cgguagcgcgcguagaaggcgc

SEQ ID NO: 10666 - RNA, 23 nt, Artificial Sequence
  Synthetic
gcgguagcgcgcguagaaggcgc

SEQ ID NO: 10667 - RNA, 24 nt, Artificial Sequence
  Synthetic
cgcgguagcgcgcguagaaggcgc

SEQ ID NO: 10668 - RNA, 18 nt, Artificial Sequence
  Synthetic
ggccgggcgccacggcgc

SEQ ID NO: 10669 - RNA, 19 nt, Artificial Sequence
  Synthetic
gggccgggcgccacggcgc

SEQ ID NO: 10670 - RNA, 20 nt, Artificial Sequence
  Synthetic
agggccgggcgccacggcgc

SEQ ID NO: 10671 - RNA, 21 nt, Artificial Sequence
  Synthetic
gagggccgggcgccacggcgc

SEQ ID NO: 10672 - RNA, 22 nt, Artificial Sequence
  Synthetic
ugagggccgggcgccacggcgc

SEQ ID NO: 10673 - RNA, 23 nt, Artificial Sequence
  Synthetic
augagggccgggcgccacggcgc

SEQ ID NO: 10674 - RNA, 24 nt, Artificial Sequence
  Synthetic
caugagggccgggcgccacggcgc

SEQ ID NO: 10675 - RNA, 18 nt, Artificial Sequence
  Synthetic
gggcgcccacacgggcgc

SEQ ID NO: 10676 - RNA, 19 nt, Artificial Sequence
  Synthetic
cgggcgcccacacgggcgc

SEQ ID NO: 10677 - RNA, 20 nt, Artificial Sequence
  Synthetic
ucgggcgcccacacgggcgc

SEQ ID NO: 10678 - RNA, 21 nt, Artificial Sequence
  Synthetic
cucgggcgcccacacgggcgc

SEQ ID NO: 10679 - RNA, 22 nt, Artificial Sequence
  Synthetic
gcucgggcgcccacacgggcgc

SEQ ID NO: 10680 - RNA, 23 nt, Artificial Sequence
  Synthetic
agcucgggcgcccacacgggcgc

SEQ ID NO: 10681 - RNA, 24 nt, Artificial Sequence
  Synthetic
cagcucgggcgcccacacgggcgc

SEQ ID NO: 10682 - RNA, 18 nt, Artificial Sequence
  Synthetic
cccgcgggccccgggcgc

SEQ ID NO: 10683 - RNA, 19 nt, Artificial Sequence
  Synthetic
gcccgcgggccccgggcgc

SEQ ID NO: 10684 - RNA, 20 nt, Artificial Sequence
  Synthetic
cgcccgcgggccccgggcgc

SEQ ID NO: 10685 - RNA, 21 nt, Artificial Sequence
  Synthetic
gcgcccgcgggccccgggcgc

SEQ ID NO: 10686 - RNA, 22 nt, Artificial Sequence
  Synthetic
cgcgcccgcgggccccgggcgc

SEQ ID NO: 10687 - RNA, 23 nt, Artificial Sequence
  Synthetic
ccgcgcccgcgggccccgggcgc

SEQ ID NO: 10688 - RNA, 24 nt, Artificial Sequence
  Synthetic
gccgcgcccgcgggccccgggcgc

SEQ ID NO: 10689 - RNA, 18 nt, Artificial Sequence
  Synthetic
acacgggcgccggggcgc

SEQ ID NO: 10690 - RNA, 19 nt, Artificial Sequence
  Synthetic
cacacgggcgccggggcgc

SEQ ID NO: 10691 - RNA, 20 nt, Artificial Sequence
  Synthetic
ccacacgggcgccggggcgc

SEQ ID NO: 10692 - RNA, 21 nt, Artificial Sequence
  Synthetic
cccacacgggcgccggggcgc

SEQ ID NO: 10693 - RNA, 22 nt, Artificial Sequence
  Synthetic
gcccacacgggcgccggggcgc

SEQ ID NO: 10694 - RNA, 23 nt, Artificial Sequence
  Synthetic
cgcccacacgggcgccggggcgc

SEQ ID NO: 10695 - RNA, 24 nt, Artificial Sequence
  Synthetic
gcgcccacacgggcgccggggcgc

SEQ ID NO: 10696 - RNA, 18 nt, Artificial Sequence
  Synthetic
guggugucggcggggcgc

SEQ ID NO: 10697 - RNA, 19 nt, Artificial Sequence
  Synthetic
gguggugucggcggggcgc

SEQ ID NO: 10698 - RNA, 20 nt, Artificial Sequence
  Synthetic
ugguggugucggcggggcgc

SEQ ID NO: 10699 - RNA, 21 nt, Artificial Sequence
  Synthetic
gugguggugucggcggggcgc

SEQ ID NO: 10700 - RNA, 22 nt, Artificial Sequence
  Synthetic
ggugguggugucggcggggcgc

SEQ ID NO: 10701 - RNA, 23 nt, Artificial Sequence
  Synthetic
uggugguggugucggcggggcgc

SEQ ID NO: 10702 - RNA, 24 nt, Artificial Sequence
  Synthetic
guggugguggugucggcggggcgc

SEQ ID NO: 10703 - RNA, 18 nt, Artificial Sequence
  Synthetic
cggcgcggcgguacucgc

SEQ ID NO: 10704 - RNA, 19 nt, Artificial Sequence
  Synthetic
acggcgcggcgguacucgc

SEQ ID NO: 10705 - RNA, 20 nt, Artificial Sequence
  Synthetic
cacggcgcggcgguacucgc

SEQ ID NO: 10706 - RNA, 21 nt, Artificial Sequence
  Synthetic
gcacggcgcggcgguacucgc

SEQ ID NO: 10707 - RNA, 22 nt, Artificial Sequence
  Synthetic
agcacggcgcggcgguacucgc

SEQ ID NO: 10708 - RNA, 23 nt, Artificial Sequence
  Synthetic
gagcacggcgcggcgguacucgc

SEQ ID NO: 10709 - RNA, 24 nt, Artificial Sequence
  Synthetic
ggagcacggcgcggcgguacucgc

SEQ ID NO: 10710 - RNA, 18 nt, Artificial Sequence
  Synthetic
cggcggagcucagcaggc

SEQ ID NO: 10711 - RNA, 19 nt, Artificial Sequence
  Synthetic
gcggcggagcucagcaggc

SEQ ID NO: 10712 - RNA, 20 nt, Artificial Sequence
  Synthetic
ggcggcggagcucagcaggc

SEQ ID NO: 10713 - RNA, 21 nt, Artificial Sequence
  Synthetic
cggcggcggagcucagcaggc

SEQ ID NO: 10714 - RNA, 22 nt, Artificial Sequence
  Synthetic
gcggcggcggagcucagcaggc

SEQ ID NO: 10715 - RNA, 23 nt, Artificial Sequence
  Synthetic
ggcggcggcggagcucagcaggc

SEQ ID NO: 10716 - RNA, 24 nt, Artificial Sequence
  Synthetic
cggcggcggcggagcucagcaggc

SEQ ID NO: 10717 - RNA, 18 nt, Artificial Sequence
  Synthetic
cgggcgccccccagaggc

SEQ ID NO: 10718 - RNA, 19 nt, Artificial Sequence
  Synthetic
ucgggcgccccccagaggc

SEQ ID NO: 10719 - RNA, 20 nt, Artificial Sequence
  Synthetic
cucgggcgccccccagaggc

SEQ ID NO: 10720 - RNA, 21 nt, Artificial Sequence
  Synthetic
ccucgggcgccccccagaggc

SEQ ID NO: 10721 - RNA, 22 nt, Artificial Sequence
  Synthetic
gccucgggcgccccccagaggc

SEQ ID NO: 10722 - RNA, 23 nt, Artificial Sequence
  Synthetic
cgccucgggcgccccccagaggc

SEQ ID NO: 10723 - RNA, 24 nt, Artificial Sequence
  Synthetic
ccgccucgggcgccccccagaggc

SEQ ID NO: 10724 - RNA, 18 nt, Artificial Sequence
  Synthetic
agggccgggcgccacggc

SEQ ID NO: 10725 - RNA, 19 nt, Artificial Sequence
  Synthetic
gagggccgggcgccacggc

SEQ ID NO: 10726 - RNA, 20 nt, Artificial Sequence
  Synthetic
ugagggccgggcgccacggc

SEQ ID NO: 10727 - RNA, 21 nt, Artificial Sequence
  Synthetic
augagggccgggcgccacggc

SEQ ID NO: 10728 - RNA, 22 nt, Artificial Sequence
  Synthetic
caugagggccgggcgccacggc

SEQ ID NO: 10729 - RNA, 23 nt, Artificial Sequence
  Synthetic
acaugagggccgggcgccacggc

SEQ ID NO: 10730 - RNA, 24 nt, Artificial Sequence
  Synthetic
aacaugagggccgggcgccacggc

SEQ ID NO: 10731 - RNA, 18 nt, Artificial Sequence
  Synthetic
cgcgcgaagacccccggc

SEQ ID NO: 10732 - RNA, 19 nt, Artificial Sequence
  Synthetic
gcgcgcgaagacccccggc

SEQ ID NO: 10733 - RNA, 20 nt, Artificial Sequence
  Synthetic
cgcgcgcgaagacccccggc

SEQ ID NO: 10734 - RNA, 21 nt, Artificial Sequence
  Synthetic
acgcgcgcgaagacccccggc

SEQ ID NO: 10735 - RNA, 22 nt, Artificial Sequence
  Synthetic
cacgcgcgcgaagacccccggc

SEQ ID NO: 10736 - RNA, 23 nt, Artificial Sequence
  Synthetic
ccacgcgcgcgaagacccccggc

SEQ ID NO: 10737 - RNA, 24 nt, Artificial Sequence
  Synthetic
uccacgcgcgcgaagacccccggc

SEQ ID NO: 10738 - RNA, 18 nt, Artificial Sequence
  Synthetic
aggcggccgagcgccggc

SEQ ID NO: 10739 - RNA, 19 nt, Artificial Sequence
  Synthetic
gaggcggccgagcgccggc

SEQ ID NO: 10740 - RNA, 20 nt, Artificial Sequence
  Synthetic
agaggcggccgagcgccggc

SEQ ID NO: 10741 - RNA, 21 nt, Artificial Sequence
  Synthetic
cagaggcggccgagcgccggc

SEQ ID NO: 10742 - RNA, 22 nt, Artificial Sequence
  Synthetic
ucagaggcggccgagcgccggc

SEQ ID NO: 10743 - RNA, 23 nt, Artificial Sequence
  Synthetic
gucagaggcggccgagcgccggc

SEQ ID NO: 10744 - RNA, 24 nt, Artificial Sequence
  Synthetic
agucagaggcggccgagcgccggc

SEQ ID NO: 10745 - RNA, 18 nt, Artificial Sequence
  Synthetic
ucgucggccccggccggc

SEQ ID NO: 10746 - RNA, 19 nt, Artificial Sequence
  Synthetic
gucgucggccccggccggc

SEQ ID NO: 10747 - RNA, 20 nt, Artificial Sequence
  Synthetic
cgucgucggccccggccggc

SEQ ID NO: 10748 - RNA, 21 nt, Artificial Sequence
  Synthetic
ucgucgucggccccggccggc

SEQ ID NO: 10749 - RNA, 22 nt, Artificial Sequence
  Synthetic
gucgucgucggccccggccggc

SEQ ID NO: 10750 - RNA, 23 nt, Artificial Sequence
  Synthetic
cgucgucgucggccccggccggc

SEQ ID NO: 10751 - RNA, 24 nt, Artificial Sequence
  Synthetic
ucgucgucgucggccccggccggc

SEQ ID NO: 10752 - RNA, 18 nt, Artificial Sequence
  Synthetic
ccggcccgaacacgcggc

SEQ ID NO: 10753 - RNA, 19 nt, Artificial Sequence
  Synthetic
cccggcccgaacacgcggc

SEQ ID NO: 10754 - RNA, 20 nt, Artificial Sequence
  Synthetic
ccccggcccgaacacgcggc

SEQ ID NO: 10755 - RNA, 21 nt, Artificial Sequence
  Synthetic
cccccggcccgaacacgcggc

SEQ ID NO: 10756 - RNA, 22 nt, Artificial Sequence
  Synthetic
acccccggcccgaacacgcggc

SEQ ID NO: 10757 - RNA, 23 nt, Artificial Sequence
  Synthetic
gacccccggcccgaacacgcggc

SEQ ID NO: 10758 - RNA, 24 nt, Artificial Sequence
  Synthetic
agacccccggcccgaacacgcggc

SEQ ID NO: 10759 - RNA, 18 nt, Artificial Sequence
  Synthetic
uugcgcgccucccgcggc

SEQ ID NO: 10760 - RNA, 19 nt, Artificial Sequence
  Synthetic
cuugcgcgccucccgcggc

SEQ ID NO: 10761 - RNA, 20 nt, Artificial Sequence
  Synthetic
gcuugcgcgccucccgcggc

SEQ ID NO: 10762 - RNA, 21 nt, Artificial Sequence
  Synthetic
cgcuugcgcgccucccgcggc

SEQ ID NO: 10763 - RNA, 22 nt, Artificial Sequence
  Synthetic
gcgcuugcgcgccucccgcggc

SEQ ID NO: 10764 - RNA, 23 nt, Artificial Sequence
  Synthetic
ugcgcuugcgcgccucccgcggc

SEQ ID NO: 10765 - RNA, 24 nt, Artificial Sequence
  Synthetic
uugcgcuugcgcgccucccgcggc

SEQ ID NO: 10766 - RNA, 18 nt, Artificial Sequence
  Synthetic
gcccugggcgggcucggc

SEQ ID NO: 10767 - RNA, 19 nt, Artificial Sequence
  Synthetic
ggcccugggcgggcucggc

SEQ ID NO: 10768 - RNA, 20 nt, Artificial Sequence
  Synthetic
cggcccugggcgggcucggc

SEQ ID NO: 10769 - RNA, 21 nt, Artificial Sequence
  Synthetic
ucggcccugggcgggcucggc

SEQ ID NO: 10770 - RNA, 22 nt, Artificial Sequence
  Synthetic
cucggcccugggcgggcucggc

SEQ ID NO: 10771 - RNA, 23 nt, Artificial Sequence
  Synthetic
gcucggcccugggcgggcucggc

SEQ ID NO: 10772 - RNA, 24 nt, Artificial Sequence
  Synthetic
ggcucggcccugggcgggcucggc

SEQ ID NO: 10773 - RNA, 18 nt, Artificial Sequence
  Synthetic
cgcccgcgggccccgggc

SEQ ID NO: 10774 - RNA, 19 nt, Artificial Sequence
  Synthetic
gcgcccgcgggccccgggc

SEQ ID NO: 10775 - RNA, 20 nt, Artificial Sequence
  Synthetic
cgcgcccgcgggccccgggc

SEQ ID NO: 10776 - RNA, 21 nt, Artificial Sequence
  Synthetic
ccgcgcccgcgggccccgggc

SEQ ID NO: 10777 - RNA, 22 nt, Artificial Sequence
  Synthetic
gccgcgcccgcgggccccgggc

SEQ ID NO: 10778 - RNA, 23 nt, Artificial Sequence
  Synthetic
ggccgcgcccgcgggccccgggc

SEQ ID NO: 10779 - RNA, 24 nt, Artificial Sequence
  Synthetic
cggccgcgcccgcgggccccgggc

SEQ ID NO: 10780 - RNA, 18 nt, Artificial Sequence
  Synthetic
cgccgcggggguccgggc

SEQ ID NO: 10781 - RNA, 19 nt, Artificial Sequence
  Synthetic
ucgccgcggggguccgggc

SEQ ID NO: 10782 - RNA, 20 nt, Artificial Sequence
  Synthetic
gucgccgcggggguccgggc

SEQ ID NO: 10783 - RNA, 21 nt, Artificial Sequence
  Synthetic
ggucgccgcggggguccgggc

SEQ ID NO: 10784 - RNA, 22 nt, Artificial Sequence
  Synthetic
cggucgccgcggggguccgggc

SEQ ID NO: 10785 - RNA, 23 nt, Artificial Sequence
  Synthetic
gcggucgccgcggggguccgggc

SEQ ID NO: 10786 - RNA, 24 nt, Artificial Sequence
  Synthetic
cgcggucgccgcggggguccgggc

SEQ ID NO: 10787 - RNA, 18 nt, Artificial Sequence
  Synthetic
ccgcgcggcgcagcgggc

SEQ ID NO: 10788 - RNA, 19 nt, Artificial Sequence
  Synthetic
gccgcgcggcgcagcgggc

SEQ ID NO: 10789 - RNA, 20 nt, Artificial Sequence
  Synthetic
cgccgcgcggcgcagcgggc

SEQ ID NO: 10790 - RNA, 21 nt, Artificial Sequence
  Synthetic
ccgccgcgcggcgcagcgggc

SEQ ID NO: 10791 - RNA, 22 nt, Artificial Sequence
  Synthetic
gccgccgcgcggcgcagcgggc

SEQ ID NO: 10792 - RNA, 23 nt, Artificial Sequence
  Synthetic
ggccgccgcgcggcgcagcgggc

SEQ ID NO: 10793 - RNA, 24 nt, Artificial Sequence
  Synthetic
aggccgccgcgcggcgcagcgggc

SEQ ID NO: 10794 - RNA, 18 nt, Artificial Sequence
  Synthetic
ggcgcgucgccgucgggc

SEQ ID NO: 10795 - RNA, 19 nt, Artificial Sequence
  Synthetic
gggcgcgucgccgucgggc

SEQ ID NO: 10796 - RNA, 20 nt, Artificial Sequence
  Synthetic
ggggcgcgucgccgucgggc

SEQ ID NO: 10797 - RNA, 21 nt, Artificial Sequence
  Synthetic
gggggcgcgucgccgucgggc

SEQ ID NO: 10798 - RNA, 22 nt, Artificial Sequence
  Synthetic
cgggggcgcgucgccgucgggc

SEQ ID NO: 10799 - RNA, 23 nt, Artificial Sequence
  Synthetic
gcgggggcgcgucgccgucgggc

SEQ ID NO: 10800 - RNA, 24 nt, Artificial Sequence
  Synthetic
agcgggggcgcgucgccgucgggc

SEQ ID NO: 10801 - RNA, 18 nt, Artificial Sequence
  Synthetic
gaggggcggccgcggggc

SEQ ID NO: 10802 - RNA, 19 nt, Artificial Sequence
  Synthetic
ggaggggcggccgcggggc

SEQ ID NO: 10803 - RNA, 20 nt, Artificial Sequence
  Synthetic
gggaggggcggccgcggggc

SEQ ID NO: 10804 - RNA, 21 nt, Artificial Sequence
  Synthetic
cgggaggggcggccgcggggc

SEQ ID NO: 10805 - RNA, 22 nt, Artificial Sequence
  Synthetic
gcgggaggggcggccgcggggc

SEQ ID NO: 10806 - RNA, 23 nt, Artificial Sequence
  Synthetic
cgcgggaggggcggccgcggggc

SEQ ID NO: 10807 - RNA, 24 nt, Artificial Sequence
  Synthetic
ccgcgggaggggcggccgcggggc

SEQ ID NO: 10808 - RNA, 18 nt, Artificial Sequence
  Synthetic
cggcggcgucggcggggc

SEQ ID NO: 10809 - RNA, 19 nt, Artificial Sequence
  Synthetic
gcggcggcgucggcggggc

SEQ ID NO: 10810 - RNA, 20 nt, Artificial Sequence
  Synthetic
ggcggcggcgucggcggggc

SEQ ID NO: 10811 - RNA, 21 nt, Artificial Sequence
  Synthetic
cggcggcggcgucggcggggc

SEQ ID NO: 10812 - RNA, 22 nt, Artificial Sequence
  Synthetic
gcggcggcggcgucggcggggc

SEQ ID NO: 10813 - RNA, 23 nt, Artificial Sequence
  Synthetic
cgcggcggcggcgucggcggggc

SEQ ID NO: 10814 - RNA, 24 nt, Artificial Sequence
  Synthetic
ccgcggcggcggcgucggcggggc

SEQ ID NO: 10815 - RNA, 18 nt, Artificial Sequence
  Synthetic
agcacgcgccccgggggc

SEQ ID NO: 10816 - RNA, 19 nt, Artificial Sequence
  Synthetic
cagcacgcgccccgggggc

SEQ ID NO: 10817 - RNA, 20 nt, Artificial Sequence
  Synthetic
acagcacgcgccccgggggc

SEQ ID NO: 10818 - RNA, 21 nt, Artificial Sequence
  Synthetic
uacagcacgcgccccgggggc

SEQ ID NO: 10819 - RNA, 22 nt, Artificial Sequence
  Synthetic
guacagcacgcgccccgggggc

SEQ ID NO: 10820 - RNA, 23 nt, Artificial Sequence
  Synthetic
cguacagcacgcgccccgggggc

SEQ ID NO: 10821 - RNA, 24 nt, Artificial Sequence
  Synthetic
ccguacagcacgcgccccgggggc

SEQ ID NO: 10822 - RNA, 18 nt, Artificial Sequence
  Synthetic
ugcggcgcuggcgggggc

SEQ ID NO: 10823 - RNA, 19 nt, Artificial Sequence
  Synthetic
cugcggcgcuggcgggggc

SEQ ID NO: 10824 - RNA, 20 nt, Artificial Sequence
  Synthetic
ucugcggcgcuggcgggggc

SEQ ID NO: 10825 - RNA, 21 nt, Artificial Sequence
  Synthetic
gucugcggcgcuggcgggggc

SEQ ID NO: 10826 - RNA, 22 nt, Artificial Sequence
  Synthetic
ggucugcggcgcuggcgggggc

SEQ ID NO: 10827 - RNA, 23 nt, Artificial Sequence
  Synthetic
uggucugcggcgcuggcgggggc

SEQ ID NO: 10828 - RNA, 24 nt, Artificial Sequence
  Synthetic
guggucugcggcgcuggcgggggc

SEQ ID NO: 10829 - RNA, 18 nt, Artificial Sequence
  Synthetic
ggcucuucuucggggggc

SEQ ID NO: 10830 - RNA, 19 nt, Artificial Sequence
  Synthetic
cggcucuucuucggggggc

SEQ ID NO: 10831 - RNA, 20 nt, Artificial Sequence
  Synthetic
gcggcucuucuucggggggc

SEQ ID NO: 10832 - RNA, 21 nt, Artificial Sequence
  Synthetic
cgcggcucuucuucggggggc

SEQ ID NO: 10833 - RNA, 22 nt, Artificial Sequence
  Synthetic
gcgcggcucuucuucggggggc

SEQ ID NO: 10834 - RNA, 23 nt, Artificial Sequence
  Synthetic
cgcgcggcucuucuucggggggc

SEQ ID NO: 10835 - RNA, 24 nt, Artificial Sequence
  Synthetic
ccgcgcggcucuucuucggggggc

SEQ ID NO: 10836 - RNA, 18 nt, Artificial Sequence
  Synthetic
gcccggcggcgcccuggc

SEQ ID NO: 10837 - RNA, 19 nt, Artificial Sequence
  Synthetic
cgcccggcggcgcccuggc

SEQ ID NO: 10838 - RNA, 20 nt, Artificial Sequence
  Synthetic
ccgcccggcggcgcccuggc

SEQ ID NO: 10839 - RNA, 21 nt, Artificial Sequence
  Synthetic
gccgcccggcggcgcccuggc

SEQ ID NO: 10840 - RNA, 22 nt, Artificial Sequence
  Synthetic
cgccgcccggcggcgcccuggc

SEQ ID NO: 10841 - RNA, 23 nt, Artificial Sequence
  Synthetic
gcgccgcccggcggcgcccuggc

SEQ ID NO: 10842 - RNA, 24 nt, Artificial Sequence
  Synthetic
ggcgccgcccggcggcgcccuggc

SEQ ID NO: 10843 - RNA, 18 nt, Artificial Sequence
  Synthetic
guggucugcggcgcuggc

SEQ ID NO: 10844 - RNA, 19 nt, Artificial Sequence
  Synthetic
cguggucugcggcgcuggc

SEQ ID NO: 10845 - RNA, 20 nt, Artificial Sequence
  Synthetic
gcguggucugcggcgcuggc

SEQ ID NO: 10846 - RNA, 21 nt, Artificial Sequence
  Synthetic
ggcguggucugcggcgcuggc

SEQ ID NO: 10847 - RNA, 22 nt, Artificial Sequence
  Synthetic
cggcguggucugcggcgcuggc

SEQ ID NO: 10848 - RNA, 23 nt, Artificial Sequence
  Synthetic
gcggcguggucugcggcgcuggc

SEQ ID NO: 10849 - RNA, 24 nt, Artificial Sequence
  Synthetic
cgcggcguggucugcggcgcuggc

SEQ ID NO: 10850 - RNA, 18 nt, Artificial Sequence
  Synthetic
cggcccgcgccacgcugc

SEQ ID NO: 10851 - RNA, 19 nt, Artificial Sequence
  Synthetic
acggcccgcgccacgcugc

SEQ ID NO: 10852 - RNA, 20 nt, Artificial Sequence
  Synthetic
cacggcccgcgccacgcugc

SEQ ID NO: 10853 - RNA, 21 nt, Artificial Sequence
  Synthetic
gcacggcccgcgccacgcugc

SEQ ID NO: 10854 - RNA, 22 nt, Artificial Sequence
  Synthetic
ggcacggcccgcgccacgcugc

SEQ ID NO: 10855 - RNA, 23 nt, Artificial Sequence
  Synthetic
gggcacggcccgcgccacgcugc

SEQ ID NO: 10856 - RNA, 24 nt, Artificial Sequence
  Synthetic
ggggcacggcccgcgccacgcugc

SEQ ID NO: 10857 - RNA, 18 nt, Artificial Sequence
  Synthetic
gacgcccagcguaucugc

SEQ ID NO: 10858 - RNA, 19 nt, Artificial Sequence
  Synthetic
cgacgcccagcguaucugc

SEQ ID NO: 10859 - RNA, 20 nt, Artificial Sequence
  Synthetic
ccgacgcccagcguaucugc

SEQ ID NO: 10860 - RNA, 21 nt, Artificial Sequence
  Synthetic
gccgacgcccagcguaucugc

SEQ ID NO: 10861 - RNA, 22 nt, Artificial Sequence
  Synthetic
ggccgacgcccagcguaucugc

SEQ ID NO: 10862 - RNA, 23 nt, Artificial Sequence
  Synthetic
cggccgacgcccagcguaucugc

SEQ ID NO: 10863 - RNA, 24 nt, Artificial Sequence
  Synthetic
gcggccgacgcccagcguaucugc

SEQ ID NO: 10864 - RNA, 18 nt, Artificial Sequence
  Synthetic
cgcgccgcgcccgagauc

SEQ ID NO: 10865 - RNA, 19 nt, Artificial Sequence
  Synthetic
gcgcgccgcgcccgagauc

SEQ ID NO: 10866 - RNA, 20 nt, Artificial Sequence
  Synthetic
ugcgcgccgcgcccgagauc

SEQ ID NO: 10867 - RNA, 21 nt, Artificial Sequence
  Synthetic
uugcgcgccgcgcccgagauc

SEQ ID NO: 10868 - RNA, 22 nt, Artificial Sequence
  Synthetic
guugcgcgccgcgcccgagauc

SEQ ID NO: 10869 - RNA, 23 nt, Artificial Sequence
  Synthetic
uguugcgcgccgcgcccgagauc

SEQ ID NO: 10870 - RNA, 24 nt, Artificial Sequence
  Synthetic
cuguugcgcgccgcgcccgagauc

SEQ ID NO: 10871 - RNA, 18 nt, Artificial Sequence
  Synthetic
gcgcucggcggaccacuc

SEQ ID NO: 10872 - RNA, 19 nt, Artificial Sequence
  Synthetic
cgcgcucggcggaccacuc

SEQ ID NO: 10873 - RNA, 20 nt, Artificial Sequence
  Synthetic
ccgcgcucggcggaccacuc

SEQ ID NO: 10874 - RNA, 21 nt, Artificial Sequence
  Synthetic
gccgcgcucggcggaccacuc

SEQ ID NO: 10875 - RNA, 22 nt, Artificial Sequence
  Synthetic
cgccgcgcucggcggaccacuc

SEQ ID NO: 10876 - RNA, 23 nt, Artificial Sequence
  Synthetic
ccgccgcgcucggcggaccacuc

SEQ ID NO: 10877 - RNA, 24 nt, Artificial Sequence
  Synthetic
cccgccgcgcucggcggaccacuc

SEQ ID NO: 10878 - RNA, 18 nt, Artificial Sequence
  Synthetic
gccgcccccggggcccuc

SEQ ID NO: 10879 - RNA, 19 nt, Artificial Sequence
  Synthetic
cgccgcccccggggcccuc

SEQ ID NO: 10880 - RNA, 20 nt, Artificial Sequence
  Synthetic
gcgccgcccccggggcccuc

SEQ ID NO: 10881 - RNA, 21 nt, Artificial Sequence
  Synthetic
ggcgccgcccccggggcccuc

SEQ ID NO: 10882 - RNA, 22 nt, Artificial Sequence
  Synthetic
gggcgccgcccccggggcccuc

SEQ ID NO: 10883 - RNA, 23 nt, Artificial Sequence
  Synthetic
ggggcgccgcccccggggcccuc

SEQ ID NO: 10884 - RNA, 24 nt, Artificial Sequence
  Synthetic
cggggcgccgcccccggggcccuc

SEQ ID NO: 10885 - RNA, 18 nt, Artificial Sequence
  Synthetic
cggggcgcaguaggccuc

SEQ ID NO: 10886 - RNA, 19 nt, Artificial Sequence
  Synthetic
gcggggcgcaguaggccuc

SEQ ID NO: 10887 - RNA, 20 nt, Artificial Sequence
  Synthetic
cgcggggcgcaguaggccuc

SEQ ID NO: 10888 - RNA, 21 nt, Artificial Sequence
  Synthetic
ccgcggggcgcaguaggccuc

SEQ ID NO: 10889 - RNA, 22 nt, Artificial Sequence
  Synthetic
cccgcggggcgcaguaggccuc

SEQ ID NO: 10890 - RNA, 23 nt, Artificial Sequence
  Synthetic
gcccgcggggcgcaguaggccuc

SEQ ID NO: 10891 - RNA, 24 nt, Artificial Sequence
  Synthetic
ggcccgcggggcgcaguaggccuc

SEQ ID NO: 10892 - RNA, 18 nt, Artificial Sequence
  Synthetic
gcccagcgccgagacguc

SEQ ID NO: 10893 - RNA, 19 nt, Artificial Sequence
  Synthetic
cgcccagcgccgagacguc

SEQ ID NO: 10894 - RNA, 20 nt, Artificial Sequence
  Synthetic
gcgcccagcgccgagacguc

SEQ ID NO: 10895 - RNA, 21 nt, Artificial Sequence
  Synthetic
cgcgcccagcgccgagacguc

SEQ ID NO: 10896 - RNA, 22 nt, Artificial Sequence
  Synthetic
gcgcgcccagcgccgagacguc

SEQ ID NO: 10897 - RNA, 23 nt, Artificial Sequence
  Synthetic
ugcgcgcccagcgccgagacguc

SEQ ID NO: 10898 - RNA, 24 nt, Artificial Sequence
  Synthetic
cugcgcgcccagcgccgagacguc

SEQ ID NO: 10899 - RNA, 18 nt, Artificial Sequence
  Synthetic
uccgcgcggcucuucuuc

SEQ ID NO: 10900 - RNA, 19 nt, Artificial Sequence
  Synthetic
guccgcgcggcucuucuuc

SEQ ID NO: 10901 - RNA, 20 nt, Artificial Sequence
  Synthetic
cguccgcgcggcucuucuuc

SEQ ID NO: 10902 - RNA, 21 nt, Artificial Sequence
  Synthetic
gcguccgcgcggcucuucuuc

SEQ ID NO: 10903 - RNA, 22 nt, Artificial Sequence
  Synthetic
ggcguccgcgcggcucuucuuc

SEQ ID NO: 10904 - RNA, 23 nt, Artificial Sequence
  Synthetic
gggcguccgcgcggcucuucuuc

SEQ ID NO: 10905 - RNA, 24 nt, Artificial Sequence
  Synthetic
ggggcguccgcgcggcucuucuuc

SEQ ID NO: 10906 - RNA, 18 nt, Artificial Sequence
  Synthetic
ggcgccacgcgcggguuc

SEQ ID NO: 10907 - RNA, 19 nt, Artificial Sequence
  Synthetic
gggcgccacgcgcggguuc

SEQ ID NO: 10908 - RNA, 20 nt, Artificial Sequence
  Synthetic
cgggcgccacgcgcggguuc

SEQ ID NO: 10909 - RNA, 21 nt, Artificial Sequence
  Synthetic
ccgggcgccacgcgcggguuc

SEQ ID NO: 10910 - RNA, 22 nt, Artificial Sequence
  Synthetic
cccgggcgccacgcgcggguuc

SEQ ID NO: 10911 - RNA, 23 nt, Artificial Sequence
  Synthetic
ccccgggcgccacgcgcggguuc

SEQ ID NO: 10912 - RNA, 24 nt, Artificial Sequence
  Synthetic
uccccgggcgccacgcgcggguuc

SEQ ID NO: 10913 - RNA, 18 nt, Artificial Sequence
  Synthetic
gggcgcaggcucugguuc

SEQ ID NO: 10914 - RNA, 19 nt, Artificial Sequence
  Synthetic
ggggcgcaggcucugguuc

SEQ ID NO: 10915 - RNA, 20 nt, Artificial Sequence
  Synthetic
gggggcgcaggcucugguuc

SEQ ID NO: 10916 - RNA, 21 nt, Artificial Sequence
  Synthetic
agggggcgcaggcucugguuc

SEQ ID NO: 10917 - RNA, 22 nt, Artificial Sequence
  Synthetic
cagggggcgcaggcucugguuc

SEQ ID NO: 10918 - RNA, 23 nt, Artificial Sequence
  Synthetic
gcagggggcgcaggcucugguuc

SEQ ID NO: 10919 - RNA, 24 nt, Artificial Sequence
  Synthetic
agcagggggcgcaggcucugguuc

SEQ ID NO: 10920 - RNA, 18 nt, Artificial Sequence
  Synthetic
gucgucgcgcagcaccag

SEQ ID NO: 10921 - RNA, 19 nt, Artificial Sequence
  Synthetic
cgucgucgcgcagcaccag

SEQ ID NO: 10922 - RNA, 20 nt, Artificial Sequence
  Synthetic
gcgucgucgcgcagcaccag

SEQ ID NO: 10923 - RNA, 21 nt, Artificial Sequence
  Synthetic
cgcgucgucgcgcagcaccag

SEQ ID NO: 10924 - RNA, 22 nt, Artificial Sequence
  Synthetic
ccgcgucgucgcgcagcaccag

SEQ ID NO: 10925 - RNA, 23 nt, Artificial Sequence
  Synthetic
uccgcgucgucgcgcagcaccag

SEQ ID NO: 10926 - RNA, 24 nt, Artificial Sequence
  Synthetic
guccgcgucgucgcgcagcaccag

SEQ ID NO: 10927 - RNA, 18 nt, Artificial Sequence
  Synthetic
cgccauggcguaccccag

SEQ ID NO: 10928 - RNA, 19 nt, Artificial Sequence
  Synthetic
ccgccauggcguaccccag

SEQ ID NO: 10929 - RNA, 20 nt, Artificial Sequence
  Synthetic
gccgccauggcguaccccag

SEQ ID NO: 10930 - RNA, 21 nt, Artificial Sequence
  Synthetic
cgccgccauggcguaccccag

SEQ ID NO: 10931 - RNA, 22 nt, Artificial Sequence
  Synthetic
ccgccgccauggcguaccccag

SEQ ID NO: 10932 - RNA, 23 nt, Artificial Sequence
  Synthetic
cccgccgccauggcguaccccag

SEQ ID NO: 10933 - RNA, 24 nt, Artificial Sequence
  Synthetic
gcccgccgccauggcguaccccag

SEQ ID NO: 10934 - RNA, 18 nt, Artificial Sequence
  Synthetic
acgugcgccaggccccag

SEQ ID NO: 10935 - RNA, 19 nt, Artificial Sequence
  Synthetic
cacgugcgccaggccccag

SEQ ID NO: 10936 - RNA, 20 nt, Artificial Sequence
  Synthetic
ccacgugcgccaggccccag

SEQ ID NO: 10937 - RNA, 21 nt, Artificial Sequence
  Synthetic
gccacgugcgccaggccccag

SEQ ID NO: 10938 - RNA, 22 nt, Artificial Sequence
  Synthetic
cgccacgugcgccaggccccag

SEQ ID NO: 10939 - RNA, 23 nt, Artificial Sequence
  Synthetic
ccgccacgugcgccaggccccag

SEQ ID NO: 10940 - RNA, 24 nt, Artificial Sequence
  Synthetic
gccgccacgugcgccaggccccag

SEQ ID NO: 10941 - RNA, 18 nt, Artificial Sequence
  Synthetic
cgcguucucgcgcgccag

SEQ ID NO: 10942 - RNA, 19 nt, Artificial Sequence
  Synthetic
ccgcguucucgcgcgccag

SEQ ID NO: 10943 - RNA, 20 nt, Artificial Sequence
  Synthetic
gccgcguucucgcgcgccag

SEQ ID NO: 10944 - RNA, 21 nt, Artificial Sequence
  Synthetic
cgccgcguucucgcgcgccag

SEQ ID NO: 10945 - RNA, 22 nt, Artificial Sequence
  Synthetic
gcgccgcguucucgcgcgccag

SEQ ID NO: 10946 - RNA, 23 nt, Artificial Sequence
  Synthetic
agcgccgcguucucgcgcgccag

SEQ ID NO: 10947 - RNA, 24 nt, Artificial Sequence
  Synthetic
cagcgccgcguucucgcgcgccag

SEQ ID NO: 10948 - RNA, 18 nt, Artificial Sequence
  Synthetic
ggcgacggugucggccag

SEQ ID NO: 10949 - RNA, 19 nt, Artificial Sequence
  Synthetic
cggcgacggugucggccag

SEQ ID NO: 10950 - RNA, 20 nt, Artificial Sequence
  Synthetic
gcggcgacggugucggccag

SEQ ID NO: 10951 - RNA, 21 nt, Artificial Sequence
  Synthetic
cgcggcgacggugucggccag

SEQ ID NO: 10952 - RNA, 22 nt, Artificial Sequence
  Synthetic
ccgcggcgacggugucggccag

SEQ ID NO: 10953 - RNA, 23 nt, Artificial Sequence
  Synthetic
gccgcggcgacggugucggccag

SEQ ID NO: 10954 - RNA, 24 nt, Artificial Sequence
  Synthetic
ggccgcggcgacggugucggccag

SEQ ID NO: 10955 - RNA, 18 nt, Artificial Sequence
  Synthetic
gcgcagccaggcgcgcag

SEQ ID NO: 10956 - RNA, 19 nt, Artificial Sequence
  Synthetic
cgcgcagccaggcgcgcag

SEQ ID NO: 10957 - RNA, 20 nt, Artificial Sequence
  Synthetic
ucgcgcagccaggcgcgcag

SEQ ID NO: 10958 - RNA, 21 nt, Artificial Sequence
  Synthetic
cucgcgcagccaggcgcgcag

SEQ ID NO: 10959 - RNA, 22 nt, Artificial Sequence
  Synthetic
gcucgcgcagccaggcgcgcag

SEQ ID NO: 10960 - RNA, 23 nt, Artificial Sequence
  Synthetic
agcucgcgcagccaggcgcgcag

SEQ ID NO: 10961 - RNA, 24 nt, Artificial Sequence
  Synthetic
cagcucgcgcagccaggcgcgcag

SEQ ID NO: 10962 - RNA, 18 nt, Artificial Sequence
  Synthetic
acgaggaggcggaugcag

SEQ ID NO: 10963 - RNA, 19 nt, Artificial Sequence
  Synthetic
gacgaggaggcggaugcag

SEQ ID NO: 10964 - RNA, 20 nt, Artificial Sequence
  Synthetic
agacgaggaggcggaugcag

SEQ ID NO: 10965 - RNA, 21 nt, Artificial Sequence
  Synthetic
cagacgaggaggcggaugcag

SEQ ID NO: 10966 - RNA, 22 nt, Artificial Sequence
  Synthetic
ucagacgaggaggcggaugcag

SEQ ID NO: 10967 - RNA, 23 nt, Artificial Sequence
  Synthetic
gucagacgaggaggcggaugcag

SEQ ID NO: 10968 - RNA, 24 nt, Artificial Sequence
  Synthetic
cgucagacgaggaggcggaugcag

SEQ ID NO: 10969 - RNA, 18 nt, Artificial Sequence
  Synthetic
cgucgucgucgucgucag

SEQ ID NO: 10970 - RNA, 19 nt, Artificial Sequence
  Synthetic
ucgucgucgucgucgucag

SEQ ID NO: 10971 - RNA, 20 nt, Artificial Sequence
  Synthetic
gucgucgucgucgucgucag

SEQ ID NO: 10972 - RNA, 21 nt, Artificial Sequence
  Synthetic
cgucgucgucgucgucgucag

SEQ ID NO: 10973 - RNA, 22 nt, Artificial Sequence
  Synthetic
ucgucgucgucgucgucgucag

SEQ ID NO: 10974 - RNA, 23 nt, Artificial Sequence
  Synthetic
gucgucgucgucgucgucgucag

SEQ ID NO: 10975 - RNA, 24 nt, Artificial Sequence
  Synthetic
cgucgucgucgucgucgucgucag

SEQ ID NO: 10976 - RNA, 18 nt, Artificial Sequence
  Synthetic
gcggcgcaggcuggucag

SEQ ID NO: 10977 - RNA, 19 nt, Artificial Sequence
  Synthetic
cgcggcgcaggcuggucag

SEQ ID NO: 10978 - RNA, 20 nt, Artificial Sequence
  Synthetic
gcgcggcgcaggcuggucag

SEQ ID NO: 10979 - RNA, 21 nt, Artificial Sequence
  Synthetic
ggcgcggcgcaggcuggucag

SEQ ID NO: 10980 - RNA, 22 nt, Artificial Sequence
  Synthetic
aggcgcggcgcaggcuggucag

SEQ ID NO: 10981 - RNA, 23 nt, Artificial Sequence
  Synthetic
uaggcgcggcgcaggcuggucag

SEQ ID NO: 10982 - RNA, 24 nt, Artificial Sequence
  Synthetic
guaggcgcggcgcaggcuggucag

SEQ ID NO: 10983 - RNA, 18 nt, Artificial Sequence
  Synthetic
gaggcggaugcagacgag

SEQ ID NO: 10984 - RNA, 19 nt, Artificial Sequence
  Synthetic
ggaggcggaugcagacgag

SEQ ID NO: 10985 - RNA, 20 nt, Artificial Sequence
  Synthetic
aggaggcggaugcagacgag

SEQ ID NO: 10986 - RNA, 21 nt, Artificial Sequence
  Synthetic
gaggaggcggaugcagacgag

SEQ ID NO: 10987 - RNA, 22 nt, Artificial Sequence
  Synthetic
cgaggaggcggaugcagacgag

SEQ ID NO: 10988 - RNA, 23 nt, Artificial Sequence
  Synthetic
acgaggaggcggaugcagacgag

SEQ ID NO: 10989 - RNA, 24 nt, Artificial Sequence
  Synthetic
gacgaggaggcggaugcagacgag

SEQ ID NO: 10990 - RNA, 18 nt, Artificial Sequence
  Synthetic
ucgcccggcagcggcgag

SEQ ID NO: 10991 - RNA, 19 nt, Artificial Sequence
  Synthetic
cucgcccggcagcggcgag

SEQ ID NO: 10992 - RNA, 20 nt, Artificial Sequence
  Synthetic
ccucgcccggcagcggcgag

SEQ ID NO: 10993 - RNA, 21 nt, Artificial Sequence
  Synthetic
uccucgcccggcagcggcgag

SEQ ID NO: 10994 - RNA, 22 nt, Artificial Sequence
  Synthetic
guccucgcccggcagcggcgag

SEQ ID NO: 10995 - RNA, 23 nt, Artificial Sequence
  Synthetic
gguccucgcccggcagcggcgag

SEQ ID NO: 10996 - RNA, 24 nt, Artificial Sequence
  Synthetic
agguccucgcccggcagcggcgag

SEQ ID NO: 10997 - RNA, 18 nt, Artificial Sequence
  Synthetic
gcggaugcagacgaggag

SEQ ID NO: 10998 - RNA, 19 nt, Artificial Sequence
  Synthetic
ggcggaugcagacgaggag

SEQ ID NO: 10999 - RNA, 20 nt, Artificial Sequence
  Synthetic
aggcggaugcagacgaggag

SEQ ID NO: 11000 - RNA, 21 nt, Artificial Sequence
  Synthetic
gaggcggaugcagacgaggag

SEQ ID NO: 11001 - RNA, 22 nt, Artificial Sequence
  Synthetic
ggaggcggaugcagacgaggag

SEQ ID NO: 11002 - RNA, 23 nt, Artificial Sequence
  Synthetic
aggaggcggaugcagacgaggag

SEQ ID NO: 11003 - RNA, 24 nt, Artificial Sequence
  Synthetic
gaggaggcggaugcagacgaggag

SEQ ID NO: 11004 - RNA, 18 nt, Artificial Sequence
  Synthetic
gcagacgaggaggaggag

SEQ ID NO: 11005 - RNA, 19 nt, Artificial Sequence
  Synthetic
ugcagacgaggaggaggag

SEQ ID NO: 11006 - RNA, 20 nt, Artificial Sequence
  Synthetic
augcagacgaggaggaggag

SEQ ID NO: 11007 - RNA, 21 nt, Artificial Sequence
  Synthetic
gaugcagacgaggaggaggag

SEQ ID NO: 11008 - RNA, 22 nt, Artificial Sequence
  Synthetic
ggaugcagacgaggaggaggag

SEQ ID NO: 11009 - RNA, 23 nt, Artificial Sequence
  Synthetic
cggaugcagacgaggaggaggag

SEQ ID NO: 11010 - RNA, 24 nt, Artificial Sequence
  Synthetic
gcggaugcagacgaggaggaggag

SEQ ID NO: 11011 - RNA, 18 nt, Artificial Sequence
  Synthetic
gaggaggcggaggaggag

SEQ ID NO: 11012 - RNA, 19 nt, Artificial Sequence
  Synthetic
ggaggaggcggaggaggag

SEQ ID NO: 11013 - RNA, 20 nt, Artificial Sequence
  Synthetic
aggaggaggcggaggaggag

SEQ ID NO: 11014 - RNA, 21 nt, Artificial Sequence
  Synthetic
gaggaggaggcggaggaggag

SEQ ID NO: 11015 - RNA, 22 nt, Artificial Sequence
  Synthetic
ggaggaggaggcggaggaggag

SEQ ID NO: 11016 - RNA, 23 nt, Artificial Sequence
  Synthetic
aggaggaggaggcggaggaggag

SEQ ID NO: 11017 - RNA, 24 nt, Artificial Sequence
  Synthetic
gaggaggaggaggcggaggaggag

SEQ ID NO: 11018 - RNA, 18 nt, Artificial Sequence
  Synthetic
cgcgccacgcugccggag

SEQ ID NO: 11019 - RNA, 19 nt, Artificial Sequence
  Synthetic
ccgcgccacgcugccggag

SEQ ID NO: 11020 - RNA, 20 nt, Artificial Sequence
  Synthetic
cccgcgccacgcugccggag

SEQ ID NO: 11021 - RNA, 21 nt, Artificial Sequence
  Synthetic
gcccgcgccacgcugccggag

SEQ ID NO: 11022 - RNA, 22 nt, Artificial Sequence
  Synthetic
ggcccgcgccacgcugccggag

SEQ ID NO: 11023 - RNA, 23 nt, Artificial Sequence
  Synthetic
cggcccgcgccacgcugccggag

SEQ ID NO: 11024 - RNA, 24 nt, Artificial Sequence
  Synthetic
acggcccgcgccacgcugccggag

SEQ ID NO: 11025 - RNA, 18 nt, Artificial Sequence
  Synthetic
gccccggccggcgcggag

SEQ ID NO: 11026 - RNA, 19 nt, Artificial Sequence
  Synthetic
ggccccggccggcgcggag

SEQ ID NO: 11027 - RNA, 20 nt, Artificial Sequence
  Synthetic
cggccccggccggcgcggag

SEQ ID NO: 11028 - RNA, 21 nt, Artificial Sequence
  Synthetic
ucggccccggccggcgcggag

SEQ ID NO: 11029 - RNA, 22 nt, Artificial Sequence
  Synthetic
gucggccccggccggcgcggag

SEQ ID NO: 11030 - RNA, 23 nt, Artificial Sequence
  Synthetic
cgucggccccggccggcgcggag

SEQ ID NO: 11031 - RNA, 24 nt, Artificial Sequence
  Synthetic
ucgucggccccggccggcgcggag

SEQ ID NO: 11032 - RNA, 18 nt, Artificial Sequence
  Synthetic
gccucccgcggcgcggag

SEQ ID NO: 11033 - RNA, 19 nt, Artificial Sequence
  Synthetic
cgccucccgcggcgcggag

SEQ ID NO: 11034 - RNA, 20 nt, Artificial Sequence
  Synthetic
gcgccucccgcggcgcggag

SEQ ID NO: 11035 - RNA, 21 nt, Artificial Sequence
  Synthetic
cgcgccucccgcggcgcggag

SEQ ID NO: 11036 - RNA, 22 nt, Artificial Sequence
  Synthetic
gcgcgccucccgcggcgcggag

SEQ ID NO: 11037 - RNA, 23 nt, Artificial Sequence
  Synthetic
ugcgcgccucccgcggcgcggag

SEQ ID NO: 11038 - RNA, 24 nt, Artificial Sequence
  Synthetic
uugcgcgccucccgcggcgcggag

SEQ ID NO: 11039 - RNA, 18 nt, Artificial Sequence
  Synthetic
gaggaggaggaggcggag

SEQ ID NO: 11040 - RNA, 19 nt, Artificial Sequence
  Synthetic
cgaggaggaggaggcggag

SEQ ID NO: 11041 - RNA, 20 nt, Artificial Sequence
  Synthetic
acgaggaggaggaggcggag

SEQ ID NO: 11042 - RNA, 21 nt, Artificial Sequence
  Synthetic
gacgaggaggaggaggcggag

SEQ ID NO: 11043 - RNA, 22 nt, Artificial Sequence
  Synthetic
agacgaggaggaggaggcggag

SEQ ID NO: 11044 - RNA, 23 nt, Artificial Sequence
  Synthetic
cagacgaggaggaggaggcggag

SEQ ID NO: 11045 - RNA, 24 nt, Artificial Sequence
  Synthetic
gcagacgaggaggaggaggcggag

SEQ ID NO: 11046 - RNA, 18 nt, Artificial Sequence
  Synthetic
cgccccagcgccacguag

SEQ ID NO: 11047 - RNA, 19 nt, Artificial Sequence
  Synthetic
gcgccccagcgccacguag

SEQ ID NO: 11048 - RNA, 20 nt, Artificial Sequence
  Synthetic
cgcgccccagcgccacguag

SEQ ID NO: 11049 - RNA, 21 nt, Artificial Sequence
  Synthetic
ucgcgccccagcgccacguag

SEQ ID NO: 11050 - RNA, 22 nt, Artificial Sequence
  Synthetic
gucgcgccccagcgccacguag

SEQ ID NO: 11051 - RNA, 23 nt, Artificial Sequence
  Synthetic
cgucgcgccccagcgccacguag

SEQ ID NO: 11052 - RNA, 24 nt, Artificial Sequence
  Synthetic
gcgucgcgccccagcgccacguag

SEQ ID NO: 11053 - RNA, 18 nt, Artificial Sequence
  Synthetic
cgcacggcgcacugcacg

SEQ ID NO: 11054 - RNA, 19 nt, Artificial Sequence
  Synthetic
gcgcacggcgcacugcacg

SEQ ID NO: 11055 - RNA, 20 nt, Artificial Sequence
  Synthetic
agcgcacggcgcacugcacg

SEQ ID NO: 11056 - RNA, 21 nt, Artificial Sequence
  Synthetic
cagcgcacggcgcacugcacg

SEQ ID NO: 11057 - RNA, 22 nt, Artificial Sequence
  Synthetic
ccagcgcacggcgcacugcacg

SEQ ID NO: 11058 - RNA, 23 nt, Artificial Sequence
  Synthetic
gccagcgcacggcgcacugcacg

SEQ ID NO: 11059 - RNA, 24 nt, Artificial Sequence
  Synthetic
ggccagcgcacggcgcacugcacg

SEQ ID NO: 11060 - RNA, 18 nt, Artificial Sequence
  Synthetic
aggaggcggaugcagacg

SEQ ID NO: 11061 - RNA, 19 nt, Artificial Sequence
  Synthetic
gaggaggcggaugcagacg

SEQ ID NO: 11062 - RNA, 20 nt, Artificial Sequence
  Synthetic
cgaggaggcggaugcagacg

SEQ ID NO: 11063 - RNA, 21 nt, Artificial Sequence
  Synthetic
acgaggaggcggaugcagacg

SEQ ID NO: 11064 - RNA, 22 nt, Artificial Sequence
  Synthetic
gacgaggaggcggaugcagacg

SEQ ID NO: 11065 - RNA, 23 nt, Artificial Sequence
  Synthetic
agacgaggaggcggaugcagacg

SEQ ID NO: 11066 - RNA, 24 nt, Artificial Sequence
  Synthetic
cagacgaggaggcggaugcagacg

SEQ ID NO: 11067 - RNA, 18 nt, Artificial Sequence
  Synthetic
cgucgucgucgucagacg

SEQ ID NO: 11068 - RNA, 19 nt, Artificial Sequence
  Synthetic
ucgucgucgucgucagacg

SEQ ID NO: 11069 - RNA, 20 nt, Artificial Sequence
  Synthetic
gucgucgucgucgucagacg

SEQ ID NO: 11070 - RNA, 21 nt, Artificial Sequence
  Synthetic
cgucgucgucgucgucagacg

SEQ ID NO: 11071 - RNA, 22 nt, Artificial Sequence
  Synthetic
ucgucgucgucgucgucagacg

SEQ ID NO: 11072 - RNA, 23 nt, Artificial Sequence
  Synthetic
gucgucgucgucgucgucagacg

SEQ ID NO: 11073 - RNA, 24 nt, Artificial Sequence
  Synthetic
cgucgucgucgucgucgucagacg

SEQ ID NO: 11074 - RNA, 18 nt, Artificial Sequence
  Synthetic
gcgcccagcgccgagacg

SEQ ID NO: 11075 - RNA, 19 nt, Artificial Sequence
  Synthetic
cgcgcccagcgccgagacg

SEQ ID NO: 11076 - RNA, 20 nt, Artificial Sequence
  Synthetic
gcgcgcccagcgccgagacg

SEQ ID NO: 11077 - RNA, 21 nt, Artificial Sequence
  Synthetic
ugcgcgcccagcgccgagacg

SEQ ID NO: 11078 - RNA, 22 nt, Artificial Sequence
  Synthetic
cugcgcgcccagcgccgagacg

SEQ ID NO: 11079 - RNA, 23 nt, Artificial Sequence
  Synthetic
ccugcgcgcccagcgccgagacg

SEQ ID NO: 11080 - RNA, 24 nt, Artificial Sequence
  Synthetic
cccugcgcgcccagcgccgagacg

SEQ ID NO: 11081 - RNA, 18 nt, Artificial Sequence
  Synthetic
cgcacggcguugacgacg

SEQ ID NO: 11082 - RNA, 19 nt, Artificial Sequence
  Synthetic
gcgcacggcguugacgacg

SEQ ID NO: 11083 - RNA, 20 nt, Artificial Sequence
  Synthetic
cgcgcacggcguugacgacg

SEQ ID NO: 11084 - RNA, 21 nt, Artificial Sequence
  Synthetic
gcgcgcacggcguugacgacg

SEQ ID NO: 11085 - RNA, 22 nt, Artificial Sequence
  Synthetic
ggcgcgcacggcguugacgacg

SEQ ID NO: 11086 - RNA, 23 nt, Artificial Sequence
  Synthetic
cggcgcgcacggcguugacgacg

SEQ ID NO: 11087 - RNA, 24 nt, Artificial Sequence
  Synthetic
gcggcgcgcacggcguugacgacg

SEQ ID NO: 11088 - RNA, 18 nt, Artificial Sequence
  Synthetic
aggcggaggacgccgacg

SEQ ID NO: 11089 - RNA, 19 nt, Artificial Sequence
  Synthetic
gaggcggaggacgccgacg

SEQ ID NO: 11090 - RNA, 20 nt, Artificial Sequence
  Synthetic
ggaggcggaggacgccgacg

SEQ ID NO: 11091 - RNA, 21 nt, Artificial Sequence
  Synthetic
aggaggcggaggacgccgacg

SEQ ID NO: 11092 - RNA, 22 nt, Artificial Sequence
  Synthetic
gaggaggcggaggacgccgacg

SEQ ID NO: 11093 - RNA, 23 nt, Artificial Sequence
  Synthetic
ggaggaggcggaggacgccgacg

SEQ ID NO: 11094 - RNA, 24 nt, Artificial Sequence
  Synthetic
aggaggaggcggaggacgccgacg

SEQ ID NO: 11095 - RNA, 18 nt, Artificial Sequence
  Synthetic
ggcguccagcucgacccg

SEQ ID NO: 11096 - RNA, 19 nt, Artificial Sequence
  Synthetic
cggcguccagcucgacccg

SEQ ID NO: 11097 - RNA, 20 nt, Artificial Sequence
  Synthetic
ucggcguccagcucgacccg

SEQ ID NO: 11098 - RNA, 21 nt, Artificial Sequence
  Synthetic
gucggcguccagcucgacccg

SEQ ID NO: 11099 - RNA, 22 nt, Artificial Sequence
  Synthetic
cgucggcguccagcucgacccg

SEQ ID NO: 11100 - RNA, 23 nt, Artificial Sequence
  Synthetic
gcgucggcguccagcucgacccg

SEQ ID NO: 11101 - RNA, 24 nt, Artificial Sequence
  Synthetic
cgcgucggcguccagcucgacccg

SEQ ID NO: 11102 - RNA, 18 nt, Artificial Sequence
  Synthetic
cggggggcgcggcccccg

SEQ ID NO: 11103 - RNA, 19 nt, Artificial Sequence
  Synthetic
gcggggggcgcggcccccg

SEQ ID NO: 11104 - RNA, 20 nt, Artificial Sequence
  Synthetic
ggcggggggcgcggcccccg

SEQ ID NO: 11105 - RNA, 21 nt, Artificial Sequence
  Synthetic
gggcggggggcgcggcccccg

SEQ ID NO: 11106 - RNA, 22 nt, Artificial Sequence
  Synthetic
ggggcggggggcgcggcccccg

SEQ ID NO: 11107 - RNA, 23 nt, Artificial Sequence
  Synthetic
cggggcggggggcgcggcccccg

SEQ ID NO: 11108 - RNA, 24 nt, Artificial Sequence
  Synthetic
gcggggcggggggcgcggcccccg

SEQ ID NO: 11109 - RNA, 18 nt, Artificial Sequence
  Synthetic
gagcucggccacggcccg

SEQ ID NO: 11110 - RNA, 19 nt, Artificial Sequence
  Synthetic
ugagcucggccacggcccg

SEQ ID NO: 11111 - RNA, 20 nt, Artificial Sequence
  Synthetic
gugagcucggccacggcccg

SEQ ID NO: 11112 - RNA, 21 nt, Artificial Sequence
  Synthetic
cgugagcucggccacggcccg

SEQ ID NO: 11113 - RNA, 22 nt, Artificial Sequence
  Synthetic
ccgugagcucggccacggcccg

SEQ ID NO: 11114 - RNA, 23 nt, Artificial Sequence
  Synthetic
uccgugagcucggccacggcccg

SEQ ID NO: 11115 - RNA, 24 nt, Artificial Sequence
  Synthetic
guccgugagcucggccacggcccg

SEQ ID NO: 11116 - RNA, 18 nt, Artificial Sequence
  Synthetic
gcggccguggcgggcccg

SEQ ID NO: 11117 - RNA, 19 nt, Artificial Sequence
  Synthetic
ggcggccguggcgggcccg

SEQ ID NO: 11118 - RNA, 20 nt, Artificial Sequence
  Synthetic
aggcggccguggcgggcccg

SEQ ID NO: 11119 - RNA, 21 nt, Artificial Sequence
  Synthetic
caggcggccguggcgggcccg

SEQ ID NO: 11120 - RNA, 22 nt, Artificial Sequence
  Synthetic
ccaggcggccguggcgggcccg

SEQ ID NO: 11121 - RNA, 23 nt, Artificial Sequence
  Synthetic
cccaggcggccguggcgggcccg

SEQ ID NO: 11122 - RNA, 24 nt, Artificial Sequence
  Synthetic
gcccaggcggccguggcgggcccg

SEQ ID NO: 11123 - RNA, 18 nt, Artificial Sequence
  Synthetic
cccgcggcgccguagccg

SEQ ID NO: 11124 - RNA, 19 nt, Artificial Sequence
  Synthetic
ccccgcggcgccguagccg

SEQ ID NO: 11125 - RNA, 20 nt, Artificial Sequence
  Synthetic
cccccgcggcgccguagccg

SEQ ID NO: 11126 - RNA, 21 nt, Artificial Sequence
  Synthetic
acccccgcggcgccguagccg

SEQ ID NO: 11127 - RNA, 22 nt, Artificial Sequence
  Synthetic
cacccccgcggcgccguagccg

SEQ ID NO: 11128 - RNA, 23 nt, Artificial Sequence
  Synthetic
gcacccccgcggcgccguagccg

SEQ ID NO: 11129 - RNA, 24 nt, Artificial Sequence
  Synthetic
agcacccccgcggcgccguagccg

SEQ ID NO: 11130 - RNA, 18 nt, Artificial Sequence
  Synthetic
gcggcgggcgcgccgccg

SEQ ID NO: 11131 - RNA, 19 nt, Artificial Sequence
  Synthetic
ggcggcgggcgcgccgccg

SEQ ID NO: 11132 - RNA, 20 nt, Artificial Sequence
  Synthetic
aggcggcgggcgcgccgccg

SEQ ID NO: 11133 - RNA, 21 nt, Artificial Sequence
  Synthetic
aaggcggcgggcgcgccgccg

SEQ ID NO: 11134 - RNA, 22 nt, Artificial Sequence
  Synthetic
gaaggcggcgggcgcgccgccg

SEQ ID NO: 11135 - RNA, 23 nt, Artificial Sequence
  Synthetic
cgaaggcggcgggcgcgccgccg

SEQ ID NO: 11136 - RNA, 24 nt, Artificial Sequence
  Synthetic
ccgaaggcggcgggcgcgccgccg

SEQ ID NO: 11137 - RNA, 18 nt, Artificial Sequence
  Synthetic
gccggcgggucagcgccg

SEQ ID NO: 11138 - RNA, 19 nt, Artificial Sequence
  Synthetic
ggccggcgggucagcgccg

SEQ ID NO: 11139 - RNA, 20 nt, Artificial Sequence
  Synthetic
gggccggcgggucagcgccg

SEQ ID NO: 11140 - RNA, 21 nt, Artificial Sequence
  Synthetic
cgggccggcgggucagcgccg

SEQ ID NO: 11141 - RNA, 22 nt, Artificial Sequence
  Synthetic
gcgggccggcgggucagcgccg

SEQ ID NO: 11142 - RNA, 23 nt, Artificial Sequence
  Synthetic
ggcgggccggcgggucagcgccg

SEQ ID NO: 11143 - RNA, 24 nt, Artificial Sequence
  Synthetic
cggcgggccggcgggucagcgccg

SEQ ID NO: 11144 - RNA, 18 nt, Artificial Sequence
  Synthetic
agaggcggccgagcgccg

SEQ ID NO: 11145 - RNA, 19 nt, Artificial Sequence
  Synthetic
cagaggcggccgagcgccg

SEQ ID NO: 11146 - RNA, 20 nt, Artificial Sequence
  Synthetic
ucagaggcggccgagcgccg

SEQ ID NO: 11147 - RNA, 21 nt, Artificial Sequence
  Synthetic
gucagaggcggccgagcgccg

SEQ ID NO: 11148 - RNA, 22 nt, Artificial Sequence
  Synthetic
agucagaggcggccgagcgccg

SEQ ID NO: 11149 - RNA, 23 nt, Artificial Sequence
  Synthetic
gagucagaggcggccgagcgccg

SEQ ID NO: 11150 - RNA, 24 nt, Artificial Sequence
  Synthetic
ugagucagaggcggccgagcgccg

SEQ ID NO: 11151 - RNA, 18 nt, Artificial Sequence
  Synthetic
aaggcggcgggcgcgccg

SEQ ID NO: 11152 - RNA, 19 nt, Artificial Sequence
  Synthetic
gaaggcggcgggcgcgccg

SEQ ID NO: 11153 - RNA, 20 nt, Artificial Sequence
  Synthetic
cgaaggcggcgggcgcgccg

SEQ ID NO: 11154 - RNA, 21 nt, Artificial Sequence
  Synthetic
ccgaaggcggcgggcgcgccg

SEQ ID NO: 11155 - RNA, 22 nt, Artificial Sequence
  Synthetic
gccgaaggcggcgggcgcgccg

SEQ ID NO: 11156 - RNA, 23 nt, Artificial Sequence
  Synthetic
ggccgaaggcggcgggcgcgccg

SEQ ID NO: 11157 - RNA, 24 nt, Artificial Sequence
  Synthetic
gggccgaaggcggcgggcgcgccg

SEQ ID NO: 11158 - RNA, 18 nt, Artificial Sequence
  Synthetic
aggaacuccacggcgccg

SEQ ID NO: 11159 - RNA, 19 nt, Artificial Sequence
  Synthetic
caggaacuccacggcgccg

SEQ ID NO: 11160 - RNA, 20 nt, Artificial Sequence
  Synthetic
ccaggaacuccacggcgccg

SEQ ID NO: 11161 - RNA, 21 nt, Artificial Sequence
  Synthetic
cccaggaacuccacggcgccg

SEQ ID NO: 11162 - RNA, 22 nt, Artificial Sequence
  Synthetic
ccccaggaacuccacggcgccg

SEQ ID NO: 11163 - RNA, 23 nt, Artificial Sequence
  Synthetic
gccccaggaacuccacggcgccg

SEQ ID NO: 11164 - RNA, 24 nt, Artificial Sequence
  Synthetic
agccccaggaacuccacggcgccg

SEQ ID NO: 11165 - RNA, 18 nt, Artificial Sequence
  Synthetic
agcgggggcgcgucgccg

SEQ ID NO: 11166 - RNA, 19 nt, Artificial Sequence
  Synthetic
cagcgggggcgcgucgccg

SEQ ID NO: 11167 - RNA, 20 nt, Artificial Sequence
  Synthetic
ccagcgggggcgcgucgccg

SEQ ID NO: 11168 - RNA, 21 nt, Artificial Sequence
  Synthetic
accagcgggggcgcgucgccg

SEQ ID NO: 11169 - RNA, 22 nt, Artificial Sequence
  Synthetic
caccagcgggggcgcgucgccg

SEQ ID NO: 11170 - RNA, 23 nt, Artificial Sequence
  Synthetic
gcaccagcgggggcgcgucgccg

SEQ ID NO: 11171 - RNA, 24 nt, Artificial Sequence
  Synthetic
agcaccagcgggggcgcgucgccg

SEQ ID NO: 11172 - RNA, 18 nt, Artificial Sequence
  Synthetic
acggccgccaggucgccg

SEQ ID NO: 11173 - RNA, 19 nt, Artificial Sequence
  Synthetic
cacggccgccaggucgccg

SEQ ID NO: 11174 - RNA, 20 nt, Artificial Sequence
  Synthetic
gcacggccgccaggucgccg

SEQ ID NO: 11175 - RNA, 21 nt, Artificial Sequence
  Synthetic
ggcacggccgccaggucgccg

SEQ ID NO: 11176 - RNA, 22 nt, Artificial Sequence
  Synthetic
cggcacggccgccaggucgccg

SEQ ID NO: 11177 - RNA, 23 nt, Artificial Sequence
  Synthetic
ccggcacggccgccaggucgccg

SEQ ID NO: 11178 - RNA, 24 nt, Artificial Sequence
  Synthetic
cccggcacggccgccaggucgccg

SEQ ID NO: 11179 - RNA, 18 nt, Artificial Sequence
  Synthetic
ggcggcccgcggucgccg

SEQ ID NO: 11180 - RNA, 19 nt, Artificial Sequence
  Synthetic
aggcggcccgcggucgccg

SEQ ID NO: 11181 - RNA, 20 nt, Artificial Sequence
  Synthetic
caggcggcccgcggucgccg

SEQ ID NO: 11182 - RNA, 21 nt, Artificial Sequence
  Synthetic
ccaggcggcccgcggucgccg

SEQ ID NO: 11183 - RNA, 22 nt, Artificial Sequence
  Synthetic
uccaggcggcccgcggucgccg

SEQ ID NO: 11184 - RNA, 23 nt, Artificial Sequence
  Synthetic
cuccaggcggcccgcggucgccg

SEQ ID NO: 11185 - RNA, 24 nt, Artificial Sequence
  Synthetic
gcuccaggcggcccgcggucgccg

SEQ ID NO: 11186 - RNA, 18 nt, Artificial Sequence
  Synthetic
ccgcgggaggggcggccg

SEQ ID NO: 11187 - RNA, 19 nt, Artificial Sequence
  Synthetic
cccgcgggaggggcggccg

SEQ ID NO: 11188 - RNA, 20 nt, Artificial Sequence
  Synthetic
ccccgcgggaggggcggccg

SEQ ID NO: 11189 - RNA, 21 nt, Artificial Sequence
  Synthetic
cccccgcgggaggggcggccg

SEQ ID NO: 11190 - RNA, 22 nt, Artificial Sequence
  Synthetic
gcccccgcgggaggggcggccg

SEQ ID NO: 11191 - RNA, 23 nt, Artificial Sequence
  Synthetic
ggcccccgcgggaggggcggccg

SEQ ID NO: 11192 - RNA, 24 nt, Artificial Sequence
  Synthetic
cggcccccgcgggaggggcggccg

SEQ ID NO: 11193 - RNA, 18 nt, Artificial Sequence
  Synthetic
gcucggcggaccacuccg

SEQ ID NO: 11194 - RNA, 19 nt, Artificial Sequence
  Synthetic
cgcucggcggaccacuccg

SEQ ID NO: 11195 - RNA, 20 nt, Artificial Sequence
  Synthetic
gcgcucggcggaccacuccg

SEQ ID NO: 11196 - RNA, 21 nt, Artificial Sequence
  Synthetic
cgcgcucggcggaccacuccg

SEQ ID NO: 11197 - RNA, 22 nt, Artificial Sequence
  Synthetic
ccgcgcucggcggaccacuccg

SEQ ID NO: 11198 - RNA, 23 nt, Artificial Sequence
  Synthetic
gccgcgcucggcggaccacuccg

SEQ ID NO: 11199 - RNA, 24 nt, Artificial Sequence
  Synthetic
cgccgcgcucggcggaccacuccg

SEQ ID NO: 11200 - RNA, 18 nt, Artificial Sequence
  Synthetic
gcggcccgcgcagcuccg

SEQ ID NO: 11201 - RNA, 19 nt, Artificial Sequence
  Synthetic
cgcggcccgcgcagcuccg

SEQ ID NO: 11202 - RNA, 20 nt, Artificial Sequence
  Synthetic
ccgcggcccgcgcagcuccg

SEQ ID NO: 11203 - RNA, 21 nt, Artificial Sequence
  Synthetic
gccgcggcccgcgcagcuccg

SEQ ID NO: 11204 - RNA, 22 nt, Artificial Sequence
  Synthetic
cgccgcggcccgcgcagcuccg

SEQ ID NO: 11205 - RNA, 23 nt, Artificial Sequence
  Synthetic
ccgccgcggcccgcgcagcuccg

SEQ ID NO: 11206 - RNA, 24 nt, Artificial Sequence
  Synthetic
cccgccgcggcccgcgcagcuccg

SEQ ID NO: 11207 - RNA, 18 nt, Artificial Sequence
  Synthetic
cgcccugcgcgcccagcg

SEQ ID NO: 11208 - RNA, 19 nt, Artificial Sequence
  Synthetic
acgcccugcgcgcccagcg

SEQ ID NO: 11209 - RNA, 20 nt, Artificial Sequence
  Synthetic
cacgcccugcgcgcccagcg

SEQ ID NO: 11210 - RNA, 21 nt, Artificial Sequence
  Synthetic
gcacgcccugcgcgcccagcg

SEQ ID NO: 11211 - RNA, 22 nt, Artificial Sequence
  Synthetic
agcacgcccugcgcgcccagcg

SEQ ID NO: 11212 - RNA, 23 nt, Artificial Sequence
  Synthetic
cagcacgcccugcgcgcccagcg

SEQ ID NO: 11213 - RNA, 24 nt, Artificial Sequence
  Synthetic
gcagcacgcccugcgcgcccagcg

SEQ ID NO: 11214 - RNA, 18 nt, Artificial Sequence
  Synthetic
cggcccggccguccagcg

SEQ ID NO: 11215 - RNA, 19 nt, Artificial Sequence
  Synthetic
gcggcccggccguccagcg

SEQ ID NO: 11216 - RNA, 20 nt, Artificial Sequence
  Synthetic
ggcggcccggccguccagcg

SEQ ID NO: 11217 - RNA, 21 nt, Artificial Sequence
  Synthetic
cggcggcccggccguccagcg

SEQ ID NO: 11218 - RNA, 22 nt, Artificial Sequence
  Synthetic
gcggcggcccggccguccagcg

SEQ ID NO: 11219 - RNA, 23 nt, Artificial Sequence
  Synthetic
ggcggcggcccggccguccagcg

SEQ ID NO: 11220 - RNA, 24 nt, Artificial Sequence
  Synthetic
aggcggcggcccggccguccagcg

SEQ ID NO: 11221 - RNA, 18 nt, Artificial Sequence
  Synthetic
gcgggcuccgcggcagcg

SEQ ID NO: 11222 - RNA, 19 nt, Artificial Sequence
  Synthetic
cgcgggcuccgcggcagcg

SEQ ID NO: 11223 - RNA, 20 nt, Artificial Sequence
  Synthetic
gcgcgggcuccgcggcagcg

SEQ ID NO: 11224 - RNA, 21 nt, Artificial Sequence
  Synthetic
ggcgcgggcuccgcggcagcg

SEQ ID NO: 11225 - RNA, 22 nt, Artificial Sequence
  Synthetic
aggcgcgggcuccgcggcagcg

SEQ ID NO: 11226 - RNA, 23 nt, Artificial Sequence
  Synthetic
caggcgcgggcuccgcggcagcg

SEQ ID NO: 11227 - RNA, 24 nt, Artificial Sequence
  Synthetic
gcaggcgcgggcuccgcggcagcg

SEQ ID NO: 11228 - RNA, 18 nt, Artificial Sequence
  Synthetic
gccuccucgucguccgcg

SEQ ID NO: 11229 - RNA, 19 nt, Artificial Sequence
  Synthetic
cgccuccucgucguccgcg

SEQ ID NO: 11230 - RNA, 20 nt, Artificial Sequence
  Synthetic
ccgccuccucgucguccgcg

SEQ ID NO: 11231 - RNA, 21 nt, Artificial Sequence
  Synthetic
cccgccuccucgucguccgcg

SEQ ID NO: 11232 - RNA, 22 nt, Artificial Sequence
  Synthetic
ccccgccuccucgucguccgcg

SEQ ID NO: 11233 - RNA, 23 nt, Artificial Sequence
  Synthetic
cccccgccuccucgucguccgcg

SEQ ID NO: 11234 - RNA, 24 nt, Artificial Sequence
  Synthetic
acccccgccuccucgucguccgcg

SEQ ID NO: 11235 - RNA, 18 nt, Artificial Sequence
  Synthetic
ucgagcagcgcccgcgcg

SEQ ID NO: 11236 - RNA, 19 nt, Artificial Sequence
  Synthetic
cucgagcagcgcccgcgcg

SEQ ID NO: 11237 - RNA, 20 nt, Artificial Sequence
  Synthetic
gcucgagcagcgcccgcgcg

SEQ ID NO: 11238 - RNA, 21 nt, Artificial Sequence
  Synthetic
ggcucgagcagcgcccgcgcg

SEQ ID NO: 11239 - RNA, 22 nt, Artificial Sequence
  Synthetic
gggcucgagcagcgcccgcgcg

SEQ ID NO: 11240 - RNA, 23 nt, Artificial Sequence
  Synthetic
cgggcucgagcagcgcccgcgcg

SEQ ID NO: 11241 - RNA, 24 nt, Artificial Sequence
  Synthetic
ucgggcucgagcagcgcccgcgcg

SEQ ID NO: 11242 - RNA, 18 nt, Artificial Sequence
  Synthetic
ccgucgcgguagcgcgcg

SEQ ID NO: 11243 - RNA, 19 nt, Artificial Sequence
  Synthetic
cccgucgcgguagcgcgcg

SEQ ID NO: 11244 - RNA, 20 nt, Artificial Sequence
  Synthetic
acccgucgcgguagcgcgcg

SEQ ID NO: 11245 - RNA, 21 nt, Artificial Sequence
  Synthetic
uacccgucgcgguagcgcgcg

SEQ ID NO: 11246 - RNA, 22 nt, Artificial Sequence
  Synthetic
guacccgucgcgguagcgcgcg

SEQ ID NO: 11247 - RNA, 23 nt, Artificial Sequence
  Synthetic
cguacccgucgcgguagcgcgcg

SEQ ID NO: 11248 - RNA, 24 nt, Artificial Sequence
  Synthetic
acguacccgucgcgguagcgcgcg

SEQ ID NO: 11249 - RNA, 18 nt, Artificial Sequence
  Synthetic
gccgggcgccacggcgcg

SEQ ID NO: 11250 - RNA, 19 nt, Artificial Sequence
  Synthetic
ggccgggcgccacggcgcg

SEQ ID NO: 11251 - RNA, 20 nt, Artificial Sequence
  Synthetic
gggccgggcgccacggcgcg

SEQ ID NO: 11252 - RNA, 21 nt, Artificial Sequence
  Synthetic
agggccgggcgccacggcgcg

SEQ ID NO: 11253 - RNA, 22 nt, Artificial Sequence
  Synthetic
gagggccgggcgccacggcgcg

SEQ ID NO: 11254 - RNA, 23 nt, Artificial Sequence
  Synthetic
ugagggccgggcgccacggcgcg

SEQ ID NO: 11255 - RNA, 24 nt, Artificial Sequence
  Synthetic
augagggccgggcgccacggcgcg

SEQ ID NO: 11256 - RNA, 18 nt, Artificial Sequence
  Synthetic
ucgcagaaguccggcgcg

SEQ ID NO: 11257 - RNA, 19 nt, Artificial Sequence
  Synthetic
cucgcagaaguccggcgcg

SEQ ID NO: 11258 - RNA, 20 nt, Artificial Sequence
  Synthetic
ccucgcagaaguccggcgcg

SEQ ID NO: 11259 - RNA, 21 nt, Artificial Sequence
  Synthetic
uccucgcagaaguccggcgcg

SEQ ID NO: 11260 - RNA, 22 nt, Artificial Sequence
  Synthetic
guccucgcagaaguccggcgcg

SEQ ID NO: 11261 - RNA, 23 nt, Artificial Sequence
  Synthetic
cguccucgcagaaguccggcgcg

SEQ ID NO: 11262 - RNA, 24 nt, Artificial Sequence
  Synthetic
ucguccucgcagaaguccggcgcg

SEQ ID NO: 11263 - RNA, 18 nt, Artificial Sequence
  Synthetic
aggcgcagcggcggcgcg

SEQ ID NO: 11264 - RNA, 19 nt, Artificial Sequence
  Synthetic
gaggcgcagcggcggcgcg

SEQ ID NO: 11265 - RNA, 20 nt, Artificial Sequence
  Synthetic
agaggcgcagcggcggcgcg

SEQ ID NO: 11266 - RNA, 21 nt, Artificial Sequence
  Synthetic
cagaggcgcagcggcggcgcg

SEQ ID NO: 11267 - RNA, 22 nt, Artificial Sequence
  Synthetic
gcagaggcgcagcggcggcgcg

SEQ ID NO: 11268 - RNA, 23 nt, Artificial Sequence
  Synthetic
ggcagaggcgcagcggcggcgcg

SEQ ID NO: 11269 - RNA, 24 nt, Artificial Sequence
  Synthetic
cggcagaggcgcagcggcggcgcg

SEQ ID NO: 11270 - RNA, 18 nt, Artificial Sequence
  Synthetic
ggcgcggaggcgggcgcg

SEQ ID NO: 11271 - RNA, 19 nt, Artificial Sequence
  Synthetic
cggcgcggaggcgggcgcg

SEQ ID NO: 11272 - RNA, 20 nt, Artificial Sequence
  Synthetic
gcggcgcggaggcgggcgcg

SEQ ID NO: 11273 - RNA, 21 nt, Artificial Sequence
  Synthetic
cgcggcgcggaggcgggcgcg

SEQ ID NO: 11274 - RNA, 22 nt, Artificial Sequence
  Synthetic
ccgcggcgcggaggcgggcgcg

SEQ ID NO: 11275 - RNA, 23 nt, Artificial Sequence
  Synthetic
cccgcggcgcggaggcgggcgcg

SEQ ID NO: 11276 - RNA, 24 nt, Artificial Sequence
  Synthetic
ucccgcggcgcggaggcgggcgcg

SEQ ID NO: 11277 - RNA, 18 nt, Artificial Sequence
  Synthetic
cccgggcgcgggggcgcg

SEQ ID NO: 11278 - RNA, 19 nt, Artificial Sequence
  Synthetic
ccccgggcgcgggggcgcg

SEQ ID NO: 11279 - RNA, 20 nt, Artificial Sequence
  Synthetic
gccccgggcgcgggggcgcg

SEQ ID NO: 11280 - RNA, 21 nt, Artificial Sequence
  Synthetic
ggccccgggcgcgggggcgcg

SEQ ID NO: 11281 - RNA, 22 nt, Artificial Sequence
  Synthetic
gggccccgggcgcgggggcgcg

SEQ ID NO: 11282 - RNA, 23 nt, Artificial Sequence
  Synthetic
cgggccccgggcgcgggggcgcg

SEQ ID NO: 11283 - RNA, 24 nt, Artificial Sequence
  Synthetic
gcgggccccgggcgcgggggcgcg

SEQ ID NO: 11284 - RNA, 18 nt, Artificial Sequence
  Synthetic
ggcgcggcgguacucgcg

SEQ ID NO: 11285 - RNA, 19 nt, Artificial Sequence
  Synthetic
cggcgcggcgguacucgcg

SEQ ID NO: 11286 - RNA, 20 nt, Artificial Sequence
  Synthetic
acggcgcggcgguacucgcg

SEQ ID NO: 11287 - RNA, 21 nt, Artificial Sequence
  Synthetic
cacggcgcggcgguacucgcg

SEQ ID NO: 11288 - RNA, 22 nt, Artificial Sequence
  Synthetic
gcacggcgcggcgguacucgcg

SEQ ID NO: 11289 - RNA, 23 nt, Artificial Sequence
  Synthetic
agcacggcgcggcgguacucgcg

SEQ ID NO: 11290 - RNA, 24 nt, Artificial Sequence
  Synthetic
gagcacggcgcggcgguacucgcg

SEQ ID NO: 11291 - RNA, 18 nt, Artificial Sequence
  Synthetic
uagcgcgcguagaaggcg

SEQ ID NO: 11292 - RNA, 19 nt, Artificial Sequence
  Synthetic
guagcgcgcguagaaggcg

SEQ ID NO: 11293 - RNA, 20 nt, Artificial Sequence
  Synthetic
gguagcgcgcguagaaggcg

SEQ ID NO: 11294 - RNA, 21 nt, Artificial Sequence
  Synthetic
cgguagcgcgcguagaaggcg

SEQ ID NO: 11295 - RNA, 22 nt, Artificial Sequence
  Synthetic
gcgguagcgcgcguagaaggcg

SEQ ID NO: 11296 - RNA, 23 nt, Artificial Sequence
  Synthetic
cgcgguagcgcgcguagaaggcg

SEQ ID NO: 11297 - RNA, 24 nt, Artificial Sequence
  Synthetic
ucgcgguagcgcgcguagaaggcg

SEQ ID NO: 11298 - RNA, 18 nt, Artificial Sequence
  Synthetic
cgcagcgggccgaaggcg

SEQ ID NO: 11299 - RNA, 19 nt, Artificial Sequence
  Synthetic
gcgcagcgggccgaaggcg

SEQ ID NO: 11300 - RNA, 20 nt, Artificial Sequence
  Synthetic
cgcgcagcgggccgaaggcg

SEQ ID NO: 11301 - RNA, 21 nt, Artificial Sequence
  Synthetic
gcgcgcagcgggccgaaggcg

SEQ ID NO: 11302 - RNA, 22 nt, Artificial Sequence
  Synthetic
ggcgcgcagcgggccgaaggcg

SEQ ID NO: 11303 - RNA, 23 nt, Artificial Sequence
  Synthetic
aggcgcgcagcgggccgaaggcg

SEQ ID NO: 11304 - RNA, 24 nt, Artificial Sequence
  Synthetic
gaggcgcgcagcgggccgaaggcg

SEQ ID NO: 11305 - RNA, 18 nt, Artificial Sequence
  Synthetic
gacgaggaggaggaggcg

SEQ ID NO: 11306 - RNA, 19 nt, Artificial Sequence
  Synthetic
agacgaggaggaggaggcg

SEQ ID NO: 11307 - RNA, 20 nt, Artificial Sequence
  Synthetic
cagacgaggaggaggaggcg

SEQ ID NO: 11308 - RNA, 21 nt, Artificial Sequence
  Synthetic
gcagacgaggaggaggaggcg

SEQ ID NO: 11309 - RNA, 22 nt, Artificial Sequence
  Synthetic
ugcagacgaggaggaggaggcg

SEQ ID NO: 11310 - RNA, 23 nt, Artificial Sequence
  Synthetic
augcagacgaggaggaggaggcg

SEQ ID NO: 11311 - RNA, 24 nt, Artificial Sequence
  Synthetic
gaugcagacgaggaggaggaggcg

SEQ ID NO: 11312 - RNA, 18 nt, Artificial Sequence
  Synthetic
gaggcggaggaggaggcg

SEQ ID NO: 11313 - RNA, 19 nt, Artificial Sequence
  Synthetic
ggaggcggaggaggaggcg

SEQ ID NO: 11314 - RNA, 20 nt, Artificial Sequence
  Synthetic
aggaggcggaggaggaggcg

SEQ ID NO: 11315 - RNA, 21 nt, Artificial Sequence
  Synthetic
gaggaggcggaggaggaggcg

SEQ ID NO: 11316 - RNA, 22 nt, Artificial Sequence
  Synthetic
ggaggaggcggaggaggaggcg

SEQ ID NO: 11317 - RNA, 23 nt, Artificial Sequence
  Synthetic
aggaggaggcggaggaggaggcg

SEQ ID NO: 11318 - RNA, 24 nt, Artificial Sequence
  Synthetic
gaggaggaggcggaggaggaggcg

SEQ ID NO: 11319 - RNA, 18 nt, Artificial Sequence
  Synthetic
gggccgggcgccacggcg

SEQ ID NO: 11320 - RNA, 19 nt, Artificial Sequence
  Synthetic
agggccgggcgccacggcg

SEQ ID NO: 11321 - RNA, 20 nt, Artificial Sequence
  Synthetic
gagggccgggcgccacggcg

SEQ ID NO: 11322 - RNA, 21 nt, Artificial Sequence
  Synthetic
ugagggccgggcgccacggcg

SEQ ID NO: 11323 - RNA, 22 nt, Artificial Sequence
  Synthetic
augagggccgggcgccacggcg

SEQ ID NO: 11324 - RNA, 23 nt, Artificial Sequence
  Synthetic
caugagggccgggcgccacggcg

SEQ ID NO: 11325 - RNA, 24 nt, Artificial Sequence
  Synthetic
acaugagggccgggcgccacggcg

SEQ ID NO: 11326 - RNA, 18 nt, Artificial Sequence
  Synthetic
ggcggccgagcgccggcg

SEQ ID NO: 11327 - RNA, 19 nt, Artificial Sequence
  Synthetic
aggcggccgagcgccggcg

SEQ ID NO: 11328 - RNA, 20 nt, Artificial Sequence
  Synthetic
gaggcggccgagcgccggcg

SEQ ID NO: 11329 - RNA, 21 nt, Artificial Sequence
  Synthetic
agaggcggccgagcgccggcg

SEQ ID NO: 11330 - RNA, 22 nt, Artificial Sequence
  Synthetic
cagaggcggccgagcgccggcg

SEQ ID NO: 11331 - RNA, 23 nt, Artificial Sequence
  Synthetic
ucagaggcggccgagcgccggcg

SEQ ID NO: 11332 - RNA, 24 nt, Artificial Sequence
  Synthetic
gucagaggcggccgagcgccggcg

SEQ ID NO: 11333 - RNA, 18 nt, Artificial Sequence
  Synthetic
cgucggccccggccggcg

SEQ ID NO: 11334 - RNA, 19 nt, Artificial Sequence
  Synthetic
ucgucggccccggccggcg

SEQ ID NO: 11335 - RNA, 20 nt, Artificial Sequence
  Synthetic
gucgucggccccggccggcg

SEQ ID NO: 11336 - RNA, 21 nt, Artificial Sequence
  Synthetic
cgucgucggccccggccggcg

SEQ ID NO: 11337 - RNA, 22 nt, Artificial Sequence
  Synthetic
ucgucgucggccccggccggcg

SEQ ID NO: 11338 - RNA, 23 nt, Artificial Sequence
  Synthetic
gucgucgucggccccggccggcg

SEQ ID NO: 11339 - RNA, 24 nt, Artificial Sequence
  Synthetic
cgucgucgucggccccggccggcg

SEQ ID NO: 11340 - RNA, 18 nt, Artificial Sequence
  Synthetic
ugcgcgccucccgcggcg

SEQ ID NO: 11341 - RNA, 19 nt, Artificial Sequence
  Synthetic
uugcgcgccucccgcggcg

SEQ ID NO: 11342 - RNA, 20 nt, Artificial Sequence
  Synthetic
cuugcgcgccucccgcggcg

SEQ ID NO: 11343 - RNA, 21 nt, Artificial Sequence
  Synthetic
gcuugcgcgccucccgcggcg

SEQ ID NO: 11344 - RNA, 22 nt, Artificial Sequence
  Synthetic
cgcuugcgcgccucccgcggcg

SEQ ID NO: 11345 - RNA, 23 nt, Artificial Sequence
  Synthetic
gcgcuugcgcgccucccgcggcg

SEQ ID NO: 11346 - RNA, 24 nt, Artificial Sequence
  Synthetic
ugcgcuugcgcgccucccgcggcg

SEQ ID NO: 11347 - RNA, 18 nt, Artificial Sequence
  Synthetic
uccgcggcggcggcggcg

SEQ ID NO: 11348 - RNA, 19 nt, Artificial Sequence
  Synthetic
guccgcggcggcggcggcg

SEQ ID NO: 11349 - RNA, 20 nt, Artificial Sequence
  Synthetic
gguccgcggcggcggcggcg

SEQ ID NO: 11350 - RNA, 21 nt, Artificial Sequence
  Synthetic
agguccgcggcggcggcggcg

SEQ ID NO: 11351 - RNA, 22 nt, Artificial Sequence
  Synthetic
cagguccgcggcggcggcggcg

SEQ ID NO: 11352 - RNA, 23 nt, Artificial Sequence
  Synthetic
gcagguccgcggcggcggcggcg

SEQ ID NO: 11353 - RNA, 24 nt, Artificial Sequence
  Synthetic
agcagguccgcggcggcggcggcg

SEQ ID NO: 11354 - RNA, 18 nt, Artificial Sequence
  Synthetic
aacggggcggcggcggcg

SEQ ID NO: 11355 - RNA, 19 nt, Artificial Sequence
  Synthetic
caacggggcggcggcggcg

SEQ ID NO: 11356 - RNA, 20 nt, Artificial Sequence
  Synthetic
gcaacggggcggcggcggcg

SEQ ID NO: 11357 - RNA, 21 nt, Artificial Sequence
  Synthetic
ggcaacggggcggcggcggcg

SEQ ID NO: 11358 - RNA, 22 nt, Artificial Sequence
  Synthetic
cggcaacggggcggcggcggcg

SEQ ID NO: 11359 - RNA, 23 nt, Artificial Sequence
  Synthetic
acggcaacggggcggcggcggcg

SEQ ID NO: 11360 - RNA, 24 nt, Artificial Sequence
  Synthetic
gacggcaacggggcggcggcggcg

SEQ ID NO: 11361 - RNA, 18 nt, Artificial Sequence
  Synthetic
cucaggcgccccagggcg

SEQ ID NO: 11362 - RNA, 19 nt, Artificial Sequence
  Synthetic
gcucaggcgccccagggcg

SEQ ID NO: 11363 - RNA, 20 nt, Artificial Sequence
  Synthetic
cgcucaggcgccccagggcg

SEQ ID NO: 11364 - RNA, 21 nt, Artificial Sequence
  Synthetic
gcgcucaggcgccccagggcg

SEQ ID NO: 11365 - RNA, 22 nt, Artificial Sequence
  Synthetic
ggcgcucaggcgccccagggcg

SEQ ID NO: 11366 - RNA, 23 nt, Artificial Sequence
  Synthetic
cggcgcucaggcgccccagggcg

SEQ ID NO: 11367 - RNA, 24 nt, Artificial Sequence
  Synthetic
gcggcgcucaggcgccccagggcg

SEQ ID NO: 11368 - RNA, 18 nt, Artificial Sequence
  Synthetic
cgggcgcccacacgggcg

SEQ ID NO: 11369 - RNA, 19 nt, Artificial Sequence
  Synthetic
ucgggcgcccacacgggcg

SEQ ID NO: 11370 - RNA, 20 nt, Artificial Sequence
  Synthetic
cucgggcgcccacacgggcg

SEQ ID NO: 11371 - RNA, 21 nt, Artificial Sequence
  Synthetic
gcucgggcgcccacacgggcg

SEQ ID NO: 11372 - RNA, 22 nt, Artificial Sequence
  Synthetic
agcucgggcgcccacacgggcg

SEQ ID NO: 11373 - RNA, 23 nt, Artificial Sequence
  Synthetic
cagcucgggcgcccacacgggcg

SEQ ID NO: 11374 - RNA, 24 nt, Artificial Sequence
  Synthetic
ccagcucgggcgcccacacgggcg

SEQ ID NO: 11375 - RNA, 18 nt, Artificial Sequence
  Synthetic
gcccgcgggccccgggcg

SEQ ID NO: 11376 - RNA, 19 nt, Artificial Sequence
  Synthetic
cgcccgcgggccccgggcg

SEQ ID NO: 11377 - RNA, 20 nt, Artificial Sequence
  Synthetic
gcgcccgcgggccccgggcg

SEQ ID NO: 11378 - RNA, 21 nt, Artificial Sequence
  Synthetic
cgcgcccgcgggccccgggcg

SEQ ID NO: 11379 - RNA, 22 nt, Artificial Sequence
  Synthetic
ccgcgcccgcgggccccgggcg

SEQ ID NO: 11380 - RNA, 23 nt, Artificial Sequence
  Synthetic
gccgcgcccgcgggccccgggcg

SEQ ID NO: 11381 - RNA, 24 nt, Artificial Sequence
  Synthetic
ggccgcgcccgcgggccccgggcg

SEQ ID NO: 11382 - RNA, 18 nt, Artificial Sequence
  Synthetic
aggggcggccgcggggcg

SEQ ID NO: 11383 - RNA, 19 nt, Artificial Sequence
  Synthetic
gaggggcggccgcggggcg

SEQ ID NO: 11384 - RNA, 20 nt, Artificial Sequence
  Synthetic
ggaggggcggccgcggggcg

SEQ ID NO: 11385 - RNA, 21 nt, Artificial Sequence
  Synthetic
gggaggggcggccgcggggcg

SEQ ID NO: 11386 - RNA, 22 nt, Artificial Sequence
  Synthetic
cgggaggggcggccgcggggcg

SEQ ID NO: 11387 - RNA, 23 nt, Artificial Sequence
  Synthetic
gcgggaggggcggccgcggggcg

SEQ ID NO: 11388 - RNA, 24 nt, Artificial Sequence
  Synthetic
cgcgggaggggcggccgcggggcg

SEQ ID NO: 11389 - RNA, 18 nt, Artificial Sequence
  Synthetic
ggcggcgucggcggggcg

SEQ ID NO: 11390 - RNA, 19 nt, Artificial Sequence
  Synthetic
cggcggcgucggcggggcg

SEQ ID NO: 11391 - RNA, 20 nt, Artificial Sequence
  Synthetic
gcggcggcgucggcggggcg

SEQ ID NO: 11392 - RNA, 21 nt, Artificial Sequence
  Synthetic
ggcggcggcgucggcggggcg

SEQ ID NO: 11393 - RNA, 22 nt, Artificial Sequence
  Synthetic
cggcggcggcgucggcggggcg

SEQ ID NO: 11394 - RNA, 23 nt, Artificial Sequence
  Synthetic
gcggcggcggcgucggcggggcg

SEQ ID NO: 11395 - RNA, 24 nt, Artificial Sequence
  Synthetic
cgcggcggcggcgucggcggggcg

SEQ ID NO: 11396 - RNA, 18 nt, Artificial Sequence
  Synthetic
gguggugucggcggggcg

SEQ ID NO: 11397 - RNA, 19 nt, Artificial Sequence
  Synthetic
ugguggugucggcggggcg

SEQ ID NO: 11398 - RNA, 20 nt, Artificial Sequence
  Synthetic
gugguggugucggcggggcg

SEQ ID NO: 11399 - RNA, 21 nt, Artificial Sequence
  Synthetic
ggugguggugucggcggggcg

SEQ ID NO: 11400 - RNA, 22 nt, Artificial Sequence
  Synthetic
uggugguggugucggcggggcg

SEQ ID NO: 11401 - RNA, 23 nt, Artificial Sequence
  Synthetic
guggugguggugucggcggggcg

SEQ ID NO: 11402 - RNA, 24 nt, Artificial Sequence
  Synthetic
gguggugguggugucggcggggcg

SEQ ID NO: 11403 - RNA, 18 nt, Artificial Sequence
  Synthetic
gcacgcgccccgggggcg

SEQ ID NO: 11404 - RNA, 19 nt, Artificial Sequence
  Synthetic
agcacgcgccccgggggcg

SEQ ID NO: 11405 - RNA, 20 nt, Artificial Sequence
  Synthetic
cagcacgcgccccgggggcg

SEQ ID NO: 11406 - RNA, 21 nt, Artificial Sequence
  Synthetic
acagcacgcgccccgggggcg

SEQ ID NO: 11407 - RNA, 22 nt, Artificial Sequence
  Synthetic
uacagcacgcgccccgggggcg

SEQ ID NO: 11408 - RNA, 23 nt, Artificial Sequence
  Synthetic
guacagcacgcgccccgggggcg

SEQ ID NO: 11409 - RNA, 24 nt, Artificial Sequence
  Synthetic
cguacagcacgcgccccgggggcg

SEQ ID NO: 11410 - RNA, 18 nt, Artificial Sequence
  Synthetic
gcucuucuucggggggcg

SEQ ID NO: 11411 - RNA, 19 nt, Artificial Sequence
  Synthetic
ggcucuucuucggggggcg

SEQ ID NO: 11412 - RNA, 20 nt, Artificial Sequence
  Synthetic
cggcucuucuucggggggcg

SEQ ID NO: 11413 - RNA, 21 nt, Artificial Sequence
  Synthetic
gcggcucuucuucggggggcg

SEQ ID NO: 11414 - RNA, 22 nt, Artificial Sequence
  Synthetic
cgcggcucuucuucggggggcg

SEQ ID NO: 11415 - RNA, 23 nt, Artificial Sequence
  Synthetic
gcgcggcucuucuucggggggcg

SEQ ID NO: 11416 - RNA, 24 nt, Artificial Sequence
  Synthetic
cgcgcggcucuucuucggggggcg

SEQ ID NO: 11417 - RNA, 18 nt, Artificial Sequence
  Synthetic
ggggcgcgucggcgugcg

SEQ ID NO: 11418 - RNA, 19 nt, Artificial Sequence
  Synthetic
cggggcgcgucggcgugcg

SEQ ID NO: 11419 - RNA, 20 nt, Artificial Sequence
  Synthetic
gcggggcgcgucggcgugcg

SEQ ID NO: 11420 - RNA, 21 nt, Artificial Sequence
  Synthetic
ggcggggcgcgucggcgugcg

SEQ ID NO: 11421 - RNA, 22 nt, Artificial Sequence
  Synthetic
aggcggggcgcgucggcgugcg

SEQ ID NO: 11422 - RNA, 23 nt, Artificial Sequence
  Synthetic
caggcggggcgcgucggcgugcg

SEQ ID NO: 11423 - RNA, 24 nt, Artificial Sequence
  Synthetic
gcaggcggggcgcgucggcgugcg

SEQ ID NO: 11424 - RNA, 18 nt, Artificial Sequence
  Synthetic
ugcgggucggggcccucg

SEQ ID NO: 11425 - RNA, 19 nt, Artificial Sequence
  Synthetic
cugcgggucggggcccucg

SEQ ID NO: 11426 - RNA, 20 nt, Artificial Sequence
  Synthetic
ccugcgggucggggcccucg

SEQ ID NO: 11427 - RNA, 21 nt, Artificial Sequence
  Synthetic
cccugcgggucggggcccucg

SEQ ID NO: 11428 - RNA, 22 nt, Artificial Sequence
  Synthetic
gcccugcgggucggggcccucg

SEQ ID NO: 11429 - RNA, 23 nt, Artificial Sequence
  Synthetic
cgcccugcgggucggggcccucg

SEQ ID NO: 11430 - RNA, 24 nt, Artificial Sequence
  Synthetic
ccgcccugcgggucggggcccucg

SEQ ID NO: 11431 - RNA, 18 nt, Artificial Sequence
  Synthetic
gagugcgccucguccucg

SEQ ID NO: 11432 - RNA, 19 nt, Artificial Sequence
  Synthetic
cgagugcgccucguccucg

SEQ ID NO: 11433 - RNA, 20 nt, Artificial Sequence
  Synthetic
gcgagugcgccucguccucg

SEQ ID NO: 11434 - RNA, 21 nt, Artificial Sequence
  Synthetic
ugcgagugcgccucguccucg

SEQ ID NO: 11435 - RNA, 22 nt, Artificial Sequence
  Synthetic
gugcgagugcgccucguccucg

SEQ ID NO: 11436 - RNA, 23 nt, Artificial Sequence
  Synthetic
ggugcgagugcgccucguccucg

SEQ ID NO: 11437 - RNA, 24 nt, Artificial Sequence
  Synthetic
cggugcgagugcgccucguccucg

SEQ ID NO: 11438 - RNA, 18 nt, Artificial Sequence
  Synthetic
gacagcccgccgcgcucg

SEQ ID NO: 11439 - RNA, 19 nt, Artificial Sequence
  Synthetic
ggacagcccgccgcgcucg

SEQ ID NO: 11440 - RNA, 20 nt, Artificial Sequence
  Synthetic
aggacagcccgccgcgcucg

SEQ ID NO: 11441 - RNA, 21 nt, Artificial Sequence
  Synthetic
caggacagcccgccgcgcucg

SEQ ID NO: 11442 - RNA, 22 nt, Artificial Sequence
  Synthetic
gcaggacagcccgccgcgcucg

SEQ ID NO: 11443 - RNA, 23 nt, Artificial Sequence
  Synthetic
ggcaggacagcccgccgcgcucg

SEQ ID NO: 11444 - RNA, 24 nt, Artificial Sequence
  Synthetic
aggcaggacagcccgccgcgcucg

SEQ ID NO: 11445 - RNA, 18 nt, Artificial Sequence
  Synthetic
gagaccacgggcccgucg

SEQ ID NO: 11446 - RNA, 19 nt, Artificial Sequence
  Synthetic
cgagaccacgggcccgucg

SEQ ID NO: 11447 - RNA, 20 nt, Artificial Sequence
  Synthetic
gcgagaccacgggcccgucg

SEQ ID NO: 11448 - RNA, 21 nt, Artificial Sequence
  Synthetic
cgcgagaccacgggcccgucg

SEQ ID NO: 11449 - RNA, 22 nt, Artificial Sequence
  Synthetic
ccgcgagaccacgggcccgucg

SEQ ID NO: 11450 - RNA, 23 nt, Artificial Sequence
  Synthetic
gccgcgagaccacgggcccgucg

SEQ ID NO: 11451 - RNA, 24 nt, Artificial Sequence
  Synthetic
ugccgcgagaccacgggcccgucg

SEQ ID NO: 11452 - RNA, 18 nt, Artificial Sequence
  Synthetic
uuggcgucgccgccgucg

SEQ ID NO: 11453 - RNA, 19 nt, Artificial Sequence
  Synthetic
guuggcgucgccgccgucg

SEQ ID NO: 11454 - RNA, 20 nt, Artificial Sequence
  Synthetic
gguuggcgucgccgccgucg

SEQ ID NO: 11455 - RNA, 21 nt, Artificial Sequence
  Synthetic
cgguuggcgucgccgccgucg

SEQ ID NO: 11456 - RNA, 22 nt, Artificial Sequence
  Synthetic
gcgguuggcgucgccgccgucg

SEQ ID NO: 11457 - RNA, 23 nt, Artificial Sequence
  Synthetic
ggcgguuggcgucgccgccgucg

SEQ ID NO: 11458 - RNA, 24 nt, Artificial Sequence
  Synthetic
uggcgguuggcgucgccgccgucg

SEQ ID NO: 11459 - RNA, 18 nt, Artificial Sequence
  Synthetic
gccgcggcggcggcgucg

SEQ ID NO: 11460 - RNA, 19 nt, Artificial Sequence
  Synthetic
ggccgcggcggcggcgucg

SEQ ID NO: 11461 - RNA, 20 nt, Artificial Sequence
  Synthetic
cggccgcggcggcggcgucg

SEQ ID NO: 11462 - RNA, 21 nt, Artificial Sequence
  Synthetic
gcggccgcggcggcggcgucg

SEQ ID NO: 11463 - RNA, 22 nt, Artificial Sequence
  Synthetic
ggcggccgcggcggcggcgucg

SEQ ID NO: 11464 - RNA, 23 nt, Artificial Sequence
  Synthetic
cggcggccgcggcggcggcgucg

SEQ ID NO: 11465 - RNA, 24 nt, Artificial Sequence
  Synthetic
gcggcggccgcggcggcggcgucg

SEQ ID NO: 11466 - RNA, 18 nt, Artificial Sequence
  Synthetic
gugguggugguggugucg

SEQ ID NO: 11467 - RNA, 19 nt, Artificial Sequence
  Synthetic
ggugguggugguggugucg

SEQ ID NO: 11468 - RNA, 20 nt, Artificial Sequence
  Synthetic
uggugguggugguggugucg

SEQ ID NO: 11469 - RNA, 21 nt, Artificial Sequence
  Synthetic
guggugguggugguggugucg

SEQ ID NO: 11470 - RNA, 22 nt, Artificial Sequence
  Synthetic
gguggugguggugguggugucg

SEQ ID NO: 11471 - RNA, 23 nt, Artificial Sequence
  Synthetic
ugguggugguggugguggugucg

SEQ ID NO: 11472 - RNA, 24 nt, Artificial Sequence
  Synthetic
gugguggugguggugguggugucg

SEQ ID NO: 11473 - RNA, 18 nt, Artificial Sequence
  Synthetic
ccgcgcggcucuucuucg

SEQ ID NO: 11474 - RNA, 19 nt, Artificial Sequence
  Synthetic
uccgcgcggcucuucuucg

SEQ ID NO: 11475 - RNA, 20 nt, Artificial Sequence
  Synthetic
guccgcgcggcucuucuucg

SEQ ID NO: 11476 - RNA, 21 nt, Artificial Sequence
  Synthetic
cguccgcgcggcucuucuucg

SEQ ID NO: 11477 - RNA, 22 nt, Artificial Sequence
  Synthetic
gcguccgcgcggcucuucuucg

SEQ ID NO: 11478 - RNA, 23 nt, Artificial Sequence
  Synthetic
ggcguccgcgcggcucuucuucg

SEQ ID NO: 11479 - RNA, 24 nt, Artificial Sequence
  Synthetic
gggcguccgcgcggcucuucuucg

SEQ ID NO: 11480 - RNA, 18 nt, Artificial Sequence
  Synthetic
gccauggcguaccccagg

SEQ ID NO: 11481 - RNA, 19 nt, Artificial Sequence
  Synthetic
cgccauggcguaccccagg

SEQ ID NO: 11482 - RNA, 20 nt, Artificial Sequence
  Synthetic
ccgccauggcguaccccagg

SEQ ID NO: 11483 - RNA, 21 nt, Artificial Sequence
  Synthetic
gccgccauggcguaccccagg

SEQ ID NO: 11484 - RNA, 22 nt, Artificial Sequence
  Synthetic
cgccgccauggcguaccccagg

SEQ ID NO: 11485 - RNA, 23 nt, Artificial Sequence
  Synthetic
ccgccgccauggcguaccccagg

SEQ ID NO: 11486 - RNA, 24 nt, Artificial Sequence
  Synthetic
cccgccgccauggcguaccccagg

SEQ ID NO: 11487 - RNA, 18 nt, Artificial Sequence
  Synthetic
cccagggccgccagcagg

SEQ ID NO: 11488 - RNA, 19 nt, Artificial Sequence
  Synthetic
gcccagggccgccagcagg

SEQ ID NO: 11489 - RNA, 20 nt, Artificial Sequence
  Synthetic
ugcccagggccgccagcagg

SEQ ID NO: 11490 - RNA, 21 nt, Artificial Sequence
  Synthetic
uugcccagggccgccagcagg

SEQ ID NO: 11491 - RNA, 22 nt, Artificial Sequence
  Synthetic
guugcccagggccgccagcagg

SEQ ID NO: 11492 - RNA, 23 nt, Artificial Sequence
  Synthetic
gguugcccagggccgccagcagg

SEQ ID NO: 11493 - RNA, 24 nt, Artificial Sequence
  Synthetic
cgguugcccagggccgccagcagg

SEQ ID NO: 11494 - RNA, 18 nt, Artificial Sequence
  Synthetic
cgcagccaggcgcgcagg

SEQ ID NO: 11495 - RNA, 19 nt, Artificial Sequence
  Synthetic
gcgcagccaggcgcgcagg

SEQ ID NO: 11496 - RNA, 20 nt, Artificial Sequence
  Synthetic
cgcgcagccaggcgcgcagg

SEQ ID NO: 11497 - RNA, 21 nt, Artificial Sequence
  Synthetic
ucgcgcagccaggcgcgcagg

SEQ ID NO: 11498 - RNA, 22 nt, Artificial Sequence
  Synthetic
cucgcgcagccaggcgcgcagg

SEQ ID NO: 11499 - RNA, 23 nt, Artificial Sequence
  Synthetic
gcucgcgcagccaggcgcgcagg

SEQ ID NO: 11500 - RNA, 24 nt, Artificial Sequence
  Synthetic
agcucgcgcagccaggcgcgcagg

SEQ ID NO: 11501 - RNA, 18 nt, Artificial Sequence
  Synthetic
ucgggcgccccccagagg

SEQ ID NO: 11502 - RNA, 19 nt, Artificial Sequence
  Synthetic
cucgggcgccccccagagg

SEQ ID NO: 11503 - RNA, 20 nt, Artificial Sequence
  Synthetic
ccucgggcgccccccagagg

SEQ ID NO: 11504 - RNA, 21 nt, Artificial Sequence
  Synthetic
gccucgggcgccccccagagg

SEQ ID NO: 11505 - RNA, 22 nt, Artificial Sequence
  Synthetic
cgccucgggcgccccccagagg

SEQ ID NO: 11506 - RNA, 23 nt, Artificial Sequence
  Synthetic
ccgccucgggcgccccccagagg

SEQ ID NO: 11507 - RNA, 24 nt, Artificial Sequence
  Synthetic
uccgccucgggcgccccccagagg

SEQ ID NO: 11508 - RNA, 18 nt, Artificial Sequence
  Synthetic
aggcggaugcagacgagg

SEQ ID NO: 11509 - RNA, 19 nt, Artificial Sequence
  Synthetic
gaggcggaugcagacgagg

SEQ ID NO: 11510 - RNA, 20 nt, Artificial Sequence
  Synthetic
ggaggcggaugcagacgagg

SEQ ID NO: 11511 - RNA, 21 nt, Artificial Sequence
  Synthetic
aggaggcggaugcagacgagg

SEQ ID NO: 11512 - RNA, 22 nt, Artificial Sequence
  Synthetic
gaggaggcggaugcagacgagg

SEQ ID NO: 11513 - RNA, 23 nt, Artificial Sequence
  Synthetic
cgaggaggcggaugcagacgagg

SEQ ID NO: 11514 - RNA, 24 nt, Artificial Sequence
  Synthetic
acgaggaggcggaugcagacgagg

SEQ ID NO: 11515 - RNA, 18 nt, Artificial Sequence
  Synthetic
cggaugcagacgaggagg

SEQ ID NO: 11516 - RNA, 19 nt, Artificial Sequence
  Synthetic
gcggaugcagacgaggagg

SEQ ID NO: 11517 - RNA, 20 nt, Artificial Sequence
  Synthetic
ggcggaugcagacgaggagg

SEQ ID NO: 11518 - RNA, 21 nt, Artificial Sequence
  Synthetic
aggcggaugcagacgaggagg

SEQ ID NO: 11519 - RNA, 22 nt, Artificial Sequence
  Synthetic
gaggcggaugcagacgaggagg

SEQ ID NO: 11520 - RNA, 23 nt, Artificial Sequence
  Synthetic
ggaggcggaugcagacgaggagg

SEQ ID NO: 11521 - RNA, 24 nt, Artificial Sequence
  Synthetic
aggaggcggaugcagacgaggagg

SEQ ID NO: 11522 - RNA, 18 nt, Artificial Sequence
  Synthetic
cagacgaggaggaggagg

SEQ ID NO: 11523 - RNA, 19 nt, Artificial Sequence
  Synthetic
gcagacgaggaggaggagg

SEQ ID NO: 11524 - RNA, 20 nt, Artificial Sequence
  Synthetic
ugcagacgaggaggaggagg

SEQ ID NO: 11525 - RNA, 21 nt, Artificial Sequence
  Synthetic
augcagacgaggaggaggagg

SEQ ID NO: 11526 - RNA, 22 nt, Artificial Sequence
  Synthetic
gaugcagacgaggaggaggagg

SEQ ID NO: 11527 - RNA, 23 nt, Artificial Sequence
  Synthetic
ggaugcagacgaggaggaggagg

SEQ ID NO: 11528 - RNA, 24 nt, Artificial Sequence
  Synthetic
cggaugcagacgaggaggaggagg

SEQ ID NO: 11529 - RNA, 18 nt, Artificial Sequence
  Synthetic
aggaggcggaggaggagg

SEQ ID NO: 11530 - RNA, 19 nt, Artificial Sequence
  Synthetic
gaggaggcggaggaggagg

SEQ ID NO: 11531 - RNA, 20 nt, Artificial Sequence
  Synthetic
ggaggaggcggaggaggagg

SEQ ID NO: 11532 - RNA, 21 nt, Artificial Sequence
  Synthetic
aggaggaggcggaggaggagg

SEQ ID NO: 11533 - RNA, 22 nt, Artificial Sequence
  Synthetic
gaggaggaggcggaggaggagg

SEQ ID NO: 11534 - RNA, 23 nt, Artificial Sequence
  Synthetic
ggaggaggaggcggaggaggagg

SEQ ID NO: 11535 - RNA, 24 nt, Artificial Sequence
  Synthetic
aggaggaggaggcggaggaggagg

SEQ ID NO: 11536 - RNA, 18 nt, Artificial Sequence
  Synthetic
aggaggaggaggcggagg

SEQ ID NO: 11537 - RNA, 19 nt, Artificial Sequence
  Synthetic
gaggaggaggaggcggagg

SEQ ID NO: 11538 - RNA, 20 nt, Artificial Sequence
  Synthetic
cgaggaggaggaggcggagg

SEQ ID NO: 11539 - RNA, 21 nt, Artificial Sequence
  Synthetic
acgaggaggaggaggcggagg

SEQ ID NO: 11540 - RNA, 22 nt, Artificial Sequence
  Synthetic
gacgaggaggaggaggcggagg

SEQ ID NO: 11541 - RNA, 23 nt, Artificial Sequence
  Synthetic
agacgaggaggaggaggcggagg

SEQ ID NO: 11542 - RNA, 24 nt, Artificial Sequence
  Synthetic
cagacgaggaggaggaggcggagg

SEQ ID NO: 11543 - RNA, 18 nt, Artificial Sequence
  Synthetic
gaggcggccgagcgccgg

SEQ ID NO: 11544 - RNA, 19 nt, Artificial Sequence
  Synthetic
agaggcggccgagcgccgg

SEQ ID NO: 11545 - RNA, 20 nt, Artificial Sequence
  Synthetic
cagaggcggccgagcgccgg

SEQ ID NO: 11546 - RNA, 21 nt, Artificial Sequence
  Synthetic
ucagaggcggccgagcgccgg

SEQ ID NO: 11547 - RNA, 22 nt, Artificial Sequence
  Synthetic
gucagaggcggccgagcgccgg

SEQ ID NO: 11548 - RNA, 23 nt, Artificial Sequence
  Synthetic
agucagaggcggccgagcgccgg

SEQ ID NO: 11549 - RNA, 24 nt, Artificial Sequence
  Synthetic
gagucagaggcggccgagcgccgg

SEQ ID NO: 11550 - RNA, 18 nt, Artificial Sequence
  Synthetic
cucggcggaccacuccgg

SEQ ID NO: 11551 - RNA, 19 nt, Artificial Sequence
  Synthetic
gcucggcggaccacuccgg

SEQ ID NO: 11552 - RNA, 20 nt, Artificial Sequence
  Synthetic
cgcucggcggaccacuccgg

SEQ ID NO: 11553 - RNA, 21 nt, Artificial Sequence
  Synthetic
gcgcucggcggaccacuccgg

SEQ ID NO: 11554 - RNA, 22 nt, Artificial Sequence
  Synthetic
cgcgcucggcggaccacuccgg

SEQ ID NO: 11555 - RNA, 23 nt, Artificial Sequence
  Synthetic
ccgcgcucggcggaccacuccgg

SEQ ID NO: 11556 - RNA, 24 nt, Artificial Sequence
  Synthetic
gccgcgcucggcggaccacuccgg

SEQ ID NO: 11557 - RNA, 18 nt, Artificial Sequence
  Synthetic
cccggcccgaacacgcgg

SEQ ID NO: 11558 - RNA, 19 nt, Artificial Sequence
  Synthetic
ccccggcccgaacacgcgg

SEQ ID NO: 11559 - RNA, 20 nt, Artificial Sequence
  Synthetic
cccccggcccgaacacgcgg

SEQ ID NO: 11560 - RNA, 21 nt, Artificial Sequence
  Synthetic
acccccggcccgaacacgcgg

SEQ ID NO: 11561 - RNA, 22 nt, Artificial Sequence
  Synthetic
gacccccggcccgaacacgcgg

SEQ ID NO: 11562 - RNA, 23 nt, Artificial Sequence
  Synthetic
agacccccggcccgaacacgcgg

SEQ ID NO: 11563 - RNA, 24 nt, Artificial Sequence
  Synthetic
aagacccccggcccgaacacgcgg

SEQ ID NO: 11564 - RNA, 18 nt, Artificial Sequence
  Synthetic
ggggcgcggcccccgcgg

SEQ ID NO: 11565 - RNA, 19 nt, Artificial Sequence
  Synthetic
gggggcgcggcccccgcgg

SEQ ID NO: 11566 - RNA, 20 nt, Artificial Sequence
  Synthetic
ggggggcgcggcccccgcgg

SEQ ID NO: 11567 - RNA, 21 nt, Artificial Sequence
  Synthetic
cggggggcgcggcccccgcgg

SEQ ID NO: 11568 - RNA, 22 nt, Artificial Sequence
  Synthetic
gcggggggcgcggcccccgcgg

SEQ ID NO: 11569 - RNA, 23 nt, Artificial Sequence
  Synthetic
ggcggggggcgcggcccccgcgg

SEQ ID NO: 11570 - RNA, 24 nt, Artificial Sequence
  Synthetic
gggcggggggcgcggcccccgcgg

SEQ ID NO: 11571 - RNA, 18 nt, Artificial Sequence
  Synthetic
cgcacguuggccccgcgg

SEQ ID NO: 11572 - RNA, 19 nt, Artificial Sequence
  Synthetic
ccgcacguuggccccgcgg

SEQ ID NO: 11573 - RNA, 20 nt, Artificial Sequence
  Synthetic
accgcacguuggccccgcgg

SEQ ID NO: 11574 - RNA, 21 nt, Artificial Sequence
  Synthetic
uaccgcacguuggccccgcgg

SEQ ID NO: 11575 - RNA, 22 nt, Artificial Sequence
  Synthetic
guaccgcacguuggccccgcgg

SEQ ID NO: 11576 - RNA, 23 nt, Artificial Sequence
  Synthetic
gguaccgcacguuggccccgcgg

SEQ ID NO: 11577 - RNA, 24 nt, Artificial Sequence
  Synthetic
cgguaccgcacguuggccccgcgg

SEQ ID NO: 11578 - RNA, 18 nt, Artificial Sequence
  Synthetic
uugaugagucagaggcgg

SEQ ID NO: 11579 - RNA, 19 nt, Artificial Sequence
  Synthetic
uuugaugagucagaggcgg

SEQ ID NO: 11580 - RNA, 20 nt, Artificial Sequence
  Synthetic
uuuugaugagucagaggcgg

SEQ ID NO: 11581 - RNA, 21 nt, Artificial Sequence
  Synthetic
auuuugaugagucagaggcgg

SEQ ID NO: 11582 - RNA, 22 nt, Artificial Sequence
  Synthetic
gauuuugaugagucagaggcgg

SEQ ID NO: 11583 - RNA, 23 nt, Artificial Sequence
  Synthetic
ggauuuugaugagucagaggcgg

SEQ ID NO: 11584 - RNA, 24 nt, Artificial Sequence
  Synthetic
cggauuuugaugagucagaggcgg

SEQ ID NO: 11585 - RNA, 18 nt, Artificial Sequence
  Synthetic
acgaggaggaggaggcgg

SEQ ID NO: 11586 - RNA, 19 nt, Artificial Sequence
  Synthetic
gacgaggaggaggaggcgg

SEQ ID NO: 11587 - RNA, 20 nt, Artificial Sequence
  Synthetic
agacgaggaggaggaggcgg

SEQ ID NO: 11588 - RNA, 21 nt, Artificial Sequence
  Synthetic
cagacgaggaggaggaggcgg

SEQ ID NO: 11589 - RNA, 22 nt, Artificial Sequence
  Synthetic
gcagacgaggaggaggaggcgg

SEQ ID NO: 11590 - RNA, 23 nt, Artificial Sequence
  Synthetic
ugcagacgaggaggaggaggcgg

SEQ ID NO: 11591 - RNA, 24 nt, Artificial Sequence
  Synthetic
augcagacgaggaggaggaggcgg

SEQ ID NO: 11592 - RNA, 18 nt, Artificial Sequence
  Synthetic
ccgcggcggcggcggcgg

SEQ ID NO: 11593 - RNA, 19 nt, Artificial Sequence
  Synthetic
uccgcggcggcggcggcgg

SEQ ID NO: 11594 - RNA, 20 nt, Artificial Sequence
  Synthetic
guccgcggcggcggcggcgg

SEQ ID NO: 11595 - RNA, 21 nt, Artificial Sequence
  Synthetic
gguccgcggcggcggcggcgg

SEQ ID NO: 11596 - RNA, 22 nt, Artificial Sequence
  Synthetic
agguccgcggcggcggcggcgg

SEQ ID NO: 11597 - RNA, 23 nt, Artificial Sequence
  Synthetic
cagguccgcggcggcggcggcgg

SEQ ID NO: 11598 - RNA, 24 nt, Artificial Sequence
  Synthetic
gcagguccgcggcggcggcggcgg

SEQ ID NO: 11599 - RNA, 18 nt, Artificial Sequence
  Synthetic
aggccuccagggcggcgg

SEQ ID NO: 11600 - RNA, 19 nt, Artificial Sequence
  Synthetic
uaggccuccagggcggcgg

SEQ ID NO: 11601 - RNA, 20 nt, Artificial Sequence
  Synthetic
guaggccuccagggcggcgg

SEQ ID NO: 11602 - RNA, 21 nt, Artificial Sequence
  Synthetic
aguaggccuccagggcggcgg

SEQ ID NO: 11603 - RNA, 22 nt, Artificial Sequence
  Synthetic
caguaggccuccagggcggcgg

SEQ ID NO: 11604 - RNA, 23 nt, Artificial Sequence
  Synthetic
gcaguaggccuccagggcggcgg

SEQ ID NO: 11605 - RNA, 24 nt, Artificial Sequence
  Synthetic
cgcaguaggccuccagggcggcgg

SEQ ID NO: 11606 - RNA, 18 nt, Artificial Sequence
  Synthetic
gggcgcgucggcgugcgg

SEQ ID NO: 11607 - RNA, 19 nt, Artificial Sequence
  Synthetic
ggggcgcgucggcgugcgg

SEQ ID NO: 11608 - RNA, 20 nt, Artificial Sequence
  Synthetic
cggggcgcgucggcgugcgg

SEQ ID NO: 11609 - RNA, 21 nt, Artificial Sequence
  Synthetic
gcggggcgcgucggcgugcgg

SEQ ID NO: 11610 - RNA, 22 nt, Artificial Sequence
  Synthetic
ggcggggcgcgucggcgugcgg

SEQ ID NO: 11611 - RNA, 23 nt, Artificial Sequence
  Synthetic
aggcggggcgcgucggcgugcgg

SEQ ID NO: 11612 - RNA, 24 nt, Artificial Sequence
  Synthetic
caggcggggcgcgucggcgugcgg

SEQ ID NO: 11613 - RNA, 18 nt, Artificial Sequence
  Synthetic
ggcccugggcgggcucgg

SEQ ID NO: 11614 - RNA, 19 nt, Artificial Sequence
  Synthetic
cggcccugggcgggcucgg

SEQ ID NO: 11615 - RNA, 20 nt, Artificial Sequence
  Synthetic
ucggcccugggcgggcucgg

SEQ ID NO: 11616 - RNA, 21 nt, Artificial Sequence
  Synthetic
cucggcccugggcgggcucgg

SEQ ID NO: 11617 - RNA, 22 nt, Artificial Sequence
  Synthetic
gcucggcccugggcgggcucgg

SEQ ID NO: 11618 - RNA, 23 nt, Artificial Sequence
  Synthetic
ggcucggcccugggcgggcucgg

SEQ ID NO: 11619 - RNA, 24 nt, Artificial Sequence
  Synthetic
gggcucggcccugggcgggcucgg

SEQ ID NO: 11620 - RNA, 18 nt, Artificial Sequence
  Synthetic
ccgcggcggcggcgucgg

SEQ ID NO: 11621 - RNA, 19 nt, Artificial Sequence
  Synthetic
gccgcggcggcggcgucgg

SEQ ID NO: 11622 - RNA, 20 nt, Artificial Sequence
  Synthetic
ggccgcggcggcggcgucgg

SEQ ID NO: 11623 - RNA, 21 nt, Artificial Sequence
  Synthetic
cggccgcggcggcggcgucgg

SEQ ID NO: 11624 - RNA, 22 nt, Artificial Sequence
  Synthetic
gcggccgcggcggcggcgucgg

SEQ ID NO: 11625 - RNA, 23 nt, Artificial Sequence
  Synthetic
ggcggccgcggcggcggcgucgg

SEQ ID NO: 11626 - RNA, 24 nt, Artificial Sequence
  Synthetic
cggcggccgcggcggcggcgucgg

SEQ ID NO: 11627 - RNA, 18 nt, Artificial Sequence
  Synthetic
ugguggugguggugucgg

SEQ ID NO: 11628 - RNA, 19 nt, Artificial Sequence
  Synthetic
gugguggugguggugucgg

SEQ ID NO: 11629 - RNA, 20 nt, Artificial Sequence
  Synthetic
ggugguggugguggugucgg

SEQ ID NO: 11630 - RNA, 21 nt, Artificial Sequence
  Synthetic
uggugguggugguggugucgg

SEQ ID NO: 11631 - RNA, 22 nt, Artificial Sequence
  Synthetic
guggugguggugguggugucgg

SEQ ID NO: 11632 - RNA, 23 nt, Artificial Sequence
  Synthetic
gguggugguggugguggugucgg

SEQ ID NO: 11633 - RNA, 24 nt, Artificial Sequence
  Synthetic
ugguggugguggugguggugucgg

SEQ ID NO: 11634 - RNA, 18 nt, Artificial Sequence
  Synthetic
gcgggucgaacaugaggg

SEQ ID NO: 11635 - RNA, 19 nt, Artificial Sequence
  Synthetic
cgcgggucgaacaugaggg

SEQ ID NO: 11636 - RNA, 20 nt, Artificial Sequence
  Synthetic
gcgcgggucgaacaugaggg

SEQ ID NO: 11637 - RNA, 21 nt, Artificial Sequence
  Synthetic
cgcgcgggucgaacaugaggg

SEQ ID NO: 11638 - RNA, 22 nt, Artificial Sequence
  Synthetic
gcgcgcgggucgaacaugaggg

SEQ ID NO: 11639 - RNA, 23 nt, Artificial Sequence
  Synthetic
cgcgcgcgggucgaacaugaggg

SEQ ID NO: 11640 - RNA, 24 nt, Artificial Sequence
  Synthetic
gcgcgcgcgggucgaacaugaggg

SEQ ID NO: 11641 - RNA, 18 nt, Artificial Sequence
  Synthetic
gcggggguccgggccggg

SEQ ID NO: 11642 - RNA, 19 nt, Artificial Sequence
  Synthetic
cgcggggguccgggccggg

SEQ ID NO: 11643 - RNA, 20 nt, Artificial Sequence
  Synthetic
ccgcggggguccgggccggg

SEQ ID NO: 11644 - RNA, 21 nt, Artificial Sequence
  Synthetic
gccgcggggguccgggccggg

SEQ ID NO: 11645 - RNA, 22 nt, Artificial Sequence
  Synthetic
cgccgcggggguccgggccggg

SEQ ID NO: 11646 - RNA, 23 nt, Artificial Sequence
  Synthetic
ucgccgcggggguccgggccggg

SEQ ID NO: 11647 - RNA, 24 nt, Artificial Sequence
  Synthetic
gucgccgcggggguccgggccggg

SEQ ID NO: 11648 - RNA, 18 nt, Artificial Sequence
  Synthetic
ggcggcgcccuggccggg

SEQ ID NO: 11649 - RNA, 19 nt, Artificial Sequence
  Synthetic
cggcggcgcccuggccggg

SEQ ID NO: 11650 - RNA, 20 nt, Artificial Sequence
  Synthetic
ccggcggcgcccuggccggg

SEQ ID NO: 11651 - RNA, 21 nt, Artificial Sequence
  Synthetic
cccggcggcgcccuggccggg

SEQ ID NO: 11652 - RNA, 22 nt, Artificial Sequence
  Synthetic
gcccggcggcgcccuggccggg

SEQ ID NO: 11653 - RNA, 23 nt, Artificial Sequence
  Synthetic
cgcccggcggcgcccuggccggg

SEQ ID NO: 11654 - RNA, 24 nt, Artificial Sequence
  Synthetic
ccgcccggcggcgcccuggccggg

SEQ ID NO: 11655 - RNA, 18 nt, Artificial Sequence
  Synthetic
ucggcggaccacuccggg

SEQ ID NO: 11656 - RNA, 19 nt, Artificial Sequence
  Synthetic
cucggcggaccacuccggg

SEQ ID NO: 11657 - RNA, 20 nt, Artificial Sequence
  Synthetic
gcucggcggaccacuccggg

SEQ ID NO: 11658 - RNA, 21 nt, Artificial Sequence
  Synthetic
cgcucggcggaccacuccggg

SEQ ID NO: 11659 - RNA, 22 nt, Artificial Sequence
  Synthetic
gcgcucggcggaccacuccggg

SEQ ID NO: 11660 - RNA, 23 nt, Artificial Sequence
  Synthetic
cgcgcucggcggaccacuccggg

SEQ ID NO: 11661 - RNA, 24 nt, Artificial Sequence
  Synthetic
ccgcgcucggcggaccacuccggg

SEQ ID NO: 11662 - RNA, 18 nt, Artificial Sequence
  Synthetic
acgcgcacguccuccggg

SEQ ID NO: 11663 - RNA, 19 nt, Artificial Sequence
  Synthetic
cacgcgcacguccuccggg

SEQ ID NO: 11664 - RNA, 20 nt, Artificial Sequence
  Synthetic
ccacgcgcacguccuccggg

SEQ ID NO: 11665 - RNA, 21 nt, Artificial Sequence
  Synthetic
accacgcgcacguccuccggg

SEQ ID NO: 11666 - RNA, 22 nt, Artificial Sequence
  Synthetic
caccacgcgcacguccuccggg

SEQ ID NO: 11667 - RNA, 23 nt, Artificial Sequence
  Synthetic
ucaccacgcgcacguccuccggg

SEQ ID NO: 11668 - RNA, 24 nt, Artificial Sequence
  Synthetic
aucaccacgcgcacguccuccggg

SEQ ID NO: 11669 - RNA, 18 nt, Artificial Sequence
  Synthetic
ucgccgcggggguccggg

SEQ ID NO: 11670 - RNA, 19 nt, Artificial Sequence
  Synthetic
gucgccgcggggguccggg

SEQ ID NO: 11671 - RNA, 20 nt, Artificial Sequence
  Synthetic
ggucgccgcggggguccggg

SEQ ID NO: 11672 - RNA, 21 nt, Artificial Sequence
  Synthetic
cggucgccgcggggguccggg

SEQ ID NO: 11673 - RNA, 22 nt, Artificial Sequence
  Synthetic
gcggucgccgcggggguccggg

SEQ ID NO: 11674 - RNA, 23 nt, Artificial Sequence
  Synthetic
cgcggucgccgcggggguccggg

SEQ ID NO: 11675 - RNA, 24 nt, Artificial Sequence
  Synthetic
ccgcggucgccgcggggguccggg

SEQ ID NO: 11676 - RNA, 18 nt, Artificial Sequence
  Synthetic
cccgaggcgcgcagcggg

SEQ ID NO: 11677 - RNA, 19 nt, Artificial Sequence
  Synthetic
gcccgaggcgcgcagcggg

SEQ ID NO: 11678 - RNA, 20 nt, Artificial Sequence
  Synthetic
ggcccgaggcgcgcagcggg

SEQ ID NO: 11679 - RNA, 21 nt, Artificial Sequence
  Synthetic
gggcccgaggcgcgcagcggg

SEQ ID NO: 11680 - RNA, 22 nt, Artificial Sequence
  Synthetic
cgggcccgaggcgcgcagcggg

SEQ ID NO: 11681 - RNA, 23 nt, Artificial Sequence
  Synthetic
gcgggcccgaggcgcgcagcggg

SEQ ID NO: 11682 - RNA, 24 nt, Artificial Sequence
  Synthetic
agcgggcccgaggcgcgcagcggg

SEQ ID NO: 11683 - RNA, 18 nt, Artificial Sequence
  Synthetic
gggcgcggcccccgcggg

SEQ ID NO: 11684 - RNA, 19 nt, Artificial Sequence
  Synthetic
ggggcgcggcccccgcggg

SEQ ID NO: 11685 - RNA, 20 nt, Artificial Sequence
  Synthetic
gggggcgcggcccccgcggg

SEQ ID NO: 11686 - RNA, 21 nt, Artificial Sequence
  Synthetic
ggggggcgcggcccccgcggg

SEQ ID NO: 11687 - RNA, 22 nt, Artificial Sequence
  Synthetic
cggggggcgcggcccccgcggg

SEQ ID NO: 11688 - RNA, 23 nt, Artificial Sequence
  Synthetic
gcggggggcgcggcccccgcggg

SEQ ID NO: 11689 - RNA, 24 nt, Artificial Sequence
  Synthetic
ggcggggggcgcggcccccgcggg

SEQ ID NO: 11690 - RNA, 18 nt, Artificial Sequence
  Synthetic
gggaggggcggccgcggg

SEQ ID NO: 11691 - RNA, 19 nt, Artificial Sequence
  Synthetic
cgggaggggcggccgcggg

SEQ ID NO: 11692 - RNA, 20 nt, Artificial Sequence
  Synthetic
gcgggaggggcggccgcggg

SEQ ID NO: 11693 - RNA, 21 nt, Artificial Sequence
  Synthetic
cgcgggaggggcggccgcggg

SEQ ID NO: 11694 - RNA, 22 nt, Artificial Sequence
  Synthetic
ccgcgggaggggcggccgcggg

SEQ ID NO: 11695 - RNA, 23 nt, Artificial Sequence
  Synthetic
cccgcgggaggggcggccgcggg

SEQ ID NO: 11696 - RNA, 24 nt, Artificial Sequence
  Synthetic
ccccgcgggaggggcggccgcggg

SEQ ID NO: 11697 - RNA, 18 nt, Artificial Sequence
  Synthetic
gaggccagcgcgcgcggg

SEQ ID NO: 11698 - RNA, 19 nt, Artificial Sequence
  Synthetic
cgaggccagcgcgcgcggg

SEQ ID NO: 11699 - RNA, 20 nt, Artificial Sequence
  Synthetic
gcgaggccagcgcgcgcggg

SEQ ID NO: 11700 - RNA, 21 nt, Artificial Sequence
  Synthetic
agcgaggccagcgcgcgcggg

SEQ ID NO: 11701 - RNA, 22 nt, Artificial Sequence
  Synthetic
cagcgaggccagcgcgcgcggg

SEQ ID NO: 11702 - RNA, 23 nt, Artificial Sequence
  Synthetic
ccagcgaggccagcgcgcgcggg

SEQ ID NO: 11703 - RNA, 24 nt, Artificial Sequence
  Synthetic
gccagcgaggccagcgcgcgcggg

SEQ ID NO: 11704 - RNA, 18 nt, Artificial Sequence
  Synthetic
gcgcgggggcgcggcggg

SEQ ID NO: 11705 - RNA, 19 nt, Artificial Sequence
  Synthetic
ggcgcgggggcgcggcggg

SEQ ID NO: 11706 - RNA, 20 nt, Artificial Sequence
  Synthetic
gggcgcgggggcgcggcggg

SEQ ID NO: 11707 - RNA, 21 nt, Artificial Sequence
  Synthetic
cgggcgcgggggcgcggcggg

SEQ ID NO: 11708 - RNA, 22 nt, Artificial Sequence
  Synthetic
ccgggcgcgggggcgcggcggg

SEQ ID NO: 11709 - RNA, 23 nt, Artificial Sequence
  Synthetic
cccgggcgcgggggcgcggcggg

SEQ ID NO: 11710 - RNA, 24 nt, Artificial Sequence
  Synthetic
ccccgggcgcgggggcgcggcggg

SEQ ID NO: 11711 - RNA, 18 nt, Artificial Sequence
  Synthetic
ggcggcggcgucggcggg

SEQ ID NO: 11712 - RNA, 19 nt, Artificial Sequence
  Synthetic
cggcggcggcgucggcggg

SEQ ID NO: 11713 - RNA, 20 nt, Artificial Sequence
  Synthetic
gcggcggcggcgucggcggg

SEQ ID NO: 11714 - RNA, 21 nt, Artificial Sequence
  Synthetic
cgcggcggcggcgucggcggg

SEQ ID NO: 11715 - RNA, 22 nt, Artificial Sequence
  Synthetic
ccgcggcggcggcgucggcggg

SEQ ID NO: 11716 - RNA, 23 nt, Artificial Sequence
  Synthetic
gccgcggcggcggcgucggcggg

SEQ ID NO: 11717 - RNA, 24 nt, Artificial Sequence
  Synthetic
ggccgcggcggcggcgucggcggg

SEQ ID NO: 11718 - RNA, 18 nt, Artificial Sequence
  Synthetic
cgccagccgcccugcggg

SEQ ID NO: 11719 - RNA, 19 nt, Artificial Sequence
  Synthetic
gcgccagccgcccugcggg

SEQ ID NO: 11720 - RNA, 20 nt, Artificial Sequence
  Synthetic
ggcgccagccgcccugcggg

SEQ ID NO: 11721 - RNA, 21 nt, Artificial Sequence
  Synthetic
cggcgccagccgcccugcggg

SEQ ID NO: 11722 - RNA, 22 nt, Artificial Sequence
  Synthetic
gcggcgccagccgcccugcggg

SEQ ID NO: 11723 - RNA, 23 nt, Artificial Sequence
  Synthetic
ggcggcgccagccgcccugcggg

SEQ ID NO: 11724 - RNA, 24 nt, Artificial Sequence
  Synthetic
uggcggcgccagccgcccugcggg

SEQ ID NO: 11725 - RNA, 18 nt, Artificial Sequence
  Synthetic
acagcacgcgccccgggg

SEQ ID NO: 11726 - RNA, 19 nt, Artificial Sequence
  Synthetic
uacagcacgcgccccgggg

SEQ ID NO: 11727 - RNA, 20 nt, Artificial Sequence
  Synthetic
guacagcacgcgccccgggg

SEQ ID NO: 11728 - RNA, 21 nt, Artificial Sequence
  Synthetic
cguacagcacgcgccccgggg

SEQ ID NO: 11729 - RNA, 22 nt, Artificial Sequence
  Synthetic
ccguacagcacgcgccccgggg

SEQ ID NO: 11730 - RNA, 23 nt, Artificial Sequence
  Synthetic
gccguacagcacgcgccccgggg

SEQ ID NO: 11731 - RNA, 24 nt, Artificial Sequence
  Synthetic
cgccguacagcacgcgccccgggg

SEQ ID NO: 11732 - RNA, 18 nt, Artificial Sequence
  Synthetic
gcggcgcccuggccgggg

SEQ ID NO: 11733 - RNA, 19 nt, Artificial Sequence
  Synthetic
ggcggcgcccuggccgggg

SEQ ID NO: 11734 - RNA, 20 nt, Artificial Sequence
  Synthetic
cggcggcgcccuggccgggg

SEQ ID NO: 11735 - RNA, 21 nt, Artificial Sequence
  Synthetic
ccggcggcgcccuggccgggg

SEQ ID NO: 11736 - RNA, 22 nt, Artificial Sequence
  Synthetic
cccggcggcgcccuggccgggg

SEQ ID NO: 11737 - RNA, 23 nt, Artificial Sequence
  Synthetic
gcccggcggcgcccuggccgggg

SEQ ID NO: 11738 - RNA, 24 nt, Artificial Sequence
  Synthetic
cgcccggcggcgcccuggccgggg

SEQ ID NO: 11739 - RNA, 18 nt, Artificial Sequence
  Synthetic
ggaggggcggccgcgggg

SEQ ID NO: 11740 - RNA, 19 nt, Artificial Sequence
  Synthetic
gggaggggcggccgcgggg

SEQ ID NO: 11741 - RNA, 20 nt, Artificial Sequence
  Synthetic
cgggaggggcggccgcgggg

SEQ ID NO: 11742 - RNA, 21 nt, Artificial Sequence
  Synthetic
gcgggaggggcggccgcgggg

SEQ ID NO: 11743 - RNA, 22 nt, Artificial Sequence
  Synthetic
cgcgggaggggcggccgcgggg

SEQ ID NO: 11744 - RNA, 23 nt, Artificial Sequence
  Synthetic
ccgcgggaggggcggccgcgggg

SEQ ID NO: 11745 - RNA, 24 nt, Artificial Sequence
  Synthetic
cccgcgggaggggcggccgcgggg

SEQ ID NO: 11746 - RNA, 18 nt, Artificial Sequence
  Synthetic
gggcgccacggcgcgggg

SEQ ID NO: 11747 - RNA, 19 nt, Artificial Sequence
  Synthetic
cgggcgccacggcgcgggg

SEQ ID NO: 11748 - RNA, 20 nt, Artificial Sequence
  Synthetic
ccgggcgccacggcgcgggg

SEQ ID NO: 11749 - RNA, 21 nt, Artificial Sequence
  Synthetic
gccgggcgccacggcgcgggg

SEQ ID NO: 11750 - RNA, 22 nt, Artificial Sequence
  Synthetic
ggccgggcgccacggcgcgggg

SEQ ID NO: 11751 - RNA, 23 nt, Artificial Sequence
  Synthetic
gggccgggcgccacggcgcgggg

SEQ ID NO: 11752 - RNA, 24 nt, Artificial Sequence
  Synthetic
agggccgggcgccacggcgcgggg

SEQ ID NO: 11753 - RNA, 18 nt, Artificial Sequence
  Synthetic
gcggcggcgucggcgggg

SEQ ID NO: 11754 - RNA, 19 nt, Artificial Sequence
  Synthetic
ggcggcggcgucggcgggg

SEQ ID NO: 11755 - RNA, 20 nt, Artificial Sequence
  Synthetic
cggcggcggcgucggcgggg

SEQ ID NO: 11756 - RNA, 21 nt, Artificial Sequence
  Synthetic
gcggcggcggcgucggcgggg

SEQ ID NO: 11757 - RNA, 22 nt, Artificial Sequence
  Synthetic
cgcggcggcggcgucggcgggg

SEQ ID NO: 11758 - RNA, 23 nt, Artificial Sequence
  Synthetic
ccgcggcggcggcgucggcgggg

SEQ ID NO: 11759 - RNA, 24 nt, Artificial Sequence
  Synthetic
gccgcggcggcggcgucggcgggg

SEQ ID NO: 11760 - RNA, 18 nt, Artificial Sequence
  Synthetic
cccagcguaucugcgggg

SEQ ID NO: 11761 - RNA, 19 nt, Artificial Sequence
  Synthetic
gcccagcguaucugcgggg

SEQ ID NO: 11762 - RNA, 20 nt, Artificial Sequence
  Synthetic
cgcccagcguaucugcgggg

SEQ ID NO: 11763 - RNA, 21 nt, Artificial Sequence
  Synthetic
acgcccagcguaucugcgggg

SEQ ID NO: 11764 - RNA, 22 nt, Artificial Sequence
  Synthetic
gacgcccagcguaucugcgggg

SEQ ID NO: 11765 - RNA, 23 nt, Artificial Sequence
  Synthetic
cgacgcccagcguaucugcgggg

SEQ ID NO: 11766 - RNA, 24 nt, Artificial Sequence
  Synthetic
ccgacgcccagcguaucugcgggg

SEQ ID NO: 11767 - RNA, 18 nt, Artificial Sequence
  Synthetic
ggcaccagcgugucgggg

SEQ ID NO: 11768 - RNA, 19 nt, Artificial Sequence
  Synthetic
gggcaccagcgugucgggg

SEQ ID NO: 11769 - RNA, 20 nt, Artificial Sequence
  Synthetic
ugggcaccagcgugucgggg

SEQ ID NO: 11770 - RNA, 21 nt, Artificial Sequence
  Synthetic
augggcaccagcgugucgggg

SEQ ID NO: 11771 - RNA, 22 nt, Artificial Sequence
  Synthetic
caugggcaccagcgugucgggg

SEQ ID NO: 11772 - RNA, 23 nt, Artificial Sequence
  Synthetic
acaugggcaccagcgugucgggg

SEQ ID NO: 11773 - RNA, 24 nt, Artificial Sequence
  Synthetic
gacaugggcaccagcgugucgggg

SEQ ID NO: 11774 - RNA, 18 nt, Artificial Sequence
  Synthetic
cagcacgcgccccggggg

SEQ ID NO: 11775 - RNA, 19 nt, Artificial Sequence
  Synthetic
acagcacgcgccccggggg

SEQ ID NO: 11776 - RNA, 20 nt, Artificial Sequence
  Synthetic
uacagcacgcgccccggggg

SEQ ID NO: 11777 - RNA, 21 nt, Artificial Sequence
  Synthetic
guacagcacgcgccccggggg

SEQ ID NO: 11778 - RNA, 22 nt, Artificial Sequence
  Synthetic
cguacagcacgcgccccggggg

SEQ ID NO: 11779 - RNA, 23 nt, Artificial Sequence
  Synthetic
ccguacagcacgcgccccggggg

SEQ ID NO: 11780 - RNA, 24 nt, Artificial Sequence
  Synthetic
gccguacagcacgcgccccggggg

SEQ ID NO: 11781 - RNA, 18 nt, Artificial Sequence
  Synthetic
cgggcgcgccgccggggg

SEQ ID NO: 11782 - RNA, 19 nt, Artificial Sequence
  Synthetic
gcgggcgcgccgccggggg

SEQ ID NO: 11783 - RNA, 20 nt, Artificial Sequence
  Synthetic
ggcgggcgcgccgccggggg

SEQ ID NO: 11784 - RNA, 21 nt, Artificial Sequence
  Synthetic
cggcgggcgcgccgccggggg

SEQ ID NO: 11785 - RNA, 22 nt, Artificial Sequence
  Synthetic
gcggcgggcgcgccgccggggg

SEQ ID NO: 11786 - RNA, 23 nt, Artificial Sequence
  Synthetic
ggcggcgggcgcgccgccggggg

SEQ ID NO: 11787 - RNA, 24 nt, Artificial Sequence
  Synthetic
aggcggcgggcgcgccgccggggg

SEQ ID NO: 11788 - RNA, 18 nt, Artificial Sequence
  Synthetic
gggcgcgccgccgggggg

SEQ ID NO: 11789 - RNA, 19 nt, Artificial Sequence
  Synthetic
cgggcgcgccgccgggggg

SEQ ID NO: 11790 - RNA, 20 nt, Artificial Sequence
  Synthetic
gcgggcgcgccgccgggggg

SEQ ID NO: 11791 - RNA, 21 nt, Artificial Sequence
  Synthetic
ggcgggcgcgccgccgggggg

SEQ ID NO: 11792 - RNA, 22 nt, Artificial Sequence
  Synthetic
cggcgggcgcgccgccgggggg

SEQ ID NO: 11793 - RNA, 23 nt, Artificial Sequence
  Synthetic
gcggcgggcgcgccgccgggggg

SEQ ID NO: 11794 - RNA, 24 nt, Artificial Sequence
  Synthetic
ggcggcgggcgcgccgccgggggg

SEQ ID NO: 11795 - RNA, 18 nt, Artificial Sequence
  Synthetic
cgcccggcggcgcccugg

SEQ ID NO: 11796 - RNA, 19 nt, Artificial Sequence
  Synthetic
ccgcccggcggcgcccugg

SEQ ID NO: 11797 - RNA, 20 nt, Artificial Sequence
  Synthetic
gccgcccggcggcgcccugg

SEQ ID NO: 11798 - RNA, 21 nt, Artificial Sequence
  Synthetic
cgccgcccggcggcgcccugg

SEQ ID NO: 11799 - RNA, 22 nt, Artificial Sequence
  Synthetic
gcgccgcccggcggcgcccugg

SEQ ID NO: 11800 - RNA, 23 nt, Artificial Sequence
  Synthetic
ggcgccgcccggcggcgcccugg

SEQ ID NO: 11801 - RNA, 24 nt, Artificial Sequence
  Synthetic
gggcgccgcccggcggcgcccugg

SEQ ID NO: 11802 - RNA, 18 nt, Artificial Sequence
  Synthetic
gggcgggcucggcccugg

SEQ ID NO: 11803 - RNA, 19 nt, Artificial Sequence
  Synthetic
ggggcgggcucggcccugg

SEQ ID NO: 11804 - RNA, 20 nt, Artificial Sequence
  Synthetic
cggggcgggcucggcccugg

SEQ ID NO: 11805 - RNA, 21 nt, Artificial Sequence
  Synthetic
ccggggcgggcucggcccugg

SEQ ID NO: 11806 - RNA, 22 nt, Artificial Sequence
  Synthetic
gccggggcgggcucggcccugg

SEQ ID NO: 11807 - RNA, 23 nt, Artificial Sequence
  Synthetic
ggccggggcgggcucggcccugg

SEQ ID NO: 11808 - RNA, 24 nt, Artificial Sequence
  Synthetic
gggccggggcgggcucggcccugg

SEQ ID NO: 11809 - RNA, 18 nt, Artificial Sequence
  Synthetic
cguggucugcggcgcugg

SEQ ID NO: 11810 - RNA, 19 nt, Artificial Sequence
  Synthetic
gcguggucugcggcgcugg

SEQ ID NO: 11811 - RNA, 20 nt, Artificial Sequence
  Synthetic
ggcguggucugcggcgcugg

SEQ ID NO: 11812 - RNA, 21 nt, Artificial Sequence
  Synthetic
cggcguggucugcggcgcugg

SEQ ID NO: 11813 - RNA, 22 nt, Artificial Sequence
  Synthetic
gcggcguggucugcggcgcugg

SEQ ID NO: 11814 - RNA, 23 nt, Artificial Sequence
  Synthetic
cgcggcguggucugcggcgcugg

SEQ ID NO: 11815 - RNA, 24 nt, Artificial Sequence
  Synthetic
ccgcggcguggucugcggcgcugg

SEQ ID NO: 11816 - RNA, 18 nt, Artificial Sequence
  Synthetic
cgcaggcucugguucugg

SEQ ID NO: 11817 - RNA, 19 nt, Artificial Sequence
  Synthetic
gcgcaggcucugguucugg

SEQ ID NO: 11818 - RNA, 20 nt, Artificial Sequence
  Synthetic
ggcgcaggcucugguucugg

SEQ ID NO: 11819 - RNA, 21 nt, Artificial Sequence
  Synthetic
gggcgcaggcucugguucugg

SEQ ID NO: 11820 - RNA, 22 nt, Artificial Sequence
  Synthetic
ggggcgcaggcucugguucugg

SEQ ID NO: 11821 - RNA, 23 nt, Artificial Sequence
  Synthetic
gggggcgcaggcucugguucugg

SEQ ID NO: 11822 - RNA, 24 nt, Artificial Sequence
  Synthetic
agggggcgcaggcucugguucugg

SEQ ID NO: 11823 - RNA, 18 nt, Artificial Sequence
  Synthetic
gagggcgccggcgugugg

SEQ ID NO: 11824 - RNA, 19 nt, Artificial Sequence
  Synthetic
cgagggcgccggcgugugg

SEQ ID NO: 11825 - RNA, 20 nt, Artificial Sequence
  Synthetic
ccgagggcgccggcgugugg

SEQ ID NO: 11826 - RNA, 21 nt, Artificial Sequence
  Synthetic
gccgagggcgccggcgugugg

SEQ ID NO: 11827 - RNA, 22 nt, Artificial Sequence
  Synthetic
ggccgagggcgccggcgugugg

SEQ ID NO: 11828 - RNA, 23 nt, Artificial Sequence
  Synthetic
cggccgagggcgccggcgugugg

SEQ ID NO: 11829 - RNA, 24 nt, Artificial Sequence
  Synthetic
gcggccgagggcgccggcgugugg

SEQ ID NO: 11830 - RNA, 18 nt, Artificial Sequence
  Synthetic
gccacgcugccggagaug

SEQ ID NO: 11831 - RNA, 19 nt, Artificial Sequence
  Synthetic
cgccacgcugccggagaug

SEQ ID NO: 11832 - RNA, 20 nt, Artificial Sequence
  Synthetic
gcgccacgcugccggagaug

SEQ ID NO: 11833 - RNA, 21 nt, Artificial Sequence
  Synthetic
cgcgccacgcugccggagaug

SEQ ID NO: 11834 - RNA, 22 nt, Artificial Sequence
  Synthetic
ccgcgccacgcugccggagaug

SEQ ID NO: 11835 - RNA, 23 nt, Artificial Sequence
  Synthetic
cccgcgccacgcugccggagaug

SEQ ID NO: 11836 - RNA, 24 nt, Artificial Sequence
  Synthetic
gcccgcgccacgcugccggagaug

SEQ ID NO: 11837 - RNA, 18 nt, Artificial Sequence
  Synthetic
acggcccgcgccacgcug

SEQ ID NO: 11838 - RNA, 19 nt, Artificial Sequence
  Synthetic
cacggcccgcgccacgcug

SEQ ID NO: 11839 - RNA, 20 nt, Artificial Sequence
  Synthetic
gcacggcccgcgccacgcug

SEQ ID NO: 11840 - RNA, 21 nt, Artificial Sequence
  Synthetic
ggcacggcccgcgccacgcug

SEQ ID NO: 11841 - RNA, 22 nt, Artificial Sequence
  Synthetic
gggcacggcccgcgccacgcug

SEQ ID NO: 11842 - RNA, 23 nt, Artificial Sequence
  Synthetic
ggggcacggcccgcgccacgcug

SEQ ID NO: 11843 - RNA, 24 nt, Artificial Sequence
  Synthetic
uggggcacggcccgcgccacgcug

SEQ ID NO: 11844 - RNA, 18 nt, Artificial Sequence
  Synthetic
gcguggucugcggcgcug

SEQ ID NO: 11845 - RNA, 19 nt, Artificial Sequence
  Synthetic
ggcguggucugcggcgcug

SEQ ID NO: 11846 - RNA, 20 nt, Artificial Sequence
  Synthetic
cggcguggucugcggcgcug

SEQ ID NO: 11847 - RNA, 21 nt, Artificial Sequence
  Synthetic
gcggcguggucugcggcgcug

SEQ ID NO: 11848 - RNA, 22 nt, Artificial Sequence
  Synthetic
cgcggcguggucugcggcgcug

SEQ ID NO: 11849 - RNA, 23 nt, Artificial Sequence
  Synthetic
ccgcggcguggucugcggcgcug

SEQ ID NO: 11850 - RNA, 24 nt, Artificial Sequence
  Synthetic
cccgcggcguggucugcggcgcug

SEQ ID NO: 11851 - RNA, 18 nt, Artificial Sequence
  Synthetic
cgacgcccagcguaucug

SEQ ID NO: 11852 - RNA, 19 nt, Artificial Sequence
  Synthetic
ccgacgcccagcguaucug

SEQ ID NO: 11853 - RNA, 20 nt, Artificial Sequence
  Synthetic
gccgacgcccagcguaucug

SEQ ID NO: 11854 - RNA, 21 nt, Artificial Sequence
  Synthetic
ggccgacgcccagcguaucug

SEQ ID NO: 11855 - RNA, 22 nt, Artificial Sequence
  Synthetic
cggccgacgcccagcguaucug

SEQ ID NO: 11856 - RNA, 23 nt, Artificial Sequence
  Synthetic
gcggccgacgcccagcguaucug

SEQ ID NO: 11857 - RNA, 24 nt, Artificial Sequence
  Synthetic
cgcggccgacgcccagcguaucug

SEQ ID NO: 11858 - RNA, 18 nt, Artificial Sequence
  Synthetic
cccgcccaggcggccgug

SEQ ID NO: 11859 - RNA, 19 nt, Artificial Sequence
  Synthetic
gcccgcccaggcggccgug

SEQ ID NO: 11860 - RNA, 20 nt, Artificial Sequence
  Synthetic
ugcccgcccaggcggccgug

SEQ ID NO: 11861 - RNA, 21 nt, Artificial Sequence
  Synthetic
uugcccgcccaggcggccgug

SEQ ID NO: 11862 - RNA, 22 nt, Artificial Sequence
  Synthetic
guugcccgcccaggcggccgug

SEQ ID NO: 11863 - RNA, 23 nt, Artificial Sequence
  Synthetic
aguugcccgcccaggcggccgug

SEQ ID NO: 11864 - RNA, 24 nt, Artificial Sequence
  Synthetic
caguugcccgcccaggcggccgug

SEQ ID NO: 11865 - RNA, 18 nt, Artificial Sequence
  Synthetic
gacaugggcaccagcgug

SEQ ID NO: 11866 - RNA, 19 nt, Artificial Sequence
  Synthetic
ggacaugggcaccagcgug

SEQ ID NO: 11867 - RNA, 20 nt, Artificial Sequence
  Synthetic
gggacaugggcaccagcgug

SEQ ID NO: 11868 - RNA, 21 nt, Artificial Sequence
  Synthetic
ggggacaugggcaccagcgug

SEQ ID NO: 11869 - RNA, 22 nt, Artificial Sequence
  Synthetic
cggggacaugggcaccagcgug

SEQ ID NO: 11870 - RNA, 23 nt, Artificial Sequence
  Synthetic
gcggggacaugggcaccagcgug

SEQ ID NO: 11871 - RNA, 24 nt, Artificial Sequence
  Synthetic
cgcggggacaugggcaccagcgug

SEQ ID NO: 11872 - RNA, 18 nt, Artificial Sequence
  Synthetic
cgcgcgcgggucgaacau

SEQ ID NO: 11873 - RNA, 19 nt, Artificial Sequence
  Synthetic
gcgcgcgcgggucgaacau

SEQ ID NO: 11874 - RNA, 20 nt, Artificial Sequence
  Synthetic
agcgcgcgcgggucgaacau

SEQ ID NO: 11875 - RNA, 21 nt, Artificial Sequence
  Synthetic
cagcgcgcgcgggucgaacau

SEQ ID NO: 11876 - RNA, 22 nt, Artificial Sequence
  Synthetic
ccagcgcgcgcgggucgaacau

SEQ ID NO: 11877 - RNA, 23 nt, Artificial Sequence
  Synthetic
gccagcgcgcgcgggucgaacau

SEQ ID NO: 11878 - RNA, 24 nt, Artificial Sequence
  Synthetic
ggccagcgcgcgcgggucgaacau

SEQ ID NO: 11879 - RNA, 18 nt, Artificial Sequence
  Synthetic
gcgcgccgcgcccgagau

SEQ ID NO: 11880 - RNA, 19 nt, Artificial Sequence
  Synthetic
ugcgcgccgcgcccgagau

SEQ ID NO: 11881 - RNA, 20 nt, Artificial Sequence
  Synthetic
uugcgcgccgcgcccgagau

SEQ ID NO: 11882 - RNA, 21 nt, Artificial Sequence
  Synthetic
guugcgcgccgcgcccgagau

SEQ ID NO: 11883 - RNA, 22 nt, Artificial Sequence
  Synthetic
uguugcgcgccgcgcccgagau

SEQ ID NO: 11884 - RNA, 23 nt, Artificial Sequence
  Synthetic
cuguugcgcgccgcgcccgagau

SEQ ID NO: 11885 - RNA, 24 nt, Artificial Sequence
  Synthetic
gcuguugcgcgccgcgcccgagau

SEQ ID NO: 11886 - RNA, 18 nt, Artificial Sequence
  Synthetic
guacagcagccgcgugau

SEQ ID NO: 11887 - RNA, 19 nt, Artificial Sequence
  Synthetic
uguacagcagccgcgugau

SEQ ID NO: 11888 - RNA, 20 nt, Artificial Sequence
  Synthetic
guguacagcagccgcgugau

SEQ ID NO: 11889 - RNA, 21 nt, Artificial Sequence
  Synthetic
cguguacagcagccgcgugau

SEQ ID NO: 11890 - RNA, 22 nt, Artificial Sequence
  Synthetic
gcguguacagcagccgcgugau

SEQ ID NO: 11891 - RNA, 23 nt, Artificial Sequence
  Synthetic
ggcguguacagcagccgcgugau

SEQ ID NO: 11892 - RNA, 24 nt, Artificial Sequence
  Synthetic
cggcguguacagcagccgcgugau

SEQ ID NO: 11893 - RNA, 18 nt, Artificial Sequence
  Synthetic
cgcgcucggcggaccacu

SEQ ID NO: 11894 - RNA, 19 nt, Artificial Sequence
  Synthetic
ccgcgcucggcggaccacu

SEQ ID NO: 11895 - RNA, 20 nt, Artificial Sequence
  Synthetic
gccgcgcucggcggaccacu

SEQ ID NO: 11896 - RNA, 21 nt, Artificial Sequence
  Synthetic
cgccgcgcucggcggaccacu

SEQ ID NO: 11897 - RNA, 22 nt, Artificial Sequence
  Synthetic
ccgccgcgcucggcggaccacu

SEQ ID NO: 11898 - RNA, 23 nt, Artificial Sequence
  Synthetic
cccgccgcgcucggcggaccacu

SEQ ID NO: 11899 - RNA, 24 nt, Artificial Sequence
  Synthetic
gcccgccgcgcucggcggaccacu

SEQ ID NO: 11900 - RNA, 18 nt, Artificial Sequence
  Synthetic
ccgacgcccagcguaucu

SEQ ID NO: 11901 - RNA, 19 nt, Artificial Sequence
  Synthetic
gccgacgcccagcguaucu

SEQ ID NO: 11902 - RNA, 20 nt, Artificial Sequence
  Synthetic
ggccgacgcccagcguaucu

SEQ ID NO: 11903 - RNA, 21 nt, Artificial Sequence
  Synthetic
cggccgacgcccagcguaucu

SEQ ID NO: 11904 - RNA, 22 nt, Artificial Sequence
  Synthetic
gcggccgacgcccagcguaucu

SEQ ID NO: 11905 - RNA, 23 nt, Artificial Sequence
  Synthetic
cgcggccgacgcccagcguaucu

SEQ ID NO: 11906 - RNA, 24 nt, Artificial Sequence
  Synthetic
ccgcggccgacgcccagcguaucu

SEQ ID NO: 11907 - RNA, 18 nt, Artificial Sequence
  Synthetic
cguccgcgcggcucuucu

SEQ ID NO: 11908 - RNA, 19 nt, Artificial Sequence
  Synthetic
gcguccgcgcggcucuucu

SEQ ID NO: 11909 - RNA, 20 nt, Artificial Sequence
  Synthetic
ggcguccgcgcggcucuucu

SEQ ID NO: 11910 - RNA, 21 nt, Artificial Sequence
  Synthetic
gggcguccgcgcggcucuucu

SEQ ID NO: 11911 - RNA, 22 nt, Artificial Sequence
  Synthetic
ggggcguccgcgcggcucuucu

SEQ ID NO: 11912 - RNA, 23 nt, Artificial Sequence
  Synthetic
gggggcguccgcgcggcucuucu

SEQ ID NO: 11913 - RNA, 24 nt, Artificial Sequence
  Synthetic
ggggggcguccgcgcggcucuucu

SEQ ID NO: 11914 - RNA, 18 nt, Artificial Sequence
  Synthetic
auccggauuuugaugagu

SEQ ID NO: 11915 - RNA, 19 nt, Artificial Sequence
  Synthetic
gauccggauuuugaugagu

SEQ ID NO: 11916 - RNA, 20 nt, Artificial Sequence
  Synthetic
ggauccggauuuugaugagu

SEQ ID NO: 11917 - RNA, 21 nt, Artificial Sequence
  Synthetic
aggauccggauuuugaugagu

SEQ ID NO: 11918 - RNA, 22 nt, Artificial Sequence
  Synthetic
gaggauccggauuuugaugagu

SEQ ID NO: 11919 - RNA, 23 nt, Artificial Sequence
  Synthetic
cgaggauccggauuuugaugagu

SEQ ID NO: 11920 - RNA, 24 nt, Artificial Sequence
  Synthetic
acgaggauccggauuuugaugagu

SEQ ID NO: 11921 - RNA, 18 nt, Artificial Sequence
  Synthetic
cgcccagcgccgagacgu

SEQ ID NO: 11922 - RNA, 19 nt, Artificial Sequence
  Synthetic
gcgcccagcgccgagacgu

SEQ ID NO: 11923 - RNA, 20 nt, Artificial Sequence
  Synthetic
cgcgcccagcgccgagacgu

SEQ ID NO: 11924 - RNA, 21 nt, Artificial Sequence
  Synthetic
gcgcgcccagcgccgagacgu

SEQ ID NO: 11925 - RNA, 22 nt, Artificial Sequence
  Synthetic
ugcgcgcccagcgccgagacgu

SEQ ID NO: 11926 - RNA, 23 nt, Artificial Sequence
  Synthetic
cugcgcgcccagcgccgagacgu

SEQ ID NO: 11927 - RNA, 24 nt, Artificial Sequence
  Synthetic
ccugcgcgcccagcgccgagacgu

SEQ ID NO: 11928 - RNA, 18 nt, Artificial Sequence
  Synthetic
uggcgucgccgccgucgu

SEQ ID NO: 11929 - RNA, 19 nt, Artificial Sequence
  Synthetic
uuggcgucgccgccgucgu

SEQ ID NO: 11930 - RNA, 20 nt, Artificial Sequence
  Synthetic
guuggcgucgccgccgucgu

SEQ ID NO: 11931 - RNA, 21 nt, Artificial Sequence
  Synthetic
gguuggcgucgccgccgucgu

SEQ ID NO: 11932 - RNA, 22 nt, Artificial Sequence
  Synthetic
cgguuggcgucgccgccgucgu

SEQ ID NO: 11933 - RNA, 23 nt, Artificial Sequence
  Synthetic
gcgguuggcgucgccgccgucgu

SEQ ID NO: 11934 - RNA, 24 nt, Artificial Sequence
  Synthetic
ggcgguuggcgucgccgccgucgu

SEQ ID NO: 11935 - RNA, 18 nt, Artificial Sequence
  Synthetic
gccagccgcccugcgggu

SEQ ID NO: 11936 - RNA, 19 nt, Artificial Sequence
  Synthetic
cgccagccgcccugcgggu

SEQ ID NO: 11937 - RNA, 20 nt, Artificial Sequence
  Synthetic
gcgccagccgcccugcgggu

SEQ ID NO: 11938 - RNA, 21 nt, Artificial Sequence
  Synthetic
ggcgccagccgcccugcgggu

SEQ ID NO: 11939 - RNA, 22 nt, Artificial Sequence
  Synthetic
cggcgccagccgcccugcgggu

SEQ ID NO: 11940 - RNA, 23 nt, Artificial Sequence
  Synthetic
gcggcgccagccgcccugcgggu

SEQ ID NO: 11941 - RNA, 24 nt, Artificial Sequence
  Synthetic
ggcggcgccagccgcccugcgggu

SEQ ID NO: 11942 - RNA, 18 nt, Artificial Sequence
  Synthetic
cgcggucgccgcgggggu

SEQ ID NO: 11943 - RNA, 19 nt, Artificial Sequence
  Synthetic
ccgcggucgccgcgggggu

SEQ ID NO: 11944 - RNA, 20 nt, Artificial Sequence
  Synthetic
cccgcggucgccgcgggggu

SEQ ID NO: 11945 - RNA, 21 nt, Artificial Sequence
  Synthetic
gcccgcggucgccgcgggggu

SEQ ID NO: 11946 - RNA, 22 nt, Artificial Sequence
  Synthetic
ggcccgcggucgccgcgggggu

SEQ ID NO: 11947 - RNA, 23 nt, Artificial Sequence
  Synthetic
cggcccgcggucgccgcgggggu

SEQ ID NO: 11948 - RNA, 24 nt, Artificial Sequence
  Synthetic
gcggcccgcggucgccgcgggggu

SEQ ID NO: 11949 - RNA, 18 nt, Artificial Sequence
  Synthetic
acaugggcaccagcgugu

SEQ ID NO: 11950 - RNA, 19 nt, Artificial Sequence
  Synthetic
gacaugggcaccagcgugu

SEQ ID NO: 11951 - RNA, 20 nt, Artificial Sequence
  Synthetic
ggacaugggcaccagcgugu

SEQ ID NO: 11952 - RNA, 21 nt, Artificial Sequence
  Synthetic
gggacaugggcaccagcgugu

SEQ ID NO: 11953 - RNA, 22 nt, Artificial Sequence
  Synthetic
ggggacaugggcaccagcgugu

SEQ ID NO: 11954 - RNA, 23 nt, Artificial Sequence
  Synthetic
cggggacaugggcaccagcgugu

SEQ ID NO: 11955 - RNA, 24 nt, Artificial Sequence
  Synthetic
gcggggacaugggcaccagcgugu

SEQ ID NO: 11956 - RNA, 18 nt, Artificial Sequence
  Synthetic
guccgcgcggcucuucuu

SEQ ID NO: 11957 - RNA, 19 nt, Artificial Sequence
  Synthetic
cguccgcgcggcucuucuu

SEQ ID NO: 11958 - RNA, 20 nt, Artificial Sequence
  Synthetic
gcguccgcgcggcucuucuu

SEQ ID NO: 11959 - RNA, 21 nt, Artificial Sequence
  Synthetic
ggcguccgcgcggcucuucuu

SEQ ID NO: 11960 - RNA, 22 nt, Artificial Sequence
  Synthetic
gggcguccgcgcggcucuucuu

SEQ ID NO: 11961 - RNA, 23 nt, Artificial Sequence
  Synthetic
ggggcguccgcgcggcucuucuu

SEQ ID NO: 11962 - RNA, 24 nt, Artificial Sequence
  Synthetic
gggggcguccgcgcggcucuucuu

SEQ ID NO: 11963 - RNA, 18 nt, Artificial Sequence
  Synthetic
gggcgccacgcgcggguu

SEQ ID NO: 11964 - RNA, 19 nt, Artificial Sequence
  Synthetic
cgggcgccacgcgcggguu

SEQ ID NO: 11965 - RNA, 20 nt, Artificial Sequence
  Synthetic
ccgggcgccacgcgcggguu

SEQ ID NO: 11966 - RNA, 21 nt, Artificial Sequence
  Synthetic
cccgggcgccacgcgcggguu

SEQ ID NO: 11967 - RNA, 22 nt, Artificial Sequence
  Synthetic
ccccgggcgccacgcgcggguu

SEQ ID NO: 11968 - RNA, 23 nt, Artificial Sequence
  Synthetic
uccccgggcgccacgcgcggguu

SEQ ID NO: 11969 - RNA, 24 nt, Artificial Sequence
  Synthetic
guccccgggcgccacgcgcggguu

SEQ ID NO: 11970 - RNA, 18 nt, Artificial Sequence
  Synthetic
ggggcgcaggcucugguu

SEQ ID NO: 11971 - RNA, 19 nt, Artificial Sequence
  Synthetic
gggggcgcaggcucugguu

SEQ ID NO: 11972 - RNA, 20 nt, Artificial Sequence
  Synthetic
agggggcgcaggcucugguu

SEQ ID NO: 11973 - RNA, 21 nt, Artificial Sequence
  Synthetic
cagggggcgcaggcucugguu

SEQ ID NO: 11974 - RNA, 22 nt, Artificial Sequence
  Synthetic
gcagggggcgcaggcucugguu

SEQ ID NO: 11975 - RNA, 23 nt, Artificial Sequence
  Synthetic
agcagggggcgcaggcucugguu

SEQ ID NO: 11976 - RNA, 24 nt, Artificial Sequence
  Synthetic
cagcagggggcgcaggcucugguu

SEQ ID NO: 11977 - RNA, 18 nt, Artificial Sequence
  Synthetic
ggccgccugggcgggcaa

SEQ ID NO: 11978 - RNA, 19 nt, Artificial Sequence
  Synthetic
cggccgccugggcgggcaa

SEQ ID NO: 11979 - RNA, 20 nt, Artificial Sequence
  Synthetic
acggccgccugggcgggcaa

SEQ ID NO: 11980 - RNA, 21 nt, Artificial Sequence
  Synthetic
cacggccgccugggcgggcaa

SEQ ID NO: 11981 - RNA, 22 nt, Artificial Sequence
  Synthetic
ccacggccgccugggcgggcaa

SEQ ID NO: 11982 - RNA, 23 nt, Artificial Sequence
  Synthetic
gccacggccgccugggcgggcaa

SEQ ID NO: 11983 - RNA, 24 nt, Artificial Sequence
  Synthetic
cgccacggccgccugggcgggcaa

SEQ ID NO: 11984 - RNA, 18 nt, Artificial Sequence
  Synthetic
ugcgcguggccggcggca

SEQ ID NO: 11985 - RNA, 19 nt, Artificial Sequence
  Synthetic
cugcgcguggccggcggca

SEQ ID NO: 11986 - RNA, 20 nt, Artificial Sequence
  Synthetic
ccugcgcguggccggcggca

SEQ ID NO: 11987 - RNA, 21 nt, Artificial Sequence
  Synthetic
accugcgcguggccggcggca

SEQ ID NO: 11988 - RNA, 22 nt, Artificial Sequence
  Synthetic
gaccugcgcguggccggcggca

SEQ ID NO: 11989 - RNA, 23 nt, Artificial Sequence
  Synthetic
ggaccugcgcguggccggcggca

SEQ ID NO: 11990 - RNA, 24 nt, Artificial Sequence
  Synthetic
gggaccugcgcguggccggcggca

SEQ ID NO: 11991 - RNA, 18 nt, Artificial Sequence
  Synthetic
accgcgacggguacguca

SEQ ID NO: 11992 - RNA, 19 nt, Artificial Sequence
  Synthetic
uaccgcgacggguacguca

SEQ ID NO: 11993 - RNA, 20 nt, Artificial Sequence
  Synthetic
cuaccgcgacggguacguca

SEQ ID NO: 11994 - RNA, 21 nt, Artificial Sequence
  Synthetic
gcuaccgcgacggguacguca

SEQ ID NO: 11995 - RNA, 22 nt, Artificial Sequence
  Synthetic
cgcuaccgcgacggguacguca

SEQ ID NO: 11996 - RNA, 23 nt, Artificial Sequence
  Synthetic
gcgcuaccgcgacggguacguca

SEQ ID NO: 11997 - RNA, 24 nt, Artificial Sequence
  Synthetic
cgcgcuaccgcgacggguacguca

SEQ ID NO: 11998 - RNA, 18 nt, Artificial Sequence
  Synthetic
ggccgcuggguccgcgga

SEQ ID NO: 11999 - RNA, 19 nt, Artificial Sequence
  Synthetic
gggccgcuggguccgcgga

SEQ ID NO: 12000 - RNA, 20 nt, Artificial Sequence
  Synthetic
cgggccgcuggguccgcgga

SEQ ID NO: 12001 - RNA, 21 nt, Artificial Sequence
  Synthetic
gcgggccgcuggguccgcgga

SEQ ID NO: 12002 - RNA, 22 nt, Artificial Sequence
  Synthetic
cgcgggccgcuggguccgcgga

SEQ ID NO: 12003 - RNA, 23 nt, Artificial Sequence
  Synthetic
acgcgggccgcuggguccgcgga

SEQ ID NO: 12004 - RNA, 24 nt, Artificial Sequence
  Synthetic
gacgcgggccgcuggguccgcgga

SEQ ID NO: 12005 - RNA, 18 nt, Artificial Sequence
  Synthetic
gcgagaacgcggcgcuga

SEQ ID NO: 12006 - RNA, 19 nt, Artificial Sequence
  Synthetic
cgcgagaacgcggcgcuga

SEQ ID NO: 12007 - RNA, 20 nt, Artificial Sequence
  Synthetic
gcgcgagaacgcggcgcuga

SEQ ID NO: 12008 - RNA, 21 nt, Artificial Sequence
  Synthetic
cgcgcgagaacgcggcgcuga

SEQ ID NO: 12009 - RNA, 22 nt, Artificial Sequence
  Synthetic
gcgcgcgagaacgcggcgcuga

SEQ ID NO: 12010 - RNA, 23 nt, Artificial Sequence
  Synthetic
ggcgcgcgagaacgcggcgcuga

SEQ ID NO: 12011 - RNA, 24 nt, Artificial Sequence
  Synthetic
uggcgcgcgagaacgcggcgcuga

SEQ ID NO: 12012 - RNA, 18 nt, Artificial Sequence
  Synthetic
gaccugcucuuccagaac

SEQ ID NO: 12013 - RNA, 19 nt, Artificial Sequence
  Synthetic
ggaccugcucuuccagaac

SEQ ID NO: 12014 - RNA, 20 nt, Artificial Sequence
  Synthetic
cggaccugcucuuccagaac

SEQ ID NO: 12015 - RNA, 21 nt, Artificial Sequence
  Synthetic
gcggaccugcucuuccagaac

SEQ ID NO: 12016 - RNA, 22 nt, Artificial Sequence
  Synthetic
cgcggaccugcucuuccagaac

SEQ ID NO: 12017 - RNA, 23 nt, Artificial Sequence
  Synthetic
ccgcggaccugcucuuccagaac

SEQ ID NO: 12018 - RNA, 24 nt, Artificial Sequence
  Synthetic
gccgcggaccugcucuuccagaac

SEQ ID NO: 12019 - RNA, 18 nt, Artificial Sequence
  Synthetic
gcgcgggccgugccccac

SEQ ID NO: 12020 - RNA, 19 nt, Artificial Sequence
  Synthetic
ggcgcgggccgugccccac

SEQ ID NO: 12021 - RNA, 20 nt, Artificial Sequence
  Synthetic
uggcgcgggccgugccccac

SEQ ID NO: 12022 - RNA, 21 nt, Artificial Sequence
  Synthetic
guggcgcgggccgugccccac

SEQ ID NO: 12023 - RNA, 22 nt, Artificial Sequence
  Synthetic
cguggcgcgggccgugccccac

SEQ ID NO: 12024 - RNA, 23 nt, Artificial Sequence
  Synthetic
gcguggcgcgggccgugccccac

SEQ ID NO: 12025 - RNA, 24 nt, Artificial Sequence
  Synthetic
agcguggcgcgggccgugccccac

SEQ ID NO: 12026 - RNA, 18 nt, Artificial Sequence
  Synthetic
cgugcugcugcuguccac

SEQ ID NO: 12027 - RNA, 19 nt, Artificial Sequence
  Synthetic
gcgugcugcugcuguccac

SEQ ID NO: 12028 - RNA, 20 nt, Artificial Sequence
  Synthetic
ggcgugcugcugcuguccac

SEQ ID NO: 12029 - RNA, 21 nt, Artificial Sequence
  Synthetic
gggcgugcugcugcuguccac

SEQ ID NO: 12030 - RNA, 22 nt, Artificial Sequence
  Synthetic
agggcgugcugcugcuguccac

SEQ ID NO: 12031 - RNA, 23 nt, Artificial Sequence
  Synthetic
cagggcgugcugcugcuguccac

SEQ ID NO: 12032 - RNA, 24 nt, Artificial Sequence
  Synthetic
gcagggcgugcugcugcuguccac

SEQ ID NO: 12033 - RNA, 18 nt, Artificial Sequence
  Synthetic
cuggugcugcgcgacgac

SEQ ID NO: 12034 - RNA, 19 nt, Artificial Sequence
  Synthetic
gcuggugcugcgcgacgac

SEQ ID NO: 12035 - RNA, 20 nt, Artificial Sequence
  Synthetic
cgcuggugcugcgcgacgac

SEQ ID NO: 12036 - RNA, 21 nt, Artificial Sequence
  Synthetic
ccgcuggugcugcgcgacgac

SEQ ID NO: 12037 - RNA, 22 nt, Artificial Sequence
  Synthetic
cccgcuggugcugcgcgacgac

SEQ ID NO: 12038 - RNA, 23 nt, Artificial Sequence
  Synthetic
ccccgcuggugcugcgcgacgac

SEQ ID NO: 12039 - RNA, 24 nt, Artificial Sequence
  Synthetic
cccccgcuggugcugcgcgacgac

SEQ ID NO: 12040 - RNA, 18 nt, Artificial Sequence
  Synthetic
acccucggcgcggacgac

SEQ ID NO: 12041 - RNA, 19 nt, Artificial Sequence
  Synthetic
gacccucggcgcggacgac

SEQ ID NO: 12042 - RNA, 20 nt, Artificial Sequence
  Synthetic
ggacccucggcgcggacgac

SEQ ID NO: 12043 - RNA, 21 nt, Artificial Sequence
  Synthetic
gggacccucggcgcggacgac

SEQ ID NO: 12044 - RNA, 22 nt, Artificial Sequence
  Synthetic
cgggacccucggcgcggacgac

SEQ ID NO: 12045 - RNA, 23 nt, Artificial Sequence
  Synthetic
gcgggacccucggcgcggacgac

SEQ ID NO: 12046 - RNA, 24 nt, Artificial Sequence
  Synthetic
ggcgggacccucggcgcggacgac

SEQ ID NO: 12047 - RNA, 18 nt, Artificial Sequence
  Synthetic
augcgccaggugcccgac

SEQ ID NO: 12048 - RNA, 19 nt, Artificial Sequence
  Synthetic
gaugcgccaggugcccgac

SEQ ID NO: 12049 - RNA, 20 nt, Artificial Sequence
  Synthetic
ggaugcgccaggugcccgac

SEQ ID NO: 12050 - RNA, 21 nt, Artificial Sequence
  Synthetic
uggaugcgccaggugcccgac

SEQ ID NO: 12051 - RNA, 22 nt, Artificial Sequence
  Synthetic
cuggaugcgccaggugcccgac

SEQ ID NO: 12052 - RNA, 23 nt, Artificial Sequence
  Synthetic
ccuggaugcgccaggugcccgac

SEQ ID NO: 12053 - RNA, 24 nt, Artificial Sequence
  Synthetic
gccuggaugcgccaggugcccgac

SEQ ID NO: 12054 - RNA, 18 nt, Artificial Sequence
  Synthetic
gaugacgacgaccgcgac

SEQ ID NO: 12055 - RNA, 19 nt, Artificial Sequence
  Synthetic
cgaugacgacgaccgcgac

SEQ ID NO: 12056 - RNA, 20 nt, Artificial Sequence
  Synthetic
acgaugacgacgaccgcgac

SEQ ID NO: 12057 - RNA, 21 nt, Artificial Sequence
  Synthetic
gacgaugacgacgaccgcgac

SEQ ID NO: 12058 - RNA, 22 nt, Artificial Sequence
  Synthetic
cgacgaugacgacgaccgcgac

SEQ ID NO: 12059 - RNA, 23 nt, Artificial Sequence
  Synthetic
acgacgaugacgacgaccgcgac

SEQ ID NO: 12060 - RNA, 24 nt, Artificial Sequence
  Synthetic
gacgacgaugacgacgaccgcgac

SEQ ID NO: 12061 - RNA, 18 nt, Artificial Sequence
  Synthetic
cugcuguacacgccggac

SEQ ID NO: 12062 - RNA, 19 nt, Artificial Sequence
  Synthetic
gcugcuguacacgccggac

SEQ ID NO: 12063 - RNA, 20 nt, Artificial Sequence
  Synthetic
ggcugcuguacacgccggac

SEQ ID NO: 12064 - RNA, 21 nt, Artificial Sequence
  Synthetic
cggcugcuguacacgccggac

SEQ ID NO: 12065 - RNA, 22 nt, Artificial Sequence
  Synthetic
gcggcugcuguacacgccggac

SEQ ID NO: 12066 - RNA, 23 nt, Artificial Sequence
  Synthetic
cgcggcugcuguacacgccggac

SEQ ID NO: 12067 - RNA, 24 nt, Artificial Sequence
  Synthetic
acgcggcugcuguacacgccggac

SEQ ID NO: 12068 - RNA, 18 nt, Artificial Sequence
  Synthetic
cugcgcgacgacgcggac

SEQ ID NO: 12069 - RNA, 19 nt, Artificial Sequence
  Synthetic
gcugcgcgacgacgcggac

SEQ ID NO: 12070 - RNA, 20 nt, Artificial Sequence
  Synthetic
ugcugcgcgacgacgcggac

SEQ ID NO: 12071 - RNA, 21 nt, Artificial Sequence
  Synthetic
gugcugcgcgacgacgcggac

SEQ ID NO: 12072 - RNA, 22 nt, Artificial Sequence
  Synthetic
ggugcugcgcgacgacgcggac

SEQ ID NO: 12073 - RNA, 23 nt, Artificial Sequence
  Synthetic
uggugcugcgcgacgacgcggac

SEQ ID NO: 12074 - RNA, 24 nt, Artificial Sequence
  Synthetic
cuggugcugcgcgacgacgcggac

SEQ ID NO: 12075 - RNA, 18 nt, Artificial Sequence
  Synthetic
gccgcuggguccgcggac

SEQ ID NO: 12076 - RNA, 19 nt, Artificial Sequence
  Synthetic
ggccgcuggguccgcggac

SEQ ID NO: 12077 - RNA, 20 nt, Artificial Sequence
  Synthetic
gggccgcuggguccgcggac

SEQ ID NO: 12078 - RNA, 21 nt, Artificial Sequence
  Synthetic
cgggccgcuggguccgcggac

SEQ ID NO: 12079 - RNA, 22 nt, Artificial Sequence
  Synthetic
gcgggccgcuggguccgcggac

SEQ ID NO: 12080 - RNA, 23 nt, Artificial Sequence
  Synthetic
cgcgggccgcuggguccgcggac

SEQ ID NO: 12081 - RNA, 24 nt, Artificial Sequence
  Synthetic
acgcgggccgcuggguccgcggac

SEQ ID NO: 12082 - RNA, 18 nt, Artificial Sequence
  Synthetic
gagcccguggacauggac

SEQ ID NO: 12083 - RNA, 19 nt, Artificial Sequence
  Synthetic
cgagcccguggacauggac

SEQ ID NO: 12084 - RNA, 20 nt, Artificial Sequence
  Synthetic
gcgagcccguggacauggac

SEQ ID NO: 12085 - RNA, 21 nt, Artificial Sequence
  Synthetic
cgcgagcccguggacauggac

SEQ ID NO: 12086 - RNA, 22 nt, Artificial Sequence
  Synthetic
gcgcgagcccguggacauggac

SEQ ID NO: 12087 - RNA, 23 nt, Artificial Sequence
  Synthetic
ggcgcgagcccguggacauggac

SEQ ID NO: 12088 - RNA, 24 nt, Artificial Sequence
  Synthetic
aggcgcgagcccguggacauggac

SEQ ID NO: 12089 - RNA, 18 nt, Artificial Sequence
  Synthetic
aggcgcgagcccguggac

SEQ ID NO: 12090 - RNA, 19 nt, Artificial Sequence
  Synthetic
gaggcgcgagcccguggac

SEQ ID NO: 12091 - RNA, 20 nt, Artificial Sequence
  Synthetic
cgaggcgcgagcccguggac

SEQ ID NO: 12092 - RNA, 21 nt, Artificial Sequence
  Synthetic
ccgaggcgcgagcccguggac

SEQ ID NO: 12093 - RNA, 22 nt, Artificial Sequence
  Synthetic
gccgaggcgcgagcccguggac

SEQ ID NO: 12094 - RNA, 23 nt, Artificial Sequence
  Synthetic
cgccgaggcgcgagcccguggac

SEQ ID NO: 12095 - RNA, 24 nt, Artificial Sequence
  Synthetic
ccgccgaggcgcgagcccguggac

SEQ ID NO: 12096 - RNA, 18 nt, Artificial Sequence
  Synthetic
cgagaacgcggcgcugac

SEQ ID NO: 12097 - RNA, 19 nt, Artificial Sequence
  Synthetic
gcgagaacgcggcgcugac

SEQ ID NO: 12098 - RNA, 20 nt, Artificial Sequence
  Synthetic
cgcgagaacgcggcgcugac

SEQ ID NO: 12099 - RNA, 21 nt, Artificial Sequence
  Synthetic
gcgcgagaacgcggcgcugac

SEQ ID NO: 12100 - RNA, 22 nt, Artificial Sequence
  Synthetic
cgcgcgagaacgcggcgcugac

SEQ ID NO: 12101 - RNA, 23 nt, Artificial Sequence
  Synthetic
gcgcgcgagaacgcggcgcugac

SEQ ID NO: 12102 - RNA, 24 nt, Artificial Sequence
  Synthetic
ggcgcgcgagaacgcggcgcugac

SEQ ID NO: 12103 - RNA, 18 nt, Artificial Sequence
  Synthetic
gcgguccgcggggcguac

SEQ ID NO: 12104 - RNA, 19 nt, Artificial Sequence
  Synthetic
cgcgguccgcggggcguac

SEQ ID NO: 12105 - RNA, 20 nt, Artificial Sequence
  Synthetic
ccgcgguccgcggggcguac

SEQ ID NO: 12106 - RNA, 21 nt, Artificial Sequence
  Synthetic
uccgcgguccgcggggcguac

SEQ ID NO: 12107 - RNA, 22 nt, Artificial Sequence
  Synthetic
guccgcgguccgcggggcguac

SEQ ID NO: 12108 - RNA, 23 nt, Artificial Sequence
  Synthetic
cguccgcgguccgcggggcguac

SEQ ID NO: 12109 - RNA, 24 nt, Artificial Sequence
  Synthetic
acguccgcgguccgcggggcguac

SEQ ID NO: 12110 - RNA, 18 nt, Artificial Sequence
  Synthetic
ugcgccaggugcccgacc

SEQ ID NO: 12111 - RNA, 19 nt, Artificial Sequence
  Synthetic
augcgccaggugcccgacc

SEQ ID NO: 12112 - RNA, 20 nt, Artificial Sequence
  Synthetic
gaugcgccaggugcccgacc

SEQ ID NO: 12113 - RNA, 21 nt, Artificial Sequence
  Synthetic
ggaugcgccaggugcccgacc

SEQ ID NO: 12114 - RNA, 22 nt, Artificial Sequence
  Synthetic
uggaugcgccaggugcccgacc

SEQ ID NO: 12115 - RNA, 23 nt, Artificial Sequence
  Synthetic
cuggaugcgccaggugcccgacc

SEQ ID NO: 12116 - RNA, 24 nt, Artificial Sequence
  Synthetic
ccuggaugcgccaggugcccgacc

SEQ ID NO: 12117 - RNA, 18 nt, Artificial Sequence
  Synthetic
cggacccccgcggcgacc

SEQ ID NO: 12118 - RNA, 19 nt, Artificial Sequence
  Synthetic
ccggacccccgcggcgacc

SEQ ID NO: 12119 - RNA, 20 nt, Artificial Sequence
  Synthetic
cccggacccccgcggcgacc

SEQ ID NO: 12120 - RNA, 21 nt, Artificial Sequence
  Synthetic
gcccggacccccgcggcgacc

SEQ ID NO: 12121 - RNA, 22 nt, Artificial Sequence
  Synthetic
ggcccggacccccgcggcgacc

SEQ ID NO: 12122 - RNA, 23 nt, Artificial Sequence
  Synthetic
cggcccggacccccgcggcgacc

SEQ ID NO: 12123 - RNA, 24 nt, Artificial Sequence
  Synthetic
ccggcccggacccccgcggcgacc

SEQ ID NO: 12124 - RNA, 18 nt, Artificial Sequence
  Synthetic
gccgggggcgggcccccc

SEQ ID NO: 12125 - RNA, 19 nt, Artificial Sequence
  Synthetic
cgccgggggcgggcccccc

SEQ ID NO: 12126 - RNA, 20 nt, Artificial Sequence
  Synthetic
gcgccgggggcgggcccccc

SEQ ID NO: 12127 - RNA, 21 nt, Artificial Sequence
  Synthetic
cgcgccgggggcgggcccccc

SEQ ID NO: 12128 - RNA, 22 nt, Artificial Sequence
  Synthetic
ccgcgccgggggcgggcccccc

SEQ ID NO: 12129 - RNA, 23 nt, Artificial Sequence
  Synthetic
gccgcgccgggggcgggcccccc

SEQ ID NO: 12130 - RNA, 24 nt, Artificial Sequence
  Synthetic
ggccgcgccgggggcgggcccccc

SEQ ID NO: 12131 - RNA, 18 nt, Artificial Sequence
  Synthetic
gggccggccccccgcccc

SEQ ID NO: 12132 - RNA, 19 nt, Artificial Sequence
  Synthetic
ggggccggccccccgcccc

SEQ ID NO: 12133 - RNA, 20 nt, Artificial Sequence
  Synthetic
cggggccggccccccgcccc

SEQ ID NO: 12134 - RNA, 21 nt, Artificial Sequence
  Synthetic
ccggggccggccccccgcccc

SEQ ID NO: 12135 - RNA, 22 nt, Artificial Sequence
  Synthetic
cccggggccggccccccgcccc

SEQ ID NO: 12136 - RNA, 23 nt, Artificial Sequence
  Synthetic
gcccggggccggccccccgcccc

SEQ ID NO: 12137 - RNA, 24 nt, Artificial Sequence
  Synthetic
ggcccggggccggccccccgcccc

SEQ ID NO: 12138 - RNA, 18 nt, Artificial Sequence
  Synthetic
ggcggcgccccgcgcccc

SEQ ID NO: 12139 - RNA, 19 nt, Artificial Sequence
  Synthetic
gggcggcgccccgcgcccc

SEQ ID NO: 12140 - RNA, 20 nt, Artificial Sequence
  Synthetic
cgggcggcgccccgcgcccc

SEQ ID NO: 12141 - RNA, 21 nt, Artificial Sequence
  Synthetic
ccgggcggcgccccgcgcccc

SEQ ID NO: 12142 - RNA, 22 nt, Artificial Sequence
  Synthetic
gccgggcggcgccccgcgcccc

SEQ ID NO: 12143 - RNA, 23 nt, Artificial Sequence
  Synthetic
cgccgggcggcgccccgcgcccc

SEQ ID NO: 12144 - RNA, 24 nt, Artificial Sequence
  Synthetic
ccgccgggcggcgccccgcgcccc

SEQ ID NO: 12145 - RNA, 18 nt, Artificial Sequence
  Synthetic
ggaggccuacugcgcccc

SEQ ID NO: 12146 - RNA, 19 nt, Artificial Sequence
  Synthetic
uggaggccuacugcgcccc

SEQ ID NO: 12147 - RNA, 20 nt, Artificial Sequence
  Synthetic
cuggaggccuacugcgcccc

SEQ ID NO: 12148 - RNA, 21 nt, Artificial Sequence
  Synthetic
ccuggaggccuacugcgcccc

SEQ ID NO: 12149 - RNA, 22 nt, Artificial Sequence
  Synthetic
cccuggaggccuacugcgcccc

SEQ ID NO: 12150 - RNA, 23 nt, Artificial Sequence
  Synthetic
gcccuggaggccuacugcgcccc

SEQ ID NO: 12151 - RNA, 24 nt, Artificial Sequence
  Synthetic
cgcccuggaggccuacugcgcccc

SEQ ID NO: 12152 - RNA, 18 nt, Artificial Sequence
  Synthetic
ggugcccgcgagggcccc

SEQ ID NO: 12153 - RNA, 19 nt, Artificial Sequence
  Synthetic
gggugcccgcgagggcccc

SEQ ID NO: 12154 - RNA, 20 nt, Artificial Sequence
  Synthetic
ggggugcccgcgagggcccc

SEQ ID NO: 12155 - RNA, 21 nt, Artificial Sequence
  Synthetic
gggggugcccgcgagggcccc

SEQ ID NO: 12156 - RNA, 22 nt, Artificial Sequence
  Synthetic
cgggggugcccgcgagggcccc

SEQ ID NO: 12157 - RNA, 23 nt, Artificial Sequence
  Synthetic
gcgggggugcccgcgagggcccc

SEQ ID NO: 12158 - RNA, 24 nt, Artificial Sequence
  Synthetic
ggcgggggugcccgcgagggcccc

SEQ ID NO: 12159 - RNA, 18 nt, Artificial Sequence
  Synthetic
ccgccgaggcgcgagccc

SEQ ID NO: 12160 - RNA, 19 nt, Artificial Sequence
  Synthetic
gccgccgaggcgcgagccc

SEQ ID NO: 12161 - RNA, 20 nt, Artificial Sequence
  Synthetic
cgccgccgaggcgcgagccc

SEQ ID NO: 12162 - RNA, 21 nt, Artificial Sequence
  Synthetic
acgccgccgaggcgcgagccc

SEQ ID NO: 12163 - RNA, 22 nt, Artificial Sequence
  Synthetic
cacgccgccgaggcgcgagccc

SEQ ID NO: 12164 - RNA, 23 nt, Artificial Sequence
  Synthetic
ccacgccgccgaggcgcgagccc

SEQ ID NO: 12165 - RNA, 24 nt, Artificial Sequence
  Synthetic
gccacgccgccgaggcgcgagccc

SEQ ID NO: 12166 - RNA, 18 nt, Artificial Sequence
  Synthetic
acgacggcgacgacgccc

SEQ ID NO: 12167 - RNA, 19 nt, Artificial Sequence
  Synthetic
cacgacggcgacgacgccc

SEQ ID NO: 12168 - RNA, 20 nt, Artificial Sequence
  Synthetic
ccacgacggcgacgacgccc

SEQ ID NO: 12169 - RNA, 21 nt, Artificial Sequence
  Synthetic
gccacgacggcgacgacgccc

SEQ ID NO: 12170 - RNA, 22 nt, Artificial Sequence
  Synthetic
cgccacgacggcgacgacgccc

SEQ ID NO: 12171 - RNA, 23 nt, Artificial Sequence
  Synthetic
ccgccacgacggcgacgacgccc

SEQ ID NO: 12172 - RNA, 24 nt, Artificial Sequence
  Synthetic
accgccacgacggcgacgacgccc

SEQ ID NO: 12173 - RNA, 18 nt, Artificial Sequence
  Synthetic
ggggccggccccccgccc

SEQ ID NO: 12174 - RNA, 19 nt, Artificial Sequence
  Synthetic
cggggccggccccccgccc

SEQ ID NO: 12175 - RNA, 20 nt, Artificial Sequence
  Synthetic
ccggggccggccccccgccc

SEQ ID NO: 12176 - RNA, 21 nt, Artificial Sequence
  Synthetic
cccggggccggccccccgccc

SEQ ID NO: 12177 - RNA, 22 nt, Artificial Sequence
  Synthetic
gcccggggccggccccccgccc

SEQ ID NO: 12178 - RNA, 23 nt, Artificial Sequence
  Synthetic
ggcccggggccggccccccgccc

SEQ ID NO: 12179 - RNA, 24 nt, Artificial Sequence
  Synthetic
uggcccggggccggccccccgccc

SEQ ID NO: 12180 - RNA, 18 nt, Artificial Sequence
  Synthetic
cgcccucggccgccgccc

SEQ ID NO: 12181 - RNA, 19 nt, Artificial Sequence
  Synthetic
gcgcccucggccgccgccc

SEQ ID NO: 12182 - RNA, 20 nt, Artificial Sequence
  Synthetic
ggcgcccucggccgccgccc

SEQ ID NO: 12183 - RNA, 21 nt, Artificial Sequence
  Synthetic
cggcgcccucggccgccgccc

SEQ ID NO: 12184 - RNA, 22 nt, Artificial Sequence
  Synthetic
ccggcgcccucggccgccgccc

SEQ ID NO: 12185 - RNA, 23 nt, Artificial Sequence
  Synthetic
gccggcgcccucggccgccgccc

SEQ ID NO: 12186 - RNA, 24 nt, Artificial Sequence
  Synthetic
cgccggcgcccucggccgccgccc

SEQ ID NO: 12187 - RNA, 18 nt, Artificial Sequence
  Synthetic
cgggggugcucgccgccc

SEQ ID NO: 12188 - RNA, 19 nt, Artificial Sequence
  Synthetic
gcgggggugcucgccgccc

SEQ ID NO: 12189 - RNA, 20 nt, Artificial Sequence
  Synthetic
cgcgggggugcucgccgccc

SEQ ID NO: 12190 - RNA, 21 nt, Artificial Sequence
  Synthetic
ccgcgggggugcucgccgccc

SEQ ID NO: 12191 - RNA, 22 nt, Artificial Sequence
  Synthetic
gccgcgggggugcucgccgccc

SEQ ID NO: 12192 - RNA, 23 nt, Artificial Sequence
  Synthetic
cgccgcgggggugcucgccgccc

SEQ ID NO: 12193 - RNA, 24 nt, Artificial Sequence
  Synthetic
gcgccgcgggggugcucgccgccc

SEQ ID NO: 12194 - RNA, 18 nt, Artificial Sequence
  Synthetic
aacccgcgcguggcgccc

SEQ ID NO: 12195 - RNA, 19 nt, Artificial Sequence
  Synthetic
gaacccgcgcguggcgccc

SEQ ID NO: 12196 - RNA, 20 nt, Artificial Sequence
  Synthetic
agaacccgcgcguggcgccc

SEQ ID NO: 12197 - RNA, 21 nt, Artificial Sequence
  Synthetic
cagaacccgcgcguggcgccc

SEQ ID NO: 12198 - RNA, 22 nt, Artificial Sequence
  Synthetic
ccagaacccgcgcguggcgccc

SEQ ID NO: 12199 - RNA, 23 nt, Artificial Sequence
  Synthetic
uccagaacccgcgcguggcgccc

SEQ ID NO: 12200 - RNA, 24 nt, Artificial Sequence
  Synthetic
cuccagaacccgcgcguggcgccc

SEQ ID NO: 12201 - RNA, 18 nt, Artificial Sequence
  Synthetic
gggugcccgcgagggccc

SEQ ID NO: 12202 - RNA, 19 nt, Artificial Sequence
  Synthetic
ggggugcccgcgagggccc

SEQ ID NO: 12203 - RNA, 20 nt, Artificial Sequence
  Synthetic
gggggugcccgcgagggccc

SEQ ID NO: 12204 - RNA, 21 nt, Artificial Sequence
  Synthetic
cgggggugcccgcgagggccc

SEQ ID NO: 12205 - RNA, 22 nt, Artificial Sequence
  Synthetic
gcgggggugcccgcgagggccc

SEQ ID NO: 12206 - RNA, 23 nt, Artificial Sequence
  Synthetic
ggcgggggugcccgcgagggccc

SEQ ID NO: 12207 - RNA, 24 nt, Artificial Sequence
  Synthetic
aggcgggggugcccgcgagggccc

SEQ ID NO: 12208 - RNA, 18 nt, Artificial Sequence
  Synthetic
cccccgcgcccggggccc

SEQ ID NO: 12209 - RNA, 19 nt, Artificial Sequence
  Synthetic
gcccccgcgcccggggccc

SEQ ID NO: 12210 - RNA, 20 nt, Artificial Sequence
  Synthetic
cgcccccgcgcccggggccc

SEQ ID NO: 12211 - RNA, 21 nt, Artificial Sequence
  Synthetic
gcgcccccgcgcccggggccc

SEQ ID NO: 12212 - RNA, 22 nt, Artificial Sequence
  Synthetic
cgcgcccccgcgcccggggccc

SEQ ID NO: 12213 - RNA, 23 nt, Artificial Sequence
  Synthetic
ccgcgcccccgcgcccggggccc

SEQ ID NO: 12214 - RNA, 24 nt, Artificial Sequence
  Synthetic
gccgcgcccccgcgcccggggccc

SEQ ID NO: 12215 - RNA, 18 nt, Artificial Sequence
  Synthetic
gaggaggcgggggugccc

SEQ ID NO: 12216 - RNA, 19 nt, Artificial Sequence
  Synthetic
cgaggaggcgggggugccc

SEQ ID NO: 12217 - RNA, 20 nt, Artificial Sequence
  Synthetic
acgaggaggcgggggugccc

SEQ ID NO: 12218 - RNA, 21 nt, Artificial Sequence
  Synthetic
gacgaggaggcgggggugccc

SEQ ID NO: 12219 - RNA, 22 nt, Artificial Sequence
  Synthetic
cgacgaggaggcgggggugccc

SEQ ID NO: 12220 - RNA, 23 nt, Artificial Sequence
  Synthetic
acgacgaggaggcgggggugccc

SEQ ID NO: 12221 - RNA, 24 nt, Artificial Sequence
  Synthetic
gacgacgaggaggcgggggugccc

SEQ ID NO: 12222 - RNA, 18 nt, Artificial Sequence
  Synthetic
cccgcggccgccccuccc

SEQ ID NO: 12223 - RNA, 19 nt, Artificial Sequence
  Synthetic
ccccgcggccgccccuccc

SEQ ID NO: 12224 - RNA, 20 nt, Artificial Sequence
  Synthetic
gccccgcggccgccccuccc

SEQ ID NO: 12225 - RNA, 21 nt, Artificial Sequence
  Synthetic
cgccccgcggccgccccuccc

SEQ ID NO: 12226 - RNA, 22 nt, Artificial Sequence
  Synthetic
ccgccccgcggccgccccuccc

SEQ ID NO: 12227 - RNA, 23 nt, Artificial Sequence
  Synthetic
cccgccccgcggccgccccuccc

SEQ ID NO: 12228 - RNA, 24 nt, Artificial Sequence
  Synthetic
ccccgccccgcggccgccccuccc

SEQ ID NO: 12229 - RNA, 18 nt, Artificial Sequence
  Synthetic
agcgccgcagaccacgcc

SEQ ID NO: 12230 - RNA, 19 nt, Artificial Sequence
  Synthetic
cagcgccgcagaccacgcc

SEQ ID NO: 12231 - RNA, 20 nt, Artificial Sequence
  Synthetic
ccagcgccgcagaccacgcc

SEQ ID NO: 12232 - RNA, 21 nt, Artificial Sequence
  Synthetic
gccagcgccgcagaccacgcc

SEQ ID NO: 12233 - RNA, 22 nt, Artificial Sequence
  Synthetic
cgccagcgccgcagaccacgcc

SEQ ID NO: 12234 - RNA, 23 nt, Artificial Sequence
  Synthetic
ccgccagcgccgcagaccacgcc

SEQ ID NO: 12235 - RNA, 24 nt, Artificial Sequence
  Synthetic
cccgccagcgccgcagaccacgcc

SEQ ID NO: 12236 - RNA, 18 nt, Artificial Sequence
  Synthetic
guggccggccgcgacgcc

SEQ ID NO: 12237 - RNA, 19 nt, Artificial Sequence
  Synthetic
gguggccggccgcgacgcc

SEQ ID NO: 12238 - RNA, 20 nt, Artificial Sequence
  Synthetic
cgguggccggccgcgacgcc

SEQ ID NO: 12239 - RNA, 21 nt, Artificial Sequence
  Synthetic
gcgguggccggccgcgacgcc

SEQ ID NO: 12240 - RNA, 22 nt, Artificial Sequence
  Synthetic
ggcgguggccggccgcgacgcc

SEQ ID NO: 12241 - RNA, 23 nt, Artificial Sequence
  Synthetic
cggcgguggccggccgcgacgcc

SEQ ID NO: 12242 - RNA, 24 nt, Artificial Sequence
  Synthetic
gcggcgguggccggccgcgacgcc

SEQ ID NO: 12243 - RNA, 18 nt, Artificial Sequence
  Synthetic
gaggugguggggaccgcc

SEQ ID NO: 12244 - RNA, 19 nt, Artificial Sequence
  Synthetic
ggaggugguggggaccgcc

SEQ ID NO: 12245 - RNA, 20 nt, Artificial Sequence
  Synthetic
uggaggugguggggaccgcc

SEQ ID NO: 12246 - RNA, 21 nt, Artificial Sequence
  Synthetic
guggaggugguggggaccgcc

SEQ ID NO: 12247 - RNA, 22 nt, Artificial Sequence
  Synthetic
cguggaggugguggggaccgcc

SEQ ID NO: 12248 - RNA, 23 nt, Artificial Sequence
  Synthetic
gcguggaggugguggggaccgcc

SEQ ID NO: 12249 - RNA, 24 nt, Artificial Sequence
  Synthetic
ggcguggaggugguggggaccgcc

SEQ ID NO: 12250 - RNA, 18 nt, Artificial Sequence
  Synthetic
gccccggccgagcccgcc

SEQ ID NO: 12251 - RNA, 19 nt, Artificial Sequence
  Synthetic
cgccccggccgagcccgcc

SEQ ID NO: 12252 - RNA, 20 nt, Artificial Sequence
  Synthetic
gcgccccggccgagcccgcc

SEQ ID NO: 12253 - RNA, 21 nt, Artificial Sequence
  Synthetic
ggcgccccggccgagcccgcc

SEQ ID NO: 12254 - RNA, 22 nt, Artificial Sequence
  Synthetic
cggcgccccggccgagcccgcc

SEQ ID NO: 12255 - RNA, 23 nt, Artificial Sequence
  Synthetic
gcggcgccccggccgagcccgcc

SEQ ID NO: 12256 - RNA, 24 nt, Artificial Sequence
  Synthetic
ggcggcgccccggccgagcccgcc

SEQ ID NO: 12257 - RNA, 18 nt, Artificial Sequence
  Synthetic
cugacccgccggcccgcc

SEQ ID NO: 12258 - RNA, 19 nt, Artificial Sequence
  Synthetic
gcugacccgccggcccgcc

SEQ ID NO: 12259 - RNA, 20 nt, Artificial Sequence
  Synthetic
cgcugacccgccggcccgcc

SEQ ID NO: 12260 - RNA, 21 nt, Artificial Sequence
  Synthetic
gcgcugacccgccggcccgcc

SEQ ID NO: 12261 - RNA, 22 nt, Artificial Sequence
  Synthetic
ggcgcugacccgccggcccgcc

SEQ ID NO: 12262 - RNA, 23 nt, Artificial Sequence
  Synthetic
cggcgcugacccgccggcccgcc

SEQ ID NO: 12263 - RNA, 24 nt, Artificial Sequence
  Synthetic
gcggcgcugacccgccggcccgcc

SEQ ID NO: 12264 - RNA, 18 nt, Artificial Sequence
  Synthetic
uccgccgccgccgccgcc

SEQ ID NO: 12265 - RNA, 19 nt, Artificial Sequence
  Synthetic
cuccgccgccgccgccgcc

SEQ ID NO: 12266 - RNA, 20 nt, Artificial Sequence
  Synthetic
gcuccgccgccgccgccgcc

SEQ ID NO: 12267 - RNA, 21 nt, Artificial Sequence
  Synthetic
agcuccgccgccgccgccgcc

SEQ ID NO: 12268 - RNA, 22 nt, Artificial Sequence
  Synthetic
gagcuccgccgccgccgccgcc

SEQ ID NO: 12269 - RNA, 23 nt, Artificial Sequence
  Synthetic
ugagcuccgccgccgccgccgcc

SEQ ID NO: 12270 - RNA, 24 nt, Artificial Sequence
  Synthetic
cugagcuccgccgccgccgccgcc

SEQ ID NO: 12271 - RNA, 18 nt, Artificial Sequence
  Synthetic
gcgcccucggccgccgcc

SEQ ID NO: 12272 - RNA, 19 nt, Artificial Sequence
  Synthetic
ggcgcccucggccgccgcc

SEQ ID NO: 12273 - RNA, 20 nt, Artificial Sequence
  Synthetic
cggcgcccucggccgccgcc

SEQ ID NO: 12274 - RNA, 21 nt, Artificial Sequence
  Synthetic
ccggcgcccucggccgccgcc

SEQ ID NO: 12275 - RNA, 22 nt, Artificial Sequence
  Synthetic
gccggcgcccucggccgccgcc

SEQ ID NO: 12276 - RNA, 23 nt, Artificial Sequence
  Synthetic
cgccggcgcccucggccgccgcc

SEQ ID NO: 12277 - RNA, 24 nt, Artificial Sequence
  Synthetic
acgccggcgcccucggccgccgcc

SEQ ID NO: 12278 - RNA, 18 nt, Artificial Sequence
  Synthetic
gacggccgggccgccgcc

SEQ ID NO: 12279 - RNA, 19 nt, Artificial Sequence
  Synthetic
ggacggccgggccgccgcc

SEQ ID NO: 12280 - RNA, 20 nt, Artificial Sequence
  Synthetic
uggacggccgggccgccgcc

SEQ ID NO: 12281 - RNA, 21 nt, Artificial Sequence
  Synthetic
cuggacggccgggccgccgcc

SEQ ID NO: 12282 - RNA, 22 nt, Artificial Sequence
  Synthetic
gcuggacggccgggccgccgcc

SEQ ID NO: 12283 - RNA, 23 nt, Artificial Sequence
  Synthetic
cgcuggacggccgggccgccgcc

SEQ ID NO: 12284 - RNA, 24 nt, Artificial Sequence
  Synthetic
gcgcuggacggccgggccgccgcc

SEQ ID NO: 12285 - RNA, 18 nt, Artificial Sequence
  Synthetic
gcgggggugcucgccgcc

SEQ ID NO: 12286 - RNA, 19 nt, Artificial Sequence
  Synthetic
cgcgggggugcucgccgcc

SEQ ID NO: 12287 - RNA, 20 nt, Artificial Sequence
  Synthetic
ccgcgggggugcucgccgcc

SEQ ID NO: 12288 - RNA, 21 nt, Artificial Sequence
  Synthetic
gccgcgggggugcucgccgcc

SEQ ID NO: 12289 - RNA, 22 nt, Artificial Sequence
  Synthetic
cgccgcgggggugcucgccgcc

SEQ ID NO: 12290 - RNA, 23 nt, Artificial Sequence
  Synthetic
gcgccgcgggggugcucgccgcc

SEQ ID NO: 12291 - RNA, 24 nt, Artificial Sequence
  Synthetic
ggcgccgcgggggugcucgccgcc

SEQ ID NO: 12292 - RNA, 18 nt, Artificial Sequence
  Synthetic
cggcgaccgcgggccgcc

SEQ ID NO: 12293 - RNA, 19 nt, Artificial Sequence
  Synthetic
gcggcgaccgcgggccgcc

SEQ ID NO: 12294 - RNA, 20 nt, Artificial Sequence
  Synthetic
cgcggcgaccgcgggccgcc

SEQ ID NO: 12295 - RNA, 21 nt, Artificial Sequence
  Synthetic
ccgcggcgaccgcgggccgcc

SEQ ID NO: 12296 - RNA, 22 nt, Artificial Sequence
  Synthetic
cccgcggcgaccgcgggccgcc

SEQ ID NO: 12297 - RNA, 23 nt, Artificial Sequence
  Synthetic
ccccgcggcgaccgcgggccgcc

SEQ ID NO: 12298 - RNA, 24 nt, Artificial Sequence
  Synthetic
cccccgcggcgaccgcgggccgcc

SEQ ID NO: 12299 - RNA, 18 nt, Artificial Sequence
  Synthetic
ccgccgcgcccccgcgcc

SEQ ID NO: 12300 - RNA, 19 nt, Artificial Sequence
  Synthetic
cccgccgcgcccccgcgcc

SEQ ID NO: 12301 - RNA, 20 nt, Artificial Sequence
  Synthetic
gcccgccgcgcccccgcgcc

SEQ ID NO: 12302 - RNA, 21 nt, Artificial Sequence
  Synthetic
ggcccgccgcgcccccgcgcc

SEQ ID NO: 12303 - RNA, 22 nt, Artificial Sequence
  Synthetic
cggcccgccgcgcccccgcgcc

SEQ ID NO: 12304 - RNA, 23 nt, Artificial Sequence
  Synthetic
ccggcccgccgcgcccccgcgcc

SEQ ID NO: 12305 - RNA, 24 nt, Artificial Sequence
  Synthetic
cccggcccgccgcgcccccgcgcc

SEQ ID NO: 12306 - RNA, 18 nt, Artificial Sequence
  Synthetic
cuggccgcgggccgcgcc

SEQ ID NO: 12307 - RNA, 19 nt, Artificial Sequence
  Synthetic
ccuggccgcgggccgcgcc

SEQ ID NO: 12308 - RNA, 20 nt, Artificial Sequence
  Synthetic
accuggccgcgggccgcgcc

SEQ ID NO: 12309 - RNA, 21 nt, Artificial Sequence
  Synthetic
gaccuggccgcgggccgcgcc

SEQ ID NO: 12310 - RNA, 22 nt, Artificial Sequence
  Synthetic
ggaccuggccgcgggccgcgcc

SEQ ID NO: 12311 - RNA, 23 nt, Artificial Sequence
  Synthetic
aggaccuggccgcgggccgcgcc

SEQ ID NO: 12312 - RNA, 24 nt, Artificial Sequence
  Synthetic
gaggaccuggccgcgggccgcgcc

SEQ ID NO: 12313 - RNA, 18 nt, Artificial Sequence
  Synthetic
cgcgcccgccuccgcgcc

SEQ ID NO: 12314 - RNA, 19 nt, Artificial Sequence
  Synthetic
ccgcgcccgccuccgcgcc

SEQ ID NO: 12315 - RNA, 20 nt, Artificial Sequence
  Synthetic
gccgcgcccgccuccgcgcc

SEQ ID NO: 12316 - RNA, 21 nt, Artificial Sequence
  Synthetic
cgccgcgcccgccuccgcgcc

SEQ ID NO: 12317 - RNA, 22 nt, Artificial Sequence
  Synthetic
ucgccgcgcccgccuccgcgcc

SEQ ID NO: 12318 - RNA, 23 nt, Artificial Sequence
  Synthetic
cucgccgcgcccgccuccgcgcc

SEQ ID NO: 12319 - RNA, 24 nt, Artificial Sequence
  Synthetic
gcucgccgcgcccgccuccgcgcc

SEQ ID NO: 12320 - RNA, 18 nt, Artificial Sequence
  Synthetic
uucggcccgcugcgcgcc

SEQ ID NO: 12321 - RNA, 19 nt, Artificial Sequence
  Synthetic
cuucggcccgcugcgcgcc

SEQ ID NO: 12322 - RNA, 20 nt, Artificial Sequence
  Synthetic
ccuucggcccgcugcgcgcc

SEQ ID NO: 12323 - RNA, 21 nt, Artificial Sequence
  Synthetic
gccuucggcccgcugcgcgcc

SEQ ID NO: 12324 - RNA, 22 nt, Artificial Sequence
  Synthetic
cgccuucggcccgcugcgcgcc

SEQ ID NO: 12325 - RNA, 23 nt, Artificial Sequence
  Synthetic
ccgccuucggcccgcugcgcgcc

SEQ ID NO: 12326 - RNA, 24 nt, Artificial Sequence
  Synthetic
gccgccuucggcccgcugcgcgcc

SEQ ID NO: 12327 - RNA, 18 nt, Artificial Sequence
  Synthetic
gucaacgccgugcgcgcc

SEQ ID NO: 12328 - RNA, 19 nt, Artificial Sequence
  Synthetic
cgucaacgccgugcgcgcc

SEQ ID NO: 12329 - RNA, 20 nt, Artificial Sequence
  Synthetic
ucgucaacgccgugcgcgcc

SEQ ID NO: 12330 - RNA, 21 nt, Artificial Sequence
  Synthetic
gucgucaacgccgugcgcgcc

SEQ ID NO: 12331 - RNA, 22 nt, Artificial Sequence
  Synthetic
cgucgucaacgccgugcgcgcc

SEQ ID NO: 12332 - RNA, 23 nt, Artificial Sequence
  Synthetic
ucgucgucaacgccgugcgcgcc

SEQ ID NO: 12333 - RNA, 24 nt, Artificial Sequence
  Synthetic
aucgucgucaacgccgugcgcgcc

SEQ ID NO: 12334 - RNA, 18 nt, Artificial Sequence
  Synthetic
guggccgccgugcgcgcc

SEQ ID NO: 12335 - RNA, 19 nt, Artificial Sequence
  Synthetic
cguggccgccgugcgcgcc

SEQ ID NO: 12336 - RNA, 20 nt, Artificial Sequence
  Synthetic
ccguggccgccgugcgcgcc

SEQ ID NO: 12337 - RNA, 21 nt, Artificial Sequence
  Synthetic
gccguggccgccgugcgcgcc

SEQ ID NO: 12338 - RNA, 22 nt, Artificial Sequence
  Synthetic
cgccguggccgccgugcgcgcc

SEQ ID NO: 12339 - RNA, 23 nt, Artificial Sequence
  Synthetic
ccgccguggccgccgugcgcgcc

SEQ ID NO: 12340 - RNA, 24 nt, Artificial Sequence
  Synthetic
gccgccguggccgccgugcgcgcc

SEQ ID NO: 12341 - RNA, 18 nt, Artificial Sequence
  Synthetic
cccgccggcuacggcgcc

SEQ ID NO: 12342 - RNA, 19 nt, Artificial Sequence
  Synthetic
gcccgccggcuacggcgcc

SEQ ID NO: 12343 - RNA, 20 nt, Artificial Sequence
  Synthetic
ugcccgccggcuacggcgcc

SEQ ID NO: 12344 - RNA, 21 nt, Artificial Sequence
  Synthetic
gugcccgccggcuacggcgcc

SEQ ID NO: 12345 - RNA, 22 nt, Artificial Sequence
  Synthetic
ggugcccgccggcuacggcgcc

SEQ ID NO: 12346 - RNA, 23 nt, Artificial Sequence
  Synthetic
cggugcccgccggcuacggcgcc

SEQ ID NO: 12347 - RNA, 24 nt, Artificial Sequence
  Synthetic
gcggugcccgccggcuacggcgcc

SEQ ID NO: 12348 - RNA, 18 nt, Artificial Sequence
  Synthetic
cuggccuucgccggcgcc

SEQ ID NO: 12349 - RNA, 19 nt, Artificial Sequence
  Synthetic
ccuggccuucgccggcgcc

SEQ ID NO: 12350 - RNA, 20 nt, Artificial Sequence
  Synthetic
accuggccuucgccggcgcc

SEQ ID NO: 12351 - RNA, 21 nt, Artificial Sequence
  Synthetic
gaccuggccuucgccggcgcc

SEQ ID NO: 12352 - RNA, 22 nt, Artificial Sequence
  Synthetic
ggaccuggccuucgccggcgcc

SEQ ID NO: 12353 - RNA, 23 nt, Artificial Sequence
  Synthetic
gggaccuggccuucgccggcgcc

SEQ ID NO: 12354 - RNA, 24 nt, Artificial Sequence
  Synthetic
cgggaccuggccuucgccggcgcc

SEQ ID NO: 12355 - RNA, 18 nt, Artificial Sequence
  Synthetic
gaacccgcgcguggcgcc

SEQ ID NO: 12356 - RNA, 19 nt, Artificial Sequence
  Synthetic
agaacccgcgcguggcgcc

SEQ ID NO: 12357 - RNA, 20 nt, Artificial Sequence
  Synthetic
cagaacccgcgcguggcgcc

SEQ ID NO: 12358 - RNA, 21 nt, Artificial Sequence
  Synthetic
ccagaacccgcgcguggcgcc

SEQ ID NO: 12359 - RNA, 22 nt, Artificial Sequence
  Synthetic
uccagaacccgcgcguggcgcc

SEQ ID NO: 12360 - RNA, 23 nt, Artificial Sequence
  Synthetic
cuccagaacccgcgcguggcgcc

SEQ ID NO: 12361 - RNA, 24 nt, Artificial Sequence
  Synthetic
gcuccagaacccgcgcguggcgcc

SEQ ID NO: 12362 - RNA, 18 nt, Artificial Sequence
  Synthetic
cgggcccgguucgaggcc

SEQ ID NO: 12363 - RNA, 19 nt, Artificial Sequence
  Synthetic
gcgggcccgguucgaggcc

SEQ ID NO: 12364 - RNA, 20 nt, Artificial Sequence
  Synthetic
cgcgggcccgguucgaggcc

SEQ ID NO: 12365 - RNA, 21 nt, Artificial Sequence
  Synthetic
gcgcgggcccgguucgaggcc

SEQ ID NO: 12366 - RNA, 22 nt, Artificial Sequence
  Synthetic
ggcgcgggcccgguucgaggcc

SEQ ID NO: 12367 - RNA, 23 nt, Artificial Sequence
  Synthetic
aggcgcgggcccgguucgaggcc

SEQ ID NO: 12368 - RNA, 24 nt, Artificial Sequence
  Synthetic
gaggcgcgggcccgguucgaggcc

SEQ ID NO: 12369 - RNA, 18 nt, Artificial Sequence
  Synthetic
uccugccugcuggcggcc

SEQ ID NO: 12370 - RNA, 19 nt, Artificial Sequence
  Synthetic
guccugccugcuggcggcc

SEQ ID NO: 12371 - RNA, 20 nt, Artificial Sequence
  Synthetic
uguccugccugcuggcggcc

SEQ ID NO: 12372 - RNA, 21 nt, Artificial Sequence
  Synthetic
cuguccugccugcuggcggcc

SEQ ID NO: 12373 - RNA, 22 nt, Artificial Sequence
  Synthetic
gcuguccugccugcuggcggcc

SEQ ID NO: 12374 - RNA, 23 nt, Artificial Sequence
  Synthetic
ggcuguccugccugcuggcggcc

SEQ ID NO: 12375 - RNA, 24 nt, Artificial Sequence
  Synthetic
gggcuguccugccugcuggcggcc

SEQ ID NO: 12376 - RNA, 18 nt, Artificial Sequence
  Synthetic
auacgcugggcgucggcc

SEQ ID NO: 12377 - RNA, 19 nt, Artificial Sequence
  Synthetic
gauacgcugggcgucggcc

SEQ ID NO: 12378 - RNA, 20 nt, Artificial Sequence
  Synthetic
agauacgcugggcgucggcc

SEQ ID NO: 12379 - RNA, 21 nt, Artificial Sequence
  Synthetic
cagauacgcugggcgucggcc

SEQ ID NO: 12380 - RNA, 22 nt, Artificial Sequence
  Synthetic
gcagauacgcugggcgucggcc

SEQ ID NO: 12381 - RNA, 23 nt, Artificial Sequence
  Synthetic
cgcagauacgcugggcgucggcc

SEQ ID NO: 12382 - RNA, 24 nt, Artificial Sequence
  Synthetic
ccgcagauacgcugggcgucggcc

SEQ ID NO: 12383 - RNA, 18 nt, Artificial Sequence
  Synthetic
ggggugcccgcgagggcc

SEQ ID NO: 12384 - RNA, 19 nt, Artificial Sequence
  Synthetic
gggggugcccgcgagggcc

SEQ ID NO: 12385 - RNA, 20 nt, Artificial Sequence
  Synthetic
cgggggugcccgcgagggcc

SEQ ID NO: 12386 - RNA, 21 nt, Artificial Sequence
  Synthetic
gcgggggugcccgcgagggcc

SEQ ID NO: 12387 - RNA, 22 nt, Artificial Sequence
  Synthetic
ggcgggggugcccgcgagggcc

SEQ ID NO: 12388 - RNA, 23 nt, Artificial Sequence
  Synthetic
aggcgggggugcccgcgagggcc

SEQ ID NO: 12389 - RNA, 24 nt, Artificial Sequence
  Synthetic
gaggcgggggugcccgcgagggcc

SEQ ID NO: 12390 - RNA, 18 nt, Artificial Sequence
  Synthetic
agccuggucgccggggcc

SEQ ID NO: 12391 - RNA, 19 nt, Artificial Sequence
  Synthetic
gagccuggucgccggggcc

SEQ ID NO: 12392 - RNA, 20 nt, Artificial Sequence
  Synthetic
ugagccuggucgccggggcc

SEQ ID NO: 12393 - RNA, 21 nt, Artificial Sequence
  Synthetic
gugagccuggucgccggggcc

SEQ ID NO: 12394 - RNA, 22 nt, Artificial Sequence
  Synthetic
cgugagccuggucgccggggcc

SEQ ID NO: 12395 - RNA, 23 nt, Artificial Sequence
  Synthetic
ccgugagccuggucgccggggcc

SEQ ID NO: 12396 - RNA, 24 nt, Artificial Sequence
  Synthetic
gccgugagccuggucgccggggcc

SEQ ID NO: 12397 - RNA, 18 nt, Artificial Sequence
  Synthetic
ccgggcgaggaccuggcc

SEQ ID NO: 12398 - RNA, 19 nt, Artificial Sequence
  Synthetic
gccgggcgaggaccuggcc

SEQ ID NO: 12399 - RNA, 20 nt, Artificial Sequence
  Synthetic
ugccgggcgaggaccuggcc

SEQ ID NO: 12400 - RNA, 21 nt, Artificial Sequence
  Synthetic
cugccgggcgaggaccuggcc

SEQ ID NO: 12401 - RNA, 22 nt, Artificial Sequence
  Synthetic
gcugccgggcgaggaccuggcc

SEQ ID NO: 12402 - RNA, 23 nt, Artificial Sequence
  Synthetic
cgcugccgggcgaggaccuggcc

SEQ ID NO: 12403 - RNA, 24 nt, Artificial Sequence
  Synthetic
ccgcugccgggcgaggaccuggcc

SEQ ID NO: 12404 - RNA, 18 nt, Artificial Sequence
  Synthetic
cagcggggagccguggcc

SEQ ID NO: 12405 - RNA, 19 nt, Artificial Sequence
  Synthetic
ucagcggggagccguggcc

SEQ ID NO: 12406 - RNA, 20 nt, Artificial Sequence
  Synthetic
gucagcggggagccguggcc

SEQ ID NO: 12407 - RNA, 21 nt, Artificial Sequence
  Synthetic
cgucagcggggagccguggcc

SEQ ID NO: 12408 - RNA, 22 nt, Artificial Sequence
  Synthetic
acgucagcggggagccguggcc

SEQ ID NO: 12409 - RNA, 23 nt, Artificial Sequence
  Synthetic
uacgucagcggggagccguggcc

SEQ ID NO: 12410 - RNA, 24 nt, Artificial Sequence
  Synthetic
guacgucagcggggagccguggcc

SEQ ID NO: 12411 - RNA, 18 nt, Artificial Sequence
  Synthetic
guggcggccgccguggcc

SEQ ID NO: 12412 - RNA, 19 nt, Artificial Sequence
  Synthetic
cguggcggccgccguggcc

SEQ ID NO: 12413 - RNA, 20 nt, Artificial Sequence
  Synthetic
acguggcggccgccguggcc

SEQ ID NO: 12414 - RNA, 21 nt, Artificial Sequence
  Synthetic
cacguggcggccgccguggcc

SEQ ID NO: 12415 - RNA, 22 nt, Artificial Sequence
  Synthetic
gcacguggcggccgccguggcc

SEQ ID NO: 12416 - RNA, 23 nt, Artificial Sequence
  Synthetic
cgcacguggcggccgccguggcc

SEQ ID NO: 12417 - RNA, 24 nt, Artificial Sequence
  Synthetic
gcgcacguggcggccgccguggcc

SEQ ID NO: 12418 - RNA, 18 nt, Artificial Sequence
  Synthetic
gaggcgggccgcguggcc

SEQ ID NO: 12419 - RNA, 19 nt, Artificial Sequence
  Synthetic
ggaggcgggccgcguggcc

SEQ ID NO: 12420 - RNA, 20 nt, Artificial Sequence
  Synthetic
cggaggcgggccgcguggcc

SEQ ID NO: 12421 - RNA, 21 nt, Artificial Sequence
  Synthetic
gcggaggcgggccgcguggcc

SEQ ID NO: 12422 - RNA, 22 nt, Artificial Sequence
  Synthetic
cgcggaggcgggccgcguggcc

SEQ ID NO: 12423 - RNA, 23 nt, Artificial Sequence
  Synthetic
gcgcggaggcgggccgcguggcc

SEQ ID NO: 12424 - RNA, 24 nt, Artificial Sequence
  Synthetic
cgcgcggaggcgggccgcguggcc

SEQ ID NO: 12425 - RNA, 18 nt, Artificial Sequence
  Synthetic
agugccuggccgccugcc

SEQ ID NO: 12426 - RNA, 19 nt, Artificial Sequence
  Synthetic
gagugccuggccgccugcc

SEQ ID NO: 12427 - RNA, 20 nt, Artificial Sequence
  Synthetic
ggagugccuggccgccugcc

SEQ ID NO: 12428 - RNA, 21 nt, Artificial Sequence
  Synthetic
uggagugccuggccgccugcc

SEQ ID NO: 12429 - RNA, 22 nt, Artificial Sequence
  Synthetic
guggagugccuggccgccugcc

SEQ ID NO: 12430 - RNA, 23 nt, Artificial Sequence
  Synthetic
cguggagugccuggccgccugcc

SEQ ID NO: 12431 - RNA, 24 nt, Artificial Sequence
  Synthetic
ccguggagugccuggccgccugcc

SEQ ID NO: 12432 - RNA, 18 nt, Artificial Sequence
  Synthetic
ccugggcccggcgcugcc

SEQ ID NO: 12433 - RNA, 19 nt, Artificial Sequence
  Synthetic
cccugggcccggcgcugcc

SEQ ID NO: 12434 - RNA, 20 nt, Artificial Sequence
  Synthetic
gcccugggcccggcgcugcc

SEQ ID NO: 12435 - RNA, 21 nt, Artificial Sequence
  Synthetic
ggcccugggcccggcgcugcc

SEQ ID NO: 12436 - RNA, 22 nt, Artificial Sequence
  Synthetic
gggcccugggcccggcgcugcc

SEQ ID NO: 12437 - RNA, 23 nt, Artificial Sequence
  Synthetic
ggggcccugggcccggcgcugcc

SEQ ID NO: 12438 - RNA, 24 nt, Artificial Sequence
  Synthetic
cggggcccugggcccggcgcugcc

SEQ ID NO: 12439 - RNA, 18 nt, Artificial Sequence
  Synthetic
cgccgcugcgccucugcc

SEQ ID NO: 12440 - RNA, 19 nt, Artificial Sequence
  Synthetic
ccgccgcugcgccucugcc

SEQ ID NO: 12441 - RNA, 20 nt, Artificial Sequence
  Synthetic
gccgccgcugcgccucugcc

SEQ ID NO: 12442 - RNA, 21 nt, Artificial Sequence
  Synthetic
cgccgccgcugcgccucugcc

SEQ ID NO: 12443 - RNA, 22 nt, Artificial Sequence
  Synthetic
gcgccgccgcugcgccucugcc

SEQ ID NO: 12444 - RNA, 23 nt, Artificial Sequence
  Synthetic
cgcgccgccgcugcgccucugcc

SEQ ID NO: 12445 - RNA, 24 nt, Artificial Sequence
  Synthetic
acgcgccgccgcugcgccucugcc

SEQ ID NO: 12446 - RNA, 18 nt, Artificial Sequence
  Synthetic
ccgccugccgcgggaucc

SEQ ID NO: 12447 - RNA, 19 nt, Artificial Sequence
  Synthetic
gccgccugccgcgggaucc

SEQ ID NO: 12448 - RNA, 20 nt, Artificial Sequence
  Synthetic
ggccgccugccgcgggaucc

SEQ ID NO: 12449 - RNA, 21 nt, Artificial Sequence
  Synthetic
uggccgccugccgcgggaucc

SEQ ID NO: 12450 - RNA, 22 nt, Artificial Sequence
  Synthetic
cuggccgccugccgcgggaucc

SEQ ID NO: 12451 - RNA, 23 nt, Artificial Sequence
  Synthetic
ccuggccgccugccgcgggaucc

SEQ ID NO: 12452 - RNA, 24 nt, Artificial Sequence
  Synthetic
gccuggccgccugccgcgggaucc

SEQ ID NO: 12453 - RNA, 18 nt, Artificial Sequence
  Synthetic
agacgacguccgcggucc

SEQ ID NO: 12454 - RNA, 19 nt, Artificial Sequence
  Synthetic
gagacgacguccgcggucc

SEQ ID NO: 12455 - RNA, 20 nt, Artificial Sequence
  Synthetic
ggagacgacguccgcggucc

SEQ ID NO: 12456 - RNA, 21 nt, Artificial Sequence
  Synthetic
cggagacgacguccgcggucc

SEQ ID NO: 12457 - RNA, 22 nt, Artificial Sequence
  Synthetic
ccggagacgacguccgcggucc

SEQ ID NO: 12458 - RNA, 23 nt, Artificial Sequence
  Synthetic
accggagacgacguccgcggucc

SEQ ID NO: 12459 - RNA, 24 nt, Artificial Sequence
  Synthetic
gaccggagacgacguccgcggucc

SEQ ID NO: 12460 - RNA, 18 nt, Artificial Sequence
  Synthetic
acgcgggccgcugggucc

SEQ ID NO: 12461 - RNA, 19 nt, Artificial Sequence
  Synthetic
gacgcgggccgcugggucc

SEQ ID NO: 12462 - RNA, 20 nt, Artificial Sequence
  Synthetic
cgacgcgggccgcugggucc

SEQ ID NO: 12463 - RNA, 21 nt, Artificial Sequence
  Synthetic
gcgacgcgggccgcugggucc

SEQ ID NO: 12464 - RNA, 22 nt, Artificial Sequence
  Synthetic
cgcgacgcgggccgcugggucc

SEQ ID NO: 12465 - RNA, 23 nt, Artificial Sequence
  Synthetic
ccgcgacgcgggccgcugggucc

SEQ ID NO: 12466 - RNA, 24 nt, Artificial Sequence
  Synthetic
accgcgacgcgggccgcugggucc

SEQ ID NO: 12467 - RNA, 18 nt, Artificial Sequence
  Synthetic
ccggcgccguggaguucc

SEQ ID NO: 12468 - RNA, 19 nt, Artificial Sequence
  Synthetic
gccggcgccguggaguucc

SEQ ID NO: 12469 - RNA, 20 nt, Artificial Sequence
  Synthetic
cgccggcgccguggaguucc

SEQ ID NO: 12470 - RNA, 21 nt, Artificial Sequence
  Synthetic
ucgccggcgccguggaguucc

SEQ ID NO: 12471 - RNA, 22 nt, Artificial Sequence
  Synthetic
uucgccggcgccguggaguucc

SEQ ID NO: 12472 - RNA, 23 nt, Artificial Sequence
  Synthetic
cuucgccggcgccguggaguucc

SEQ ID NO: 12473 - RNA, 24 nt, Artificial Sequence
  Synthetic
ccuucgccggcgccguggaguucc

SEQ ID NO: 12474 - RNA, 18 nt, Artificial Sequence
  Synthetic
cgcgacggguacgucagc

SEQ ID NO: 12475 - RNA, 19 nt, Artificial Sequence
  Synthetic
ccgcgacggguacgucagc

SEQ ID NO: 12476 - RNA, 20 nt, Artificial Sequence
  Synthetic
accgcgacggguacgucagc

SEQ ID NO: 12477 - RNA, 21 nt, Artificial Sequence
  Synthetic
uaccgcgacggguacgucagc

SEQ ID NO: 12478 - RNA, 22 nt, Artificial Sequence
  Synthetic
cuaccgcgacggguacgucagc

SEQ ID NO: 12479 - RNA, 23 nt, Artificial Sequence
  Synthetic
gcuaccgcgacggguacgucagc

SEQ ID NO: 12480 - RNA, 24 nt, Artificial Sequence
  Synthetic
cgcuaccgcgacggguacgucagc

SEQ ID NO: 12481 - RNA, 18 nt, Artificial Sequence
  Synthetic
uggacauggacgcggagc

SEQ ID NO: 12482 - RNA, 19 nt, Artificial Sequence
  Synthetic
guggacauggacgcggagc

SEQ ID NO: 12483 - RNA, 20 nt, Artificial Sequence
  Synthetic
cguggacauggacgcggagc

SEQ ID NO: 12484 - RNA, 21 nt, Artificial Sequence
  Synthetic
ccguggacauggacgcggagc

SEQ ID NO: 12485 - RNA, 22 nt, Artificial Sequence
  Synthetic
cccguggacauggacgcggagc

SEQ ID NO: 12486 - RNA, 23 nt, Artificial Sequence
  Synthetic
gcccguggacauggacgcggagc

SEQ ID NO: 12487 - RNA, 24 nt, Artificial Sequence
  Synthetic
agcccguggacauggacgcggagc

SEQ ID NO: 12488 - RNA, 18 nt, Artificial Sequence
  Synthetic
gacggcgacgacgcccgc

SEQ ID NO: 12489 - RNA, 19 nt, Artificial Sequence
  Synthetic
cgacggcgacgacgcccgc

SEQ ID NO: 12490 - RNA, 20 nt, Artificial Sequence
  Synthetic
acgacggcgacgacgcccgc

SEQ ID NO: 12491 - RNA, 21 nt, Artificial Sequence
  Synthetic
cacgacggcgacgacgcccgc

SEQ ID NO: 12492 - RNA, 22 nt, Artificial Sequence
  Synthetic
ccacgacggcgacgacgcccgc

SEQ ID NO: 12493 - RNA, 23 nt, Artificial Sequence
  Synthetic
gccacgacggcgacgacgcccgc

SEQ ID NO: 12494 - RNA, 24 nt, Artificial Sequence
  Synthetic
cgccacgacggcgacgacgcccgc

SEQ ID NO: 12495 - RNA, 18 nt, Artificial Sequence
  Synthetic
ggaggcgggggugcccgc

SEQ ID NO: 12496 - RNA, 19 nt, Artificial Sequence
  Synthetic
aggaggcgggggugcccgc

SEQ ID NO: 12497 - RNA, 20 nt, Artificial Sequence
  Synthetic
gaggaggcgggggugcccgc

SEQ ID NO: 12498 - RNA, 21 nt, Artificial Sequence
  Synthetic
cgaggaggcgggggugcccgc

SEQ ID NO: 12499 - RNA, 22 nt, Artificial Sequence
  Synthetic
acgaggaggcgggggugcccgc

SEQ ID NO: 12500 - RNA, 23 nt, Artificial Sequence
  Synthetic
gacgaggaggcgggggugcccgc

SEQ ID NO: 12501 - RNA, 24 nt, Artificial Sequence
  Synthetic
cgacgaggaggcgggggugcccgc

SEQ ID NO: 12502 - RNA, 18 nt, Artificial Sequence
  Synthetic
cgcggccgccccucccgc

SEQ ID NO: 12503 - RNA, 19 nt, Artificial Sequence
  Synthetic
ccgcggccgccccucccgc

SEQ ID NO: 12504 - RNA, 20 nt, Artificial Sequence
  Synthetic
cccgcggccgccccucccgc

SEQ ID NO: 12505 - RNA, 21 nt, Artificial Sequence
  Synthetic
ccccgcggccgccccucccgc

SEQ ID NO: 12506 - RNA, 22 nt, Artificial Sequence
  Synthetic
gccccgcggccgccccucccgc

SEQ ID NO: 12507 - RNA, 23 nt, Artificial Sequence
  Synthetic
cgccccgcggccgccccucccgc

SEQ ID NO: 12508 - RNA, 24 nt, Artificial Sequence
  Synthetic
ccgccccgcggccgccccucccgc

SEQ ID NO: 12509 - RNA, 18 nt, Artificial Sequence
  Synthetic
gcuggcgccgccagccgc

SEQ ID NO: 12510 - RNA, 19 nt, Artificial Sequence
  Synthetic
ggcuggcgccgccagccgc

SEQ ID NO: 12511 - RNA, 20 nt, Artificial Sequence
  Synthetic
cggcuggcgccgccagccgc

SEQ ID NO: 12512 - RNA, 21 nt, Artificial Sequence
  Synthetic
gcggcuggcgccgccagccgc

SEQ ID NO: 12513 - RNA, 22 nt, Artificial Sequence
  Synthetic
ggcggcuggcgccgccagccgc

SEQ ID NO: 12514 - RNA, 23 nt, Artificial Sequence
  Synthetic
gggcggcuggcgccgccagccgc

SEQ ID NO: 12515 - RNA, 24 nt, Artificial Sequence
  Synthetic
agggcggcuggcgccgccagccgc

SEQ ID NO: 12516 - RNA, 18 nt, Artificial Sequence
  Synthetic
cccccgaagaagagccgc

SEQ ID NO: 12517 - RNA, 19 nt, Artificial Sequence
  Synthetic
ccccccgaagaagagccgc

SEQ ID NO: 12518 - RNA, 20 nt, Artificial Sequence
  Synthetic
gccccccgaagaagagccgc

SEQ ID NO: 12519 - RNA, 21 nt, Artificial Sequence
  Synthetic
cgccccccgaagaagagccgc

SEQ ID NO: 12520 - RNA, 22 nt, Artificial Sequence
  Synthetic
gcgccccccgaagaagagccgc

SEQ ID NO: 12521 - RNA, 23 nt, Artificial Sequence
  Synthetic
cgcgccccccgaagaagagccgc

SEQ ID NO: 12522 - RNA, 24 nt, Artificial Sequence
  Synthetic
ccgcgccccccgaagaagagccgc

SEQ ID NO: 12523 - RNA, 18 nt, Artificial Sequence
  Synthetic
cgcccgccuccgcgccgc

SEQ ID NO: 12524 - RNA, 19 nt, Artificial Sequence
  Synthetic
gcgcccgccuccgcgccgc

SEQ ID NO: 12525 - RNA, 20 nt, Artificial Sequence
  Synthetic
cgcgcccgccuccgcgccgc

SEQ ID NO: 12526 - RNA, 21 nt, Artificial Sequence
  Synthetic
ccgcgcccgccuccgcgccgc

SEQ ID NO: 12527 - RNA, 22 nt, Artificial Sequence
  Synthetic
gccgcgcccgccuccgcgccgc

SEQ ID NO: 12528 - RNA, 23 nt, Artificial Sequence
  Synthetic
cgccgcgcccgccuccgcgccgc

SEQ ID NO: 12529 - RNA, 24 nt, Artificial Sequence
  Synthetic
ucgccgcgcccgccuccgcgccgc

SEQ ID NO: 12530 - RNA, 18 nt, Artificial Sequence
  Synthetic
cgggcccgccacggccgc

SEQ ID NO: 12531 - RNA, 19 nt, Artificial Sequence
  Synthetic
gcgggcccgccacggccgc

SEQ ID NO: 12532 - RNA, 20 nt, Artificial Sequence
  Synthetic
ugcgggcccgccacggccgc

SEQ ID NO: 12533 - RNA, 21 nt, Artificial Sequence
  Synthetic
cugcgggcccgccacggccgc

SEQ ID NO: 12534 - RNA, 22 nt, Artificial Sequence
  Synthetic
ucugcgggcccgccacggccgc

SEQ ID NO: 12535 - RNA, 23 nt, Artificial Sequence
  Synthetic
cucugcgggcccgccacggccgc

SEQ ID NO: 12536 - RNA, 24 nt, Artificial Sequence
  Synthetic
gcucugcgggcccgccacggccgc

SEQ ID NO: 12537 - RNA, 18 nt, Artificial Sequence
  Synthetic
gcggcgaccgcgggccgc

SEQ ID NO: 12538 - RNA, 19 nt, Artificial Sequence
  Synthetic
cgcggcgaccgcgggccgc

SEQ ID NO: 12539 - RNA, 20 nt, Artificial Sequence
  Synthetic
ccgcggcgaccgcgggccgc

SEQ ID NO: 12540 - RNA, 21 nt, Artificial Sequence
  Synthetic
cccgcggcgaccgcgggccgc

SEQ ID NO: 12541 - RNA, 22 nt, Artificial Sequence
  Synthetic
ccccgcggcgaccgcgggccgc

SEQ ID NO: 12542 - RNA, 23 nt, Artificial Sequence
  Synthetic
cccccgcggcgaccgcgggccgc

SEQ ID NO: 12543 - RNA, 24 nt, Artificial Sequence
  Synthetic
acccccgcggcgaccgcgggccgc

SEQ ID NO: 12544 - RNA, 18 nt, Artificial Sequence
  Synthetic
gcgucggccgcgggccgc

SEQ ID NO: 12545 - RNA, 19 nt, Artificial Sequence
  Synthetic
ggcgucggccgcgggccgc

SEQ ID NO: 12546 - RNA, 20 nt, Artificial Sequence
  Synthetic
gggcgucggccgcgggccgc

SEQ ID NO: 12547 - RNA, 21 nt, Artificial Sequence
  Synthetic
ugggcgucggccgcgggccgc

SEQ ID NO: 12548 - RNA, 22 nt, Artificial Sequence
  Synthetic
cugggcgucggccgcgggccgc

SEQ ID NO: 12549 - RNA, 23 nt, Artificial Sequence
  Synthetic
gcugggcgucggccgcgggccgc

SEQ ID NO: 12550 - RNA, 24 nt, Artificial Sequence
  Synthetic
cgcugggcgucggccgcgggccgc

SEQ ID NO: 12551 - RNA, 18 nt, Artificial Sequence
  Synthetic
cgggaggcgcgcaagcgc

SEQ ID NO: 12552 - RNA, 19 nt, Artificial Sequence
  Synthetic
gcgggaggcgcgcaagcgc

SEQ ID NO: 12553 - RNA, 20 nt, Artificial Sequence
  Synthetic
cgcgggaggcgcgcaagcgc

SEQ ID NO: 12554 - RNA, 21 nt, Artificial Sequence
  Synthetic
ccgcgggaggcgcgcaagcgc

SEQ ID NO: 12555 - RNA, 22 nt, Artificial Sequence
  Synthetic
gccgcgggaggcgcgcaagcgc

SEQ ID NO: 12556 - RNA, 23 nt, Artificial Sequence
  Synthetic
cgccgcgggaggcgcgcaagcgc

SEQ ID NO: 12557 - RNA, 24 nt, Artificial Sequence
  Synthetic
gcgccgcgggaggcgcgcaagcgc

SEQ ID NO: 12558 - RNA, 18 nt, Artificial Sequence
  Synthetic
cccgccgcgcccccgcgc

SEQ ID NO: 12559 - RNA, 19 nt, Artificial Sequence
  Synthetic
gcccgccgcgcccccgcgc

SEQ ID NO: 12560 - RNA, 20 nt, Artificial Sequence
  Synthetic
ggcccgccgcgcccccgcgc

SEQ ID NO: 12561 - RNA, 21 nt, Artificial Sequence
  Synthetic
cggcccgccgcgcccccgcgc

SEQ ID NO: 12562 - RNA, 22 nt, Artificial Sequence
  Synthetic
ccggcccgccgcgcccccgcgc

SEQ ID NO: 12563 - RNA, 23 nt, Artificial Sequence
  Synthetic
cccggcccgccgcgcccccgcgc

SEQ ID NO: 12564 - RNA, 24 nt, Artificial Sequence
  Synthetic
gcccggcccgccgcgcccccgcgc

SEQ ID NO: 12565 - RNA, 18 nt, Artificial Sequence
  Synthetic
gucggccgcgggccgcgc

SEQ ID NO: 12566 - RNA, 19 nt, Artificial Sequence
  Synthetic
cgucggccgcgggccgcgc

SEQ ID NO: 12567 - RNA, 20 nt, Artificial Sequence
  Synthetic
gcgucggccgcgggccgcgc

SEQ ID NO: 12568 - RNA, 21 nt, Artificial Sequence
  Synthetic
ggcgucggccgcgggccgcgc

SEQ ID NO: 12569 - RNA, 22 nt, Artificial Sequence
  Synthetic
gggcgucggccgcgggccgcgc

SEQ ID NO: 12570 - RNA, 23 nt, Artificial Sequence
  Synthetic
ugggcgucggccgcgggccgcgc

SEQ ID NO: 12571 - RNA, 24 nt, Artificial Sequence
  Synthetic
cugggcgucggccgcgggccgcgc

SEQ ID NO: 12572 - RNA, 18 nt, Artificial Sequence
  Synthetic
ccuggccgcgggccgcgc

SEQ ID NO: 12573 - RNA, 19 nt, Artificial Sequence
  Synthetic
accuggccgcgggccgcgc

SEQ ID NO: 12574 - RNA, 20 nt, Artificial Sequence
  Synthetic
gaccuggccgcgggccgcgc

SEQ ID NO: 12575 - RNA, 21 nt, Artificial Sequence
  Synthetic
ggaccuggccgcgggccgcgc

SEQ ID NO: 12576 - RNA, 22 nt, Artificial Sequence
  Synthetic
aggaccuggccgcgggccgcgc

SEQ ID NO: 12577 - RNA, 23 nt, Artificial Sequence
  Synthetic
gaggaccuggccgcgggccgcgc

SEQ ID NO: 12578 - RNA, 24 nt, Artificial Sequence
  Synthetic
cgaggaccuggccgcgggccgcgc

SEQ ID NO: 12579 - RNA, 18 nt, Artificial Sequence
  Synthetic
caccgcgccugcgcgcgc

SEQ ID NO: 12580 - RNA, 19 nt, Artificial Sequence
  Synthetic
gcaccgcgccugcgcgcgc

SEQ ID NO: 12581 - RNA, 20 nt, Artificial Sequence
  Synthetic
cgcaccgcgccugcgcgcgc

SEQ ID NO: 12582 - RNA, 21 nt, Artificial Sequence
  Synthetic
ucgcaccgcgccugcgcgcgc

SEQ ID NO: 12583 - RNA, 22 nt, Artificial Sequence
  Synthetic
cucgcaccgcgccugcgcgcgc

SEQ ID NO: 12584 - RNA, 23 nt, Artificial Sequence
  Synthetic
acucgcaccgcgccugcgcgcgc

SEQ ID NO: 12585 - RNA, 24 nt, Artificial Sequence
  Synthetic
cacucgcaccgcgccugcgcgcgc

SEQ ID NO: 12586 - RNA, 18 nt, Artificial Sequence
  Synthetic
ccgggggucuucgcgcgc

SEQ ID NO: 12587 - RNA, 19 nt, Artificial Sequence
  Synthetic
gccgggggucuucgcgcgc

SEQ ID NO: 12588 - RNA, 20 nt, Artificial Sequence
  Synthetic
ggccgggggucuucgcgcgc

SEQ ID NO: 12589 - RNA, 21 nt, Artificial Sequence
  Synthetic
gggccgggggucuucgcgcgc

SEQ ID NO: 12590 - RNA, 22 nt, Artificial Sequence
  Synthetic
cgggccgggggucuucgcgcgc

SEQ ID NO: 12591 - RNA, 23 nt, Artificial Sequence
  Synthetic
ucgggccgggggucuucgcgcgc

SEQ ID NO: 12592 - RNA, 24 nt, Artificial Sequence
  Synthetic
uucgggccgggggucuucgcgcgc

SEQ ID NO: 12593 - RNA, 18 nt, Artificial Sequence
  Synthetic
gcgccccugcuggcgcgc

SEQ ID NO: 12594 - RNA, 19 nt, Artificial Sequence
  Synthetic
cgcgccccugcuggcgcgc

SEQ ID NO: 12595 - RNA, 20 nt, Artificial Sequence
  Synthetic
acgcgccccugcuggcgcgc

SEQ ID NO: 12596 - RNA, 21 nt, Artificial Sequence
  Synthetic
uacgcgccccugcuggcgcgc

SEQ ID NO: 12597 - RNA, 22 nt, Artificial Sequence
  Synthetic
cuacgcgccccugcuggcgcgc

SEQ ID NO: 12598 - RNA, 23 nt, Artificial Sequence
  Synthetic
ccuacgcgccccugcuggcgcgc

SEQ ID NO: 12599 - RNA, 24 nt, Artificial Sequence
  Synthetic
gccuacgcgccccugcuggcgcgc

SEQ ID NO: 12600 - RNA, 18 nt, Artificial Sequence
  Synthetic
gguggcggcggccggcgc

SEQ ID NO: 12601 - RNA, 19 nt, Artificial Sequence
  Synthetic
ugguggcggcggccggcgc

SEQ ID NO: 12602 - RNA, 20 nt, Artificial Sequence
  Synthetic
gugguggcggcggccggcgc

SEQ ID NO: 12603 - RNA, 21 nt, Artificial Sequence
  Synthetic
ggugguggcggcggccggcgc

SEQ ID NO: 12604 - RNA, 22 nt, Artificial Sequence
  Synthetic
cggugguggcggcggccggcgc

SEQ ID NO: 12605 - RNA, 23 nt, Artificial Sequence
  Synthetic
gcggugguggcggcggccggcgc

SEQ ID NO: 12606 - RNA, 24 nt, Artificial Sequence
  Synthetic
ggcggugguggcggcggccggcgc

SEQ ID NO: 12607 - RNA, 18 nt, Artificial Sequence
  Synthetic
ccggccucuggggggcgc

SEQ ID NO: 12608 - RNA, 19 nt, Artificial Sequence
  Synthetic
cccggccucuggggggcgc

SEQ ID NO: 12609 - RNA, 20 nt, Artificial Sequence
  Synthetic
ccccggccucuggggggcgc

SEQ ID NO: 12610 - RNA, 21 nt, Artificial Sequence
  Synthetic
gccccggccucuggggggcgc

SEQ ID NO: 12611 - RNA, 22 nt, Artificial Sequence
  Synthetic
cgccccggccucuggggggcgc

SEQ ID NO: 12612 - RNA, 23 nt, Artificial Sequence
  Synthetic
ccgccccggccucuggggggcgc

SEQ ID NO: 12613 - RNA, 24 nt, Artificial Sequence
  Synthetic
gccgccccggccucuggggggcgc

SEQ ID NO: 12614 - RNA, 18 nt, Artificial Sequence
  Synthetic
cucgccgcccuggggcgc

SEQ ID NO: 12615 - RNA, 19 nt, Artificial Sequence
  Synthetic
gcucgccgcccuggggcgc

SEQ ID NO: 12616 - RNA, 20 nt, Artificial Sequence
  Synthetic
ugcucgccgcccuggggcgc

SEQ ID NO: 12617 - RNA, 21 nt, Artificial Sequence
  Synthetic
gugcucgccgcccuggggcgc

SEQ ID NO: 12618 - RNA, 22 nt, Artificial Sequence
  Synthetic
ggugcucgccgcccuggggcgc

SEQ ID NO: 12619 - RNA, 23 nt, Artificial Sequence
  Synthetic
gggugcucgccgcccuggggcgc

SEQ ID NO: 12620 - RNA, 24 nt, Artificial Sequence
  Synthetic
ggggugcucgccgcccuggggcgc

SEQ ID NO: 12621 - RNA, 18 nt, Artificial Sequence
  Synthetic
cggcgcccgugugggcgc

SEQ ID NO: 12622 - RNA, 19 nt, Artificial Sequence
  Synthetic
ccggcgcccgugugggcgc

SEQ ID NO: 12623 - RNA, 20 nt, Artificial Sequence
  Synthetic
cccggcgcccgugugggcgc

SEQ ID NO: 12624 - RNA, 21 nt, Artificial Sequence
  Synthetic
ccccggcgcccgugugggcgc

SEQ ID NO: 12625 - RNA, 22 nt, Artificial Sequence
  Synthetic
gccccggcgcccgugugggcgc

SEQ ID NO: 12626 - RNA, 23 nt, Artificial Sequence
  Synthetic
cgccccggcgcccgugugggcgc

SEQ ID NO: 12627 - RNA, 24 nt, Artificial Sequence
  Synthetic
gcgccccggcgcccgugugggcgc

SEQ ID NO: 12628 - RNA, 18 nt, Artificial Sequence
  Synthetic
acgcgccccugcuggcgc

SEQ ID NO: 12629 - RNA, 19 nt, Artificial Sequence
  Synthetic
uacgcgccccugcuggcgc

SEQ ID NO: 12630 - RNA, 20 nt, Artificial Sequence
  Synthetic
cuacgcgccccugcuggcgc

SEQ ID NO: 12631 - RNA, 21 nt, Artificial Sequence
  Synthetic
ccuacgcgccccugcuggcgc

SEQ ID NO: 12632 - RNA, 22 nt, Artificial Sequence
  Synthetic
gccuacgcgccccugcuggcgc

SEQ ID NO: 12633 - RNA, 23 nt, Artificial Sequence
  Synthetic
cgccuacgcgccccugcuggcgc

SEQ ID NO: 12634 - RNA, 24 nt, Artificial Sequence
  Synthetic
gcgccuacgcgccccugcuggcgc

SEQ ID NO: 12635 - RNA, 18 nt, Artificial Sequence
  Synthetic
ggcccgucuacguggcgc

SEQ ID NO: 12636 - RNA, 19 nt, Artificial Sequence
  Synthetic
cggcccgucuacguggcgc

SEQ ID NO: 12637 - RNA, 20 nt, Artificial Sequence
  Synthetic
gcggcccgucuacguggcgc

SEQ ID NO: 12638 - RNA, 21 nt, Artificial Sequence
  Synthetic
ugcggcccgucuacguggcgc

SEQ ID NO: 12639 - RNA, 22 nt, Artificial Sequence
  Synthetic
cugcggcccgucuacguggcgc

SEQ ID NO: 12640 - RNA, 23 nt, Artificial Sequence
  Synthetic
gcugcggcccgucuacguggcgc

SEQ ID NO: 12641 - RNA, 24 nt, Artificial Sequence
  Synthetic
cgcugcggcccgucuacguggcgc

SEQ ID NO: 12642 - RNA, 18 nt, Artificial Sequence
  Synthetic
agaacccgcgcguggcgc

SEQ ID NO: 12643 - RNA, 19 nt, Artificial Sequence
  Synthetic
cagaacccgcgcguggcgc

SEQ ID NO: 12644 - RNA, 20 nt, Artificial Sequence
  Synthetic
ccagaacccgcgcguggcgc

SEQ ID NO: 12645 - RNA, 21 nt, Artificial Sequence
  Synthetic
uccagaacccgcgcguggcgc

SEQ ID NO: 12646 - RNA, 22 nt, Artificial Sequence
  Synthetic
cuccagaacccgcgcguggcgc

SEQ ID NO: 12647 - RNA, 23 nt, Artificial Sequence
  Synthetic
gcuccagaacccgcgcguggcgc

SEQ ID NO: 12648 - RNA, 24 nt, Artificial Sequence
  Synthetic
ggcuccagaacccgcgcguggcgc

SEQ ID NO: 12649 - RNA, 18 nt, Artificial Sequence
  Synthetic
gugcugaugcgccugcgc

SEQ ID NO: 12650 - RNA, 19 nt, Artificial Sequence
  Synthetic
ggugcugaugcgccugcgc

SEQ ID NO: 12651 - RNA, 20 nt, Artificial Sequence
  Synthetic
uggugcugaugcgccugcgc

SEQ ID NO: 12652 - RNA, 21 nt, Artificial Sequence
  Synthetic
cuggugcugaugcgccugcgc

SEQ ID NO: 12653 - RNA, 22 nt, Artificial Sequence
  Synthetic
gcuggugcugaugcgccugcgc

SEQ ID NO: 12654 - RNA, 23 nt, Artificial Sequence
  Synthetic
cgcuggugcugaugcgccugcgc

SEQ ID NO: 12655 - RNA, 24 nt, Artificial Sequence
  Synthetic
gcgcuggugcugaugcgccugcgc

SEQ ID NO: 12656 - RNA, 18 nt, Artificial Sequence
  Synthetic
gcggcgggaguucugcgc

SEQ ID NO: 12657 - RNA, 19 nt, Artificial Sequence
  Synthetic
cgcggcgggaguucugcgc

SEQ ID NO: 12658 - RNA, 20 nt, Artificial Sequence
  Synthetic
ccgcggcgggaguucugcgc

SEQ ID NO: 12659 - RNA, 21 nt, Artificial Sequence
  Synthetic
gccgcggcgggaguucugcgc

SEQ ID NO: 12660 - RNA, 22 nt, Artificial Sequence
  Synthetic
ggccgcggcgggaguucugcgc

SEQ ID NO: 12661 - RNA, 23 nt, Artificial Sequence
  Synthetic
gggccgcggcgggaguucugcgc

SEQ ID NO: 12662 - RNA, 24 nt, Artificial Sequence
  Synthetic
cgggccgcggcgggaguucugcgc

SEQ ID NO: 12663 - RNA, 18 nt, Artificial Sequence
  Synthetic
cgccgugagccuggucgc

SEQ ID NO: 12664 - RNA, 19 nt, Artificial Sequence
  Synthetic
gcgccgugagccuggucgc

SEQ ID NO: 12665 - RNA, 20 nt, Artificial Sequence
  Synthetic
cgcgccgugagccuggucgc

SEQ ID NO: 12666 - RNA, 21 nt, Artificial Sequence
  Synthetic
gcgcgccgugagccuggucgc

SEQ ID NO: 12667 - RNA, 22 nt, Artificial Sequence
  Synthetic
ugcgcgccgugagccuggucgc

SEQ ID NO: 12668 - RNA, 23 nt, Artificial Sequence
  Synthetic
gugcgcgccgugagccuggucgc

SEQ ID NO: 12669 - RNA, 24 nt, Artificial Sequence
  Synthetic
cgugcgcgccgugagccuggucgc

SEQ ID NO: 12670 - RNA, 18 nt, Artificial Sequence
  Synthetic
uggccacgccgccgaggc

SEQ ID NO: 12671 - RNA, 19 nt, Artificial Sequence
  Synthetic
cuggccacgccgccgaggc

SEQ ID NO: 12672 - RNA, 20 nt, Artificial Sequence
  Synthetic
gcuggccacgccgccgaggc

SEQ ID NO: 12673 - RNA, 21 nt, Artificial Sequence
  Synthetic
ggcuggccacgccgccgaggc

SEQ ID NO: 12674 - RNA, 22 nt, Artificial Sequence
  Synthetic
gggcuggccacgccgccgaggc

SEQ ID NO: 12675 - RNA, 23 nt, Artificial Sequence
  Synthetic
ggggcuggccacgccgccgaggc

SEQ ID NO: 12676 - RNA, 24 nt, Artificial Sequence
  Synthetic
cggggcuggccacgccgccgaggc

SEQ ID NO: 12677 - RNA, 18 nt, Artificial Sequence
  Synthetic
gcccgaggcggaggaggc

SEQ ID NO: 12678 - RNA, 19 nt, Artificial Sequence
  Synthetic
cgcccgaggcggaggaggc

SEQ ID NO: 12679 - RNA, 20 nt, Artificial Sequence
  Synthetic
gcgcccgaggcggaggaggc

SEQ ID NO: 12680 - RNA, 21 nt, Artificial Sequence
  Synthetic
ggcgcccgaggcggaggaggc

SEQ ID NO: 12681 - RNA, 22 nt, Artificial Sequence
  Synthetic
gggcgcccgaggcggaggaggc

SEQ ID NO: 12682 - RNA, 23 nt, Artificial Sequence
  Synthetic
ggggcgcccgaggcggaggaggc

SEQ ID NO: 12683 - RNA, 24 nt, Artificial Sequence
  Synthetic
gggggcgcccgaggcggaggaggc

SEQ ID NO: 12684 - RNA, 18 nt, Artificial Sequence
  Synthetic
caagagccccgccccggc

SEQ ID NO: 12685 - RNA, 19 nt, Artificial Sequence
  Synthetic
gcaagagccccgccccggc

SEQ ID NO: 12686 - RNA, 20 nt, Artificial Sequence
  Synthetic
cgcaagagccccgccccggc

SEQ ID NO: 12687 - RNA, 21 nt, Artificial Sequence
  Synthetic
gcgcaagagccccgccccggc

SEQ ID NO: 12688 - RNA, 22 nt, Artificial Sequence
  Synthetic
agcgcaagagccccgccccggc

SEQ ID NO: 12689 - RNA, 23 nt, Artificial Sequence
  Synthetic
aagcgcaagagccccgccccggc

SEQ ID NO: 12690 - RNA, 24 nt, Artificial Sequence
  Synthetic
caagcgcaagagccccgccccggc

SEQ ID NO: 12691 - RNA, 18 nt, Artificial Sequence
  Synthetic
ggccgagcccgccccggc

SEQ ID NO: 12692 - RNA, 19 nt, Artificial Sequence
  Synthetic
gggccgagcccgccccggc

SEQ ID NO: 12693 - RNA, 20 nt, Artificial Sequence
  Synthetic
agggccgagcccgccccggc

SEQ ID NO: 12694 - RNA, 21 nt, Artificial Sequence
  Synthetic
cagggccgagcccgccccggc

SEQ ID NO: 12695 - RNA, 22 nt, Artificial Sequence
  Synthetic
ccagggccgagcccgccccggc

SEQ ID NO: 12696 - RNA, 23 nt, Artificial Sequence
  Synthetic
cccagggccgagcccgccccggc

SEQ ID NO: 12697 - RNA, 24 nt, Artificial Sequence
  Synthetic
gcccagggccgagcccgccccggc

SEQ ID NO: 12698 - RNA, 18 nt, Artificial Sequence
  Synthetic
gcccgccuccgcgccggc

SEQ ID NO: 12699 - RNA, 19 nt, Artificial Sequence
  Synthetic
cgcccgccuccgcgccggc

SEQ ID NO: 12700 - RNA, 20 nt, Artificial Sequence
  Synthetic
gcgcccgccuccgcgccggc

SEQ ID NO: 12701 - RNA, 21 nt, Artificial Sequence
  Synthetic
cgcgcccgccuccgcgccggc

SEQ ID NO: 12702 - RNA, 22 nt, Artificial Sequence
  Synthetic
ccgcgcccgccuccgcgccggc

SEQ ID NO: 12703 - RNA, 23 nt, Artificial Sequence
  Synthetic
gccgcgcccgccuccgcgccggc

SEQ ID NO: 12704 - RNA, 24 nt, Artificial Sequence
  Synthetic
cgccgcgcccgccuccgcgccggc

SEQ ID NO: 12705 - RNA, 18 nt, Artificial Sequence
  Synthetic
cgugcgcuggccggcggc

SEQ ID NO: 12706 - RNA, 19 nt, Artificial Sequence
  Synthetic
ccgugcgcuggccggcggc

SEQ ID NO: 12707 - RNA, 20 nt, Artificial Sequence
  Synthetic
gccgugcgcuggccggcggc

SEQ ID NO: 12708 - RNA, 21 nt, Artificial Sequence
  Synthetic
cgccgugcgcuggccggcggc

SEQ ID NO: 12709 - RNA, 22 nt, Artificial Sequence
  Synthetic
gcgccgugcgcuggccggcggc

SEQ ID NO: 12710 - RNA, 23 nt, Artificial Sequence
  Synthetic
ugcgccgugcgcuggccggcggc

SEQ ID NO: 12711 - RNA, 24 nt, Artificial Sequence
  Synthetic
gugcgccgugcgcuggccggcggc

SEQ ID NO: 12712 - RNA, 18 nt, Artificial Sequence
  Synthetic
gccgcggcgggcggcggc

SEQ ID NO: 12713 - RNA, 19 nt, Artificial Sequence
  Synthetic
ggccgcggcgggcggcggc

SEQ ID NO: 12714 - RNA, 20 nt, Artificial Sequence
  Synthetic
uggccgcggcgggcggcggc

SEQ ID NO: 12715 - RNA, 21 nt, Artificial Sequence
  Synthetic
cuggccgcggcgggcggcggc

SEQ ID NO: 12716 - RNA, 22 nt, Artificial Sequence
  Synthetic
gcuggccgcggcgggcggcggc

SEQ ID NO: 12717 - RNA, 23 nt, Artificial Sequence
  Synthetic
ugcuggccgcggcgggcggcggc

SEQ ID NO: 12718 - RNA, 24 nt, Artificial Sequence
  Synthetic
gugcuggccgcggcgggcggcggc

SEQ ID NO: 12719 - RNA, 18 nt, Artificial Sequence
  Synthetic
gcgggcgggacccucggc

SEQ ID NO: 12720 - RNA, 19 nt, Artificial Sequence
  Synthetic
cgcgggcgggacccucggc

SEQ ID NO: 12721 - RNA, 20 nt, Artificial Sequence
  Synthetic
ccgcgggcgggacccucggc

SEQ ID NO: 12722 - RNA, 21 nt, Artificial Sequence
  Synthetic
gccgcgggcgggacccucggc

SEQ ID NO: 12723 - RNA, 22 nt, Artificial Sequence
  Synthetic
cgccgcgggcgggacccucggc

SEQ ID NO: 12724 - RNA, 23 nt, Artificial Sequence
  Synthetic
acgccgcgggcgggacccucggc

SEQ ID NO: 12725 - RNA, 24 nt, Artificial Sequence
  Synthetic
cacgccgcgggcgggacccucggc

SEQ ID NO: 12726 - RNA, 18 nt, Artificial Sequence
  Synthetic
gcggcgggccgcuucggc

SEQ ID NO: 12727 - RNA, 19 nt, Artificial Sequence
  Synthetic
ggcggcgggccgcuucggc

SEQ ID NO: 12728 - RNA, 20 nt, Artificial Sequence
  Synthetic
uggcggcgggccgcuucggc

SEQ ID NO: 12729 - RNA, 21 nt, Artificial Sequence
  Synthetic
auggcggcgggccgcuucggc

SEQ ID NO: 12730 - RNA, 22 nt, Artificial Sequence
  Synthetic
cauggcggcgggccgcuucggc

SEQ ID NO: 12731 - RNA, 23 nt, Artificial Sequence
  Synthetic
ccauggcggcgggccgcuucggc

SEQ ID NO: 12732 - RNA, 24 nt, Artificial Sequence
  Synthetic
gccauggcggcgggccgcuucggc

SEQ ID NO: 12733 - RNA, 18 nt, Artificial Sequence
  Synthetic
uacucgccgcugccgggc

SEQ ID NO: 12734 - RNA, 19 nt, Artificial Sequence
  Synthetic
cuacucgccgcugccgggc

SEQ ID NO: 12735 - RNA, 20 nt, Artificial Sequence
  Synthetic
ucuacucgccgcugccgggc

SEQ ID NO: 12736 - RNA, 21 nt, Artificial Sequence
  Synthetic
cucuacucgccgcugccgggc

SEQ ID NO: 12737 - RNA, 22 nt, Artificial Sequence
  Synthetic
ccucuacucgccgcugccgggc

SEQ ID NO: 12738 - RNA, 23 nt, Artificial Sequence
  Synthetic
uccucuacucgccgcugccgggc

SEQ ID NO: 12739 - RNA, 24 nt, Artificial Sequence
  Synthetic
auccucuacucgccgcugccgggc

SEQ ID NO: 12740 - RNA, 18 nt, Artificial Sequence
  Synthetic
cgggccgccgccucgggc

SEQ ID NO: 12741 - RNA, 19 nt, Artificial Sequence
  Synthetic
ccgggccgccgccucgggc

SEQ ID NO: 12742 - RNA, 20 nt, Artificial Sequence
  Synthetic
gccgggccgccgccucgggc

SEQ ID NO: 12743 - RNA, 21 nt, Artificial Sequence
  Synthetic
ggccgggccgccgccucgggc

SEQ ID NO: 12744 - RNA, 22 nt, Artificial Sequence
  Synthetic
cggccgggccgccgccucgggc

SEQ ID NO: 12745 - RNA, 23 nt, Artificial Sequence
  Synthetic
acggccgggccgccgccucgggc

SEQ ID NO: 12746 - RNA, 24 nt, Artificial Sequence
  Synthetic
gacggccgggccgccgccucgggc

SEQ ID NO: 12747 - RNA, 18 nt, Artificial Sequence
  Synthetic
ccggccgcguguucgggc

SEQ ID NO: 12748 - RNA, 19 nt, Artificial Sequence
  Synthetic
uccggccgcguguucgggc

SEQ ID NO: 12749 - RNA, 20 nt, Artificial Sequence
  Synthetic
cuccggccgcguguucgggc

SEQ ID NO: 12750 - RNA, 21 nt, Artificial Sequence
  Synthetic
ccuccggccgcguguucgggc

SEQ ID NO: 12751 - RNA, 22 nt, Artificial Sequence
  Synthetic
gccuccggccgcguguucgggc

SEQ ID NO: 12752 - RNA, 23 nt, Artificial Sequence
  Synthetic
ggccuccggccgcguguucgggc

SEQ ID NO: 12753 - RNA, 24 nt, Artificial Sequence
  Synthetic
uggccuccggccgcguguucgggc

SEQ ID NO: 12754 - RNA, 18 nt, Artificial Sequence
  Synthetic
cgcggcgcugaccggggc

SEQ ID NO: 12755 - RNA, 19 nt, Artificial Sequence
  Synthetic
acgcggcgcugaccggggc

SEQ ID NO: 12756 - RNA, 20 nt, Artificial Sequence
  Synthetic
aacgcggcgcugaccggggc

SEQ ID NO: 12757 - RNA, 21 nt, Artificial Sequence
  Synthetic
gaacgcggcgcugaccggggc

SEQ ID NO: 12758 - RNA, 22 nt, Artificial Sequence
  Synthetic
agaacgcggcgcugaccggggc

SEQ ID NO: 12759 - RNA, 23 nt, Artificial Sequence
  Synthetic
gagaacgcggcgcugaccggggc

SEQ ID NO: 12760 - RNA, 24 nt, Artificial Sequence
  Synthetic
cgagaacgcggcgcugaccggggc

SEQ ID NO: 12761 - RNA, 18 nt, Artificial Sequence
  Synthetic
gccugcgcgcgcuggggc

SEQ ID NO: 12762 - RNA, 19 nt, Artificial Sequence
  Synthetic
cgccugcgcgcgcuggggc

SEQ ID NO: 12763 - RNA, 20 nt, Artificial Sequence
  Synthetic
gcgccugcgcgcgcuggggc

SEQ ID NO: 12764 - RNA, 21 nt, Artificial Sequence
  Synthetic
cgcgccugcgcgcgcuggggc

SEQ ID NO: 12765 - RNA, 22 nt, Artificial Sequence
  Synthetic
ccgcgccugcgcgcgcuggggc

SEQ ID NO: 12766 - RNA, 23 nt, Artificial Sequence
  Synthetic
accgcgccugcgcgcgcuggggc

SEQ ID NO: 12767 - RNA, 24 nt, Artificial Sequence
  Synthetic
caccgcgccugcgcgcgcuggggc

SEQ ID NO: 12768 - RNA, 18 nt, Artificial Sequence
  Synthetic
ggccgugccggggcuggc

SEQ ID NO: 12769 - RNA, 19 nt, Artificial Sequence
  Synthetic
cggccgugccggggcuggc

SEQ ID NO: 12770 - RNA, 20 nt, Artificial Sequence
  Synthetic
gcggccgugccggggcuggc

SEQ ID NO: 12771 - RNA, 21 nt, Artificial Sequence
  Synthetic
ggcggccgugccggggcuggc

SEQ ID NO: 12772 - RNA, 22 nt, Artificial Sequence
  Synthetic
uggcggccgugccggggcuggc

SEQ ID NO: 12773 - RNA, 23 nt, Artificial Sequence
  Synthetic
cuggcggccgugccggggcuggc

SEQ ID NO: 12774 - RNA, 24 nt, Artificial Sequence
  Synthetic
ccuggcggccgugccggggcuggc

SEQ ID NO: 12775 - RNA, 18 nt, Artificial Sequence
  Synthetic
ucagcggggagccguggc

SEQ ID NO: 12776 - RNA, 19 nt, Artificial Sequence
  Synthetic
gucagcggggagccguggc

SEQ ID NO: 12777 - RNA, 20 nt, Artificial Sequence
  Synthetic
cgucagcggggagccguggc

SEQ ID NO: 12778 - RNA, 21 nt, Artificial Sequence
  Synthetic
acgucagcggggagccguggc

SEQ ID NO: 12779 - RNA, 22 nt, Artificial Sequence
  Synthetic
uacgucagcggggagccguggc

SEQ ID NO: 12780 - RNA, 23 nt, Artificial Sequence
  Synthetic
guacgucagcggggagccguggc

SEQ ID NO: 12781 - RNA, 24 nt, Artificial Sequence
  Synthetic
gguacgucagcggggagccguggc

SEQ ID NO: 12782 - RNA, 18 nt, Artificial Sequence
  Synthetic
caucuccggcagcguggc

SEQ ID NO: 12783 - RNA, 19 nt, Artificial Sequence
  Synthetic
ucaucuccggcagcguggc

SEQ ID NO: 12784 - RNA, 20 nt, Artificial Sequence
  Synthetic
uucaucuccggcagcguggc

SEQ ID NO: 12785 - RNA, 21 nt, Artificial Sequence
  Synthetic
cuucaucuccggcagcguggc

SEQ ID NO: 12786 - RNA, 22 nt, Artificial Sequence
  Synthetic
ccuucaucuccggcagcguggc

SEQ ID NO: 12787 - RNA, 23 nt, Artificial Sequence
  Synthetic
uccuucaucuccggcagcguggc

SEQ ID NO: 12788 - RNA, 24 nt, Artificial Sequence
  Synthetic
cuccuucaucuccggcagcguggc

SEQ ID NO: 12789 - RNA, 18 nt, Artificial Sequence
  Synthetic
uggugcugaugcgccugc

SEQ ID NO: 12790 - RNA, 19 nt, Artificial Sequence
  Synthetic
cuggugcugaugcgccugc

SEQ ID NO: 12791 - RNA, 20 nt, Artificial Sequence
  Synthetic
gcuggugcugaugcgccugc

SEQ ID NO: 12792 - RNA, 21 nt, Artificial Sequence
  Synthetic
cgcuggugcugaugcgccugc

SEQ ID NO: 12793 - RNA, 22 nt, Artificial Sequence
  Synthetic
gcgcuggugcugaugcgccugc

SEQ ID NO: 12794 - RNA, 23 nt, Artificial Sequence
  Synthetic
cgcgcuggugcugaugcgccugc

SEQ ID NO: 12795 - RNA, 24 nt, Artificial Sequence
  Synthetic
acgcgcuggugcugaugcgccugc

SEQ ID NO: 12796 - RNA, 18 nt, Artificial Sequence
  Synthetic
gcggcccggcggagcugc

SEQ ID NO: 12797 - RNA, 19 nt, Artificial Sequence
  Synthetic
ggcggcccggcggagcugc

SEQ ID NO: 12798 - RNA, 20 nt, Artificial Sequence
  Synthetic
cggcggcccggcggagcugc

SEQ ID NO: 12799 - RNA, 21 nt, Artificial Sequence
  Synthetic
gcggcggcccggcggagcugc

SEQ ID NO: 12800 - RNA, 22 nt, Artificial Sequence
  Synthetic
cgcggcggcccggcggagcugc

SEQ ID NO: 12801 - RNA, 23 nt, Artificial Sequence
  Synthetic
gcgcggcggcccggcggagcugc

SEQ ID NO: 12802 - RNA, 24 nt, Artificial Sequence
  Synthetic
ugcgcggcggcccggcggagcugc

SEQ ID NO: 12803 - RNA, 18 nt, Artificial Sequence
  Synthetic
ucugcgcgcgggcgcugc

SEQ ID NO: 12804 - RNA, 19 nt, Artificial Sequence
  Synthetic
uucugcgcgcgggcgcugc

SEQ ID NO: 12805 - RNA, 20 nt, Artificial Sequence
  Synthetic
guucugcgcgcgggcgcugc

SEQ ID NO: 12806 - RNA, 21 nt, Artificial Sequence
  Synthetic
aguucugcgcgcgggcgcugc

SEQ ID NO: 12807 - RNA, 22 nt, Artificial Sequence
  Synthetic
gaguucugcgcgcgggcgcugc

SEQ ID NO: 12808 - RNA, 23 nt, Artificial Sequence
  Synthetic
ggaguucugcgcgcgggcgcugc

SEQ ID NO: 12809 - RNA, 24 nt, Artificial Sequence
  Synthetic
gggaguucugcgcgcgggcgcugc

SEQ ID NO: 12810 - RNA, 18 nt, Artificial Sequence
  Synthetic
gccugcgcgccuggcugc

SEQ ID NO: 12811 - RNA, 19 nt, Artificial Sequence
  Synthetic
cgccugcgcgccuggcugc

SEQ ID NO: 12812 - RNA, 20 nt, Artificial Sequence
  Synthetic
ccgccugcgcgccuggcugc

SEQ ID NO: 12813 - RNA, 21 nt, Artificial Sequence
  Synthetic
cccgccugcgcgccuggcugc

SEQ ID NO: 12814 - RNA, 22 nt, Artificial Sequence
  Synthetic
ccccgccugcgcgccuggcugc

SEQ ID NO: 12815 - RNA, 23 nt, Artificial Sequence
  Synthetic
gccccgccugcgcgccuggcugc

SEQ ID NO: 12816 - RNA, 24 nt, Artificial Sequence
  Synthetic
cgccccgccugcgcgccuggcugc

SEQ ID NO: 12817 - RNA, 18 nt, Artificial Sequence
  Synthetic
ggcgcgccggacuucugc

SEQ ID NO: 12818 - RNA, 19 nt, Artificial Sequence
  Synthetic
cggcgcgccggacuucugc

SEQ ID NO: 12819 - RNA, 20 nt, Artificial Sequence
  Synthetic
ccggcgcgccggacuucugc

SEQ ID NO: 12820 - RNA, 21 nt, Artificial Sequence
  Synthetic
cccggcgcgccggacuucugc

SEQ ID NO: 12821 - RNA, 22 nt, Artificial Sequence
  Synthetic
gcccggcgcgccggacuucugc

SEQ ID NO: 12822 - RNA, 23 nt, Artificial Sequence
  Synthetic
cgcccggcgcgccggacuucugc

SEQ ID NO: 12823 - RNA, 24 nt, Artificial Sequence
  Synthetic
gcgcccggcgcgccggacuucugc

SEQ ID NO: 12824 - RNA, 18 nt, Artificial Sequence
  Synthetic
gcgaccuggcggccgugc

SEQ ID NO: 12825 - RNA, 19 nt, Artificial Sequence
  Synthetic
ggcgaccuggcggccgugc

SEQ ID NO: 12826 - RNA, 20 nt, Artificial Sequence
  Synthetic
cggcgaccuggcggccgugc

SEQ ID NO: 12827 - RNA, 21 nt, Artificial Sequence
  Synthetic
acggcgaccuggcggccgugc

SEQ ID NO: 12828 - RNA, 22 nt, Artificial Sequence
  Synthetic
gacggcgaccuggcggccgugc

SEQ ID NO: 12829 - RNA, 23 nt, Artificial Sequence
  Synthetic
cgacggcgaccuggcggccgugc

SEQ ID NO: 12830 - RNA, 24 nt, Artificial Sequence
  Synthetic
ucgacggcgaccuggcggccgugc

SEQ ID NO: 12831 - RNA, 18 nt, Artificial Sequence
  Synthetic
caggccugcuuccggauc

SEQ ID NO: 12832 - RNA, 19 nt, Artificial Sequence
  Synthetic
ccaggccugcuuccggauc

SEQ ID NO: 12833 - RNA, 20 nt, Artificial Sequence
  Synthetic
accaggccugcuuccggauc

SEQ ID NO: 12834 - RNA, 21 nt, Artificial Sequence
  Synthetic
gaccaggccugcuuccggauc

SEQ ID NO: 12835 - RNA, 22 nt, Artificial Sequence
  Synthetic
ggaccaggccugcuuccggauc

SEQ ID NO: 12836 - RNA, 23 nt, Artificial Sequence
  Synthetic
uggaccaggccugcuuccggauc

SEQ ID NO: 12837 - RNA, 24 nt, Artificial Sequence
  Synthetic
cuggaccaggccugcuuccggauc

SEQ ID NO: 12838 - RNA, 18 nt, Artificial Sequence
  Synthetic
gccgccugccgcgggauc

SEQ ID NO: 12839 - RNA, 19 nt, Artificial Sequence
  Synthetic
ggccgccugccgcgggauc

SEQ ID NO: 12840 - RNA, 20 nt, Artificial Sequence
  Synthetic
uggccgccugccgcgggauc

SEQ ID NO: 12841 - RNA, 21 nt, Artificial Sequence
  Synthetic
cuggccgccugccgcgggauc

SEQ ID NO: 12842 - RNA, 22 nt, Artificial Sequence
  Synthetic
ccuggccgccugccgcgggauc

SEQ ID NO: 12843 - RNA, 23 nt, Artificial Sequence
  Synthetic
gccuggccgccugccgcgggauc

SEQ ID NO: 12844 - RNA, 24 nt, Artificial Sequence
  Synthetic
ugccuggccgccugccgcgggauc

SEQ ID NO: 12845 - RNA, 18 nt, Artificial Sequence
  Synthetic
gacagccgccccggccuc

SEQ ID NO: 12846 - RNA, 19 nt, Artificial Sequence
  Synthetic
cgacagccgccccggccuc

SEQ ID NO: 12847 - RNA, 20 nt, Artificial Sequence
  Synthetic
gcgacagccgccccggccuc

SEQ ID NO: 12848 - RNA, 21 nt, Artificial Sequence
  Synthetic
ggcgacagccgccccggccuc

SEQ ID NO: 12849 - RNA, 22 nt, Artificial Sequence
  Synthetic
gggcgacagccgccccggccuc

SEQ ID NO: 12850 - RNA, 23 nt, Artificial Sequence
  Synthetic
ugggcgacagccgccccggccuc

SEQ ID NO: 12851 - RNA, 24 nt, Artificial Sequence
  Synthetic
cugggcgacagccgccccggccuc

SEQ ID NO: 12852 - RNA, 18 nt, Artificial Sequence
  Synthetic
cgggccguggccgagcuc

SEQ ID NO: 12853 - RNA, 19 nt, Artificial Sequence
  Synthetic
gcgggccguggccgagcuc

SEQ ID NO: 12854 - RNA, 20 nt, Artificial Sequence
  Synthetic
cgcgggccguggccgagcuc

SEQ ID NO: 12855 - RNA, 21 nt, Artificial Sequence
  Synthetic
ccgcgggccguggccgagcuc

SEQ ID NO: 12856 - RNA, 22 nt, Artificial Sequence
  Synthetic
cccgcgggccguggccgagcuc

SEQ ID NO: 12857 - RNA, 23 nt, Artificial Sequence
  Synthetic
ccccgcgggccguggccgagcuc

SEQ ID NO: 12858 - RNA, 24 nt, Artificial Sequence
  Synthetic
gccccgcgggccguggccgagcuc

SEQ ID NO: 12859 - RNA, 18 nt, Artificial Sequence
  Synthetic
gaggcgaugggguggcuc

SEQ ID NO: 12860 - RNA, 19 nt, Artificial Sequence
  Synthetic
ggaggcgaugggguggcuc

SEQ ID NO: 12861 - RNA, 20 nt, Artificial Sequence
  Synthetic
cggaggcgaugggguggcuc

SEQ ID NO: 12862 - RNA, 21 nt, Artificial Sequence
  Synthetic
gcggaggcgaugggguggcuc

SEQ ID NO: 12863 - RNA, 22 nt, Artificial Sequence
  Synthetic
cgcggaggcgaugggguggcuc

SEQ ID NO: 12864 - RNA, 23 nt, Artificial Sequence
  Synthetic
acgcggaggcgaugggguggcuc

SEQ ID NO: 12865 - RNA, 24 nt, Artificial Sequence
  Synthetic
gacgcggaggcgaugggguggcuc

SEQ ID NO: 12866 - RNA, 18 nt, Artificial Sequence
  Synthetic
gccgcggaccugcucuuc

SEQ ID NO: 12867 - RNA, 19 nt, Artificial Sequence
  Synthetic
cgccgcggaccugcucuuc

SEQ ID NO: 12868 - RNA, 20 nt, Artificial Sequence
  Synthetic
ccgccgcggaccugcucuuc

SEQ ID NO: 12869 - RNA, 21 nt, Artificial Sequence
  Synthetic
gccgccgcggaccugcucuuc

SEQ ID NO: 12870 - RNA, 22 nt, Artificial Sequence
  Synthetic
cgccgccgcggaccugcucuuc

SEQ ID NO: 12871 - RNA, 23 nt, Artificial Sequence
  Synthetic
ccgccgccgcggaccugcucuuc

SEQ ID NO: 12872 - RNA, 24 nt, Artificial Sequence
  Synthetic
gccgccgccgcggaccugcucuuc

SEQ ID NO: 12873 - RNA, 18 nt, Artificial Sequence
  Synthetic
gccggcgccguggaguuc

SEQ ID NO: 12874 - RNA, 19 nt, Artificial Sequence
  Synthetic
cgccggcgccguggaguuc

SEQ ID NO: 12875 - RNA, 20 nt, Artificial Sequence
  Synthetic
ucgccggcgccguggaguuc

SEQ ID NO: 12876 - RNA, 21 nt, Artificial Sequence
  Synthetic
uucgccggcgccguggaguuc

SEQ ID NO: 12877 - RNA, 22 nt, Artificial Sequence
  Synthetic
cuucgccggcgccguggaguuc

SEQ ID NO: 12878 - RNA, 23 nt, Artificial Sequence
  Synthetic
ccuucgccggcgccguggaguuc

SEQ ID NO: 12879 - RNA, 24 nt, Artificial Sequence
  Synthetic
gccuucgccggcgccguggaguuc

SEQ ID NO: 12880 - RNA, 18 nt, Artificial Sequence
  Synthetic
gccccgcgccccccgaag

SEQ ID NO: 12881 - RNA, 19 nt, Artificial Sequence
  Synthetic
cgccccgcgccccccgaag

SEQ ID NO: 12882 - RNA, 20 nt, Artificial Sequence
  Synthetic
gcgccccgcgccccccgaag

SEQ ID NO: 12883 - RNA, 21 nt, Artificial Sequence
  Synthetic
ggcgccccgcgccccccgaag

SEQ ID NO: 12884 - RNA, 22 nt, Artificial Sequence
  Synthetic
cggcgccccgcgccccccgaag

SEQ ID NO: 12885 - RNA, 23 nt, Artificial Sequence
  Synthetic
gcggcgccccgcgccccccgaag

SEQ ID NO: 12886 - RNA, 24 nt, Artificial Sequence
  Synthetic
ggcggcgccccgcgccccccgaag

SEQ ID NO: 12887 - RNA, 18 nt, Artificial Sequence
  Synthetic
cgcuacgaccgcgcgcag

SEQ ID NO: 12888 - RNA, 19 nt, Artificial Sequence
  Synthetic
ccgcuacgaccgcgcgcag

SEQ ID NO: 12889 - RNA, 20 nt, Artificial Sequence
  Synthetic
gccgcuacgaccgcgcgcag

SEQ ID NO: 12890 - RNA, 21 nt, Artificial Sequence
  Synthetic
cgccgcuacgaccgcgcgcag

SEQ ID NO: 12891 - RNA, 22 nt, Artificial Sequence
  Synthetic
ccgccgcuacgaccgcgcgcag

SEQ ID NO: 12892 - RNA, 23 nt, Artificial Sequence
  Synthetic
gccgccgcuacgaccgcgcgcag

SEQ ID NO: 12893 - RNA, 24 nt, Artificial Sequence
  Synthetic
agccgccgcuacgaccgcgcgcag

SEQ ID NO: 12894 - RNA, 18 nt, Artificial Sequence
  Synthetic
ccgcgacggguacgucag

SEQ ID NO: 12895 - RNA, 19 nt, Artificial Sequence
  Synthetic
accgcgacggguacgucag

SEQ ID NO: 12896 - RNA, 20 nt, Artificial Sequence
  Synthetic
uaccgcgacggguacgucag

SEQ ID NO: 12897 - RNA, 21 nt, Artificial Sequence
  Synthetic
cuaccgcgacggguacgucag

SEQ ID NO: 12898 - RNA, 22 nt, Artificial Sequence
  Synthetic
gcuaccgcgacggguacgucag

SEQ ID NO: 12899 - RNA, 23 nt, Artificial Sequence
  Synthetic
cgcuaccgcgacggguacgucag

SEQ ID NO: 12900 - RNA, 24 nt, Artificial Sequence
  Synthetic
gcgcuaccgcgacggguacgucag

SEQ ID NO: 12901 - RNA, 18 nt, Artificial Sequence
  Synthetic
cucuggggggcgcccgag

SEQ ID NO: 12902 - RNA, 19 nt, Artificial Sequence
  Synthetic
ccucuggggggcgcccgag

SEQ ID NO: 12903 - RNA, 20 nt, Artificial Sequence
  Synthetic
gccucuggggggcgcccgag

SEQ ID NO: 12904 - RNA, 21 nt, Artificial Sequence
  Synthetic
ggccucuggggggcgcccgag

SEQ ID NO: 12905 - RNA, 22 nt, Artificial Sequence
  Synthetic
cggccucuggggggcgcccgag

SEQ ID NO: 12906 - RNA, 23 nt, Artificial Sequence
  Synthetic
ccggccucuggggggcgcccgag

SEQ ID NO: 12907 - RNA, 24 nt, Artificial Sequence
  Synthetic
cccggccucuggggggcgcccgag

SEQ ID NO: 12908 - RNA, 18 nt, Artificial Sequence
  Synthetic
cccgugugggcgcccgag

SEQ ID NO: 12909 - RNA, 19 nt, Artificial Sequence
  Synthetic
gcccgugugggcgcccgag

SEQ ID NO: 12910 - RNA, 20 nt, Artificial Sequence
  Synthetic
cgcccgugugggcgcccgag

SEQ ID NO: 12911 - RNA, 21 nt, Artificial Sequence
  Synthetic
gcgcccgugugggcgcccgag

SEQ ID NO: 12912 - RNA, 22 nt, Artificial Sequence
  Synthetic
ggcgcccgugugggcgcccgag

SEQ ID NO: 12913 - RNA, 23 nt, Artificial Sequence
  Synthetic
cggcgcccgugugggcgcccgag

SEQ ID NO: 12914 - RNA, 24 nt, Artificial Sequence
  Synthetic
ccggcgcccgugugggcgcccgag

SEQ ID NO: 12915 - RNA, 18 nt, Artificial Sequence
  Synthetic
cggccccggcgggucgag

SEQ ID NO: 12916 - RNA, 19 nt, Artificial Sequence
  Synthetic
gcggccccggcgggucgag

SEQ ID NO: 12917 - RNA, 20 nt, Artificial Sequence
  Synthetic
ggcggccccggcgggucgag

SEQ ID NO: 12918 - RNA, 21 nt, Artificial Sequence
  Synthetic
gggcggccccggcgggucgag

SEQ ID NO: 12919 - RNA, 22 nt, Artificial Sequence
  Synthetic
cgggcggccccggcgggucgag

SEQ ID NO: 12920 - RNA, 23 nt, Artificial Sequence
  Synthetic
ccgggcggccccggcgggucgag

SEQ ID NO: 12921 - RNA, 24 nt, Artificial Sequence
  Synthetic
gccgggcggccccggcgggucgag

SEQ ID NO: 12922 - RNA, 18 nt, Artificial Sequence
  Synthetic
ggcgcggacgacgaggag

SEQ ID NO: 12923 - RNA, 19 nt, Artificial Sequence
  Synthetic
cggcgcggacgacgaggag

SEQ ID NO: 12924 - RNA, 20 nt, Artificial Sequence
  Synthetic
ucggcgcggacgacgaggag

SEQ ID NO: 12925 - RNA, 21 nt, Artificial Sequence
  Synthetic
cucggcgcggacgacgaggag

SEQ ID NO: 12926 - RNA, 22 nt, Artificial Sequence
  Synthetic
ccucggcgcggacgacgaggag

SEQ ID NO: 12927 - RNA, 23 nt, Artificial Sequence
  Synthetic
cccucggcgcggacgacgaggag

SEQ ID NO: 12928 - RNA, 24 nt, Artificial Sequence
  Synthetic
acccucggcgcggacgacgaggag

SEQ ID NO: 12929 - RNA, 18 nt, Artificial Sequence
  Synthetic
guggacauggacgcggag

SEQ ID NO: 12930 - RNA, 19 nt, Artificial Sequence
  Synthetic
cguggacauggacgcggag

SEQ ID NO: 12931 - RNA, 20 nt, Artificial Sequence
  Synthetic
ccguggacauggacgcggag

SEQ ID NO: 12932 - RNA, 21 nt, Artificial Sequence
  Synthetic
cccguggacauggacgcggag

SEQ ID NO: 12933 - RNA, 22 nt, Artificial Sequence
  Synthetic
gcccguggacauggacgcggag

SEQ ID NO: 12934 - RNA, 23 nt, Artificial Sequence
  Synthetic
agcccguggacauggacgcggag

SEQ ID NO: 12935 - RNA, 24 nt, Artificial Sequence
  Synthetic
gagcccguggacauggacgcggag

SEQ ID NO: 12936 - RNA, 18 nt, Artificial Sequence
  Synthetic
ggcggccggcgcgcggag

SEQ ID NO: 12937 - RNA, 19 nt, Artificial Sequence
  Synthetic
cggcggccggcgcgcggag

SEQ ID NO: 12938 - RNA, 20 nt, Artificial Sequence
  Synthetic
gcggcggccggcgcgcggag

SEQ ID NO: 12939 - RNA, 21 nt, Artificial Sequence
  Synthetic
ggcggcggccggcgcgcggag

SEQ ID NO: 12940 - RNA, 22 nt, Artificial Sequence
  Synthetic
uggcggcggccggcgcgcggag

SEQ ID NO: 12941 - RNA, 23 nt, Artificial Sequence
  Synthetic
guggcggcggccggcgcgcggag

SEQ ID NO: 12942 - RNA, 24 nt, Artificial Sequence
  Synthetic
gguggcggcggccggcgcgcggag

SEQ ID NO: 12943 - RNA, 18 nt, Artificial Sequence
  Synthetic
acgcggcugcuguacacg

SEQ ID NO: 12944 - RNA, 19 nt, Artificial Sequence
  Synthetic
cacgcggcugcuguacacg

SEQ ID NO: 12945 - RNA, 20 nt, Artificial Sequence
  Synthetic
ucacgcggcugcuguacacg

SEQ ID NO: 12946 - RNA, 21 nt, Artificial Sequence
  Synthetic
aucacgcggcugcuguacacg

SEQ ID NO: 12947 - RNA, 22 nt, Artificial Sequence
  Synthetic
gaucacgcggcugcuguacacg

SEQ ID NO: 12948 - RNA, 23 nt, Artificial Sequence
  Synthetic
ugaucacgcggcugcuguacacg

SEQ ID NO: 12949 - RNA, 24 nt, Artificial Sequence
  Synthetic
cugaucacgcggcugcuguacacg

SEQ ID NO: 12950 - RNA, 18 nt, Artificial Sequence
  Synthetic
gugcugcugcuguccacg

SEQ ID NO: 12951 - RNA, 19 nt, Artificial Sequence
  Synthetic
cgugcugcugcuguccacg

SEQ ID NO: 12952 - RNA, 20 nt, Artificial Sequence
  Synthetic
gcgugcugcugcuguccacg

SEQ ID NO: 12953 - RNA, 21 nt, Artificial Sequence
  Synthetic
ggcgugcugcugcuguccacg

SEQ ID NO: 12954 - RNA, 22 nt, Artificial Sequence
  Synthetic
gggcgugcugcugcuguccacg

SEQ ID NO: 12955 - RNA, 23 nt, Artificial Sequence
  Synthetic
agggcgugcugcugcuguccacg

SEQ ID NO: 12956 - RNA, 24 nt, Artificial Sequence
  Synthetic
cagggcgugcugcugcuguccacg

SEQ ID NO: 12957 - RNA, 18 nt, Artificial Sequence
  Synthetic
agcuggaggacgacgacg

SEQ ID NO: 12958 - RNA, 19 nt, Artificial Sequence
  Synthetic
gagcuggaggacgacgacg

SEQ ID NO: 12959 - RNA, 20 nt, Artificial Sequence
  Synthetic
ggagcuggaggacgacgacg

SEQ ID NO: 12960 - RNA, 21 nt, Artificial Sequence
  Synthetic
cggagcuggaggacgacgacg

SEQ ID NO: 12961 - RNA, 22 nt, Artificial Sequence
  Synthetic
gcggagcuggaggacgacgacg

SEQ ID NO: 12962 - RNA, 23 nt, Artificial Sequence
  Synthetic
cgcggagcuggaggacgacgacg

SEQ ID NO: 12963 - RNA, 24 nt, Artificial Sequence
  Synthetic
acgcggagcuggaggacgacgacg

SEQ ID NO: 12964 - RNA, 18 nt, Artificial Sequence
  Synthetic
cccucggcgcggacgacg

SEQ ID NO: 12965 - RNA, 19 nt, Artificial Sequence
  Synthetic
acccucggcgcggacgacg

SEQ ID NO: 12966 - RNA, 20 nt, Artificial Sequence
  Synthetic
gacccucggcgcggacgacg

SEQ ID NO: 12967 - RNA, 21 nt, Artificial Sequence
  Synthetic
ggacccucggcgcggacgacg

SEQ ID NO: 12968 - RNA, 22 nt, Artificial Sequence
  Synthetic
gggacccucggcgcggacgacg

SEQ ID NO: 12969 - RNA, 23 nt, Artificial Sequence
  Synthetic
cgggacccucggcgcggacgacg

SEQ ID NO: 12970 - RNA, 24 nt, Artificial Sequence
  Synthetic
gcgggacccucggcgcggacgacg

SEQ ID NO: 12971 - RNA, 18 nt, Artificial Sequence
  Synthetic
ugcuguacacgccggacg

SEQ ID NO: 12972 - RNA, 19 nt, Artificial Sequence
  Synthetic
cugcuguacacgccggacg

SEQ ID NO: 12973 - RNA, 20 nt, Artificial Sequence
  Synthetic
gcugcuguacacgccggacg

SEQ ID NO: 12974 - RNA, 21 nt, Artificial Sequence
  Synthetic
ggcugcuguacacgccggacg

SEQ ID NO: 12975 - RNA, 22 nt, Artificial Sequence
  Synthetic
cggcugcuguacacgccggacg

SEQ ID NO: 12976 - RNA, 23 nt, Artificial Sequence
  Synthetic
gcggcugcuguacacgccggacg

SEQ ID NO: 12977 - RNA, 24 nt, Artificial Sequence
  Synthetic
cgcggcugcuguacacgccggacg

SEQ ID NO: 12978 - RNA, 18 nt, Artificial Sequence
  Synthetic
ggacccucggcgcggacg

SEQ ID NO: 12979 - RNA, 19 nt, Artificial Sequence
  Synthetic
gggacccucggcgcggacg

SEQ ID NO: 12980 - RNA, 20 nt, Artificial Sequence
  Synthetic
cgggacccucggcgcggacg

SEQ ID NO: 12981 - RNA, 21 nt, Artificial Sequence
  Synthetic
gcgggacccucggcgcggacg

SEQ ID NO: 12982 - RNA, 22 nt, Artificial Sequence
  Synthetic
ggcgggacccucggcgcggacg

SEQ ID NO: 12983 - RNA, 23 nt, Artificial Sequence
  Synthetic
gggcgggacccucggcgcggacg

SEQ ID NO: 12984 - RNA, 24 nt, Artificial Sequence
  Synthetic
cgggcgggacccucggcgcggacg

SEQ ID NO: 12985 - RNA, 18 nt, Artificial Sequence
  Synthetic
agcccguggacauggacg

SEQ ID NO: 12986 - RNA, 19 nt, Artificial Sequence
  Synthetic
gagcccguggacauggacg

SEQ ID NO: 12987 - RNA, 20 nt, Artificial Sequence
  Synthetic
cgagcccguggacauggacg

SEQ ID NO: 12988 - RNA, 21 nt, Artificial Sequence
  Synthetic
gcgagcccguggacauggacg

SEQ ID NO: 12989 - RNA, 22 nt, Artificial Sequence
  Synthetic
cgcgagcccguggacauggacg

SEQ ID NO: 12990 - RNA, 23 nt, Artificial Sequence
  Synthetic
gcgcgagcccguggacauggacg

SEQ ID NO: 12991 - RNA, 24 nt, Artificial Sequence
  Synthetic
ggcgcgagcccguggacauggacg

SEQ ID NO: 12992 - RNA, 18 nt, Artificial Sequence
  Synthetic
cccgcccccgcagauacg

SEQ ID NO: 12993 - RNA, 19 nt, Artificial Sequence
  Synthetic
gcccgcccccgcagauacg

SEQ ID NO: 12994 - RNA, 20 nt, Artificial Sequence
  Synthetic
ggcccgcccccgcagauacg

SEQ ID NO: 12995 - RNA, 21 nt, Artificial Sequence
  Synthetic
gggcccgcccccgcagauacg

SEQ ID NO: 12996 - RNA, 22 nt, Artificial Sequence
  Synthetic
cgggcccgcccccgcagauacg

SEQ ID NO: 12997 - RNA, 23 nt, Artificial Sequence
  Synthetic
gcgggcccgcccccgcagauacg

SEQ ID NO: 12998 - RNA, 24 nt, Artificial Sequence
  Synthetic
cgcgggcccgcccccgcagauacg

SEQ ID NO: 12999 - RNA, 18 nt, Artificial Sequence
  Synthetic
cggggcgcgugcuguacg

SEQ ID NO: 13000 - RNA, 19 nt, Artificial Sequence
  Synthetic
ccggggcgcgugcuguacg

SEQ ID NO: 13001 - RNA, 20 nt, Artificial Sequence
  Synthetic
cccggggcgcgugcuguacg

SEQ ID NO: 13002 - RNA, 21 nt, Artificial Sequence
  Synthetic
ccccggggcgcgugcuguacg

SEQ ID NO: 13003 - RNA, 22 nt, Artificial Sequence
  Synthetic
cccccggggcgcgugcuguacg

SEQ ID NO: 13004 - RNA, 23 nt, Artificial Sequence
  Synthetic
gcccccggggcgcgugcuguacg

SEQ ID NO: 13005 - RNA, 24 nt, Artificial Sequence
  Synthetic
cgcccccggggcgcgugcuguacg

SEQ ID NO: 13006 - RNA, 18 nt, Artificial Sequence
  Synthetic
gccgagggccccgacccg

SEQ ID NO: 13007 - RNA, 19 nt, Artificial Sequence
  Synthetic
cgccgagggccccgacccg

SEQ ID NO: 13008 - RNA, 20 nt, Artificial Sequence
  Synthetic
ccgccgagggccccgacccg

SEQ ID NO: 13009 - RNA, 21 nt, Artificial Sequence
  Synthetic
cccgccgagggccccgacccg

SEQ ID NO: 13010 - RNA, 22 nt, Artificial Sequence
  Synthetic
gcccgccgagggccccgacccg

SEQ ID NO: 13011 - RNA, 23 nt, Artificial Sequence
  Synthetic
ggcccgccgagggccccgacccg

SEQ ID NO: 13012 - RNA, 24 nt, Artificial Sequence
  Synthetic
cggcccgccgagggccccgacccg

SEQ ID NO: 13013 - RNA, 18 nt, Artificial Sequence
  Synthetic
cgccaggugcccgacccg

SEQ ID NO: 13014 - RNA, 19 nt, Artificial Sequence
  Synthetic
gcgccaggugcccgacccg

SEQ ID NO: 13015 - RNA, 20 nt, Artificial Sequence
  Synthetic
ugcgccaggugcccgacccg

SEQ ID NO: 13016 - RNA, 21 nt, Artificial Sequence
  Synthetic
augcgccaggugcccgacccg

SEQ ID NO: 13017 - RNA, 22 nt, Artificial Sequence
  Synthetic
gaugcgccaggugcccgacccg

SEQ ID NO: 13018 - RNA, 23 nt, Artificial Sequence
  Synthetic
ggaugcgccaggugcccgacccg

SEQ ID NO: 13019 - RNA, 24 nt, Artificial Sequence
  Synthetic
uggaugcgccaggugcccgacccg

SEQ ID NO: 13020 - RNA, 18 nt, Artificial Sequence
  Synthetic
ggcgccccgcgccccccg

SEQ ID NO: 13021 - RNA, 19 nt, Artificial Sequence
  Synthetic
cggcgccccgcgccccccg

SEQ ID NO: 13022 - RNA, 20 nt, Artificial Sequence
  Synthetic
gcggcgccccgcgccccccg

SEQ ID NO: 13023 - RNA, 21 nt, Artificial Sequence
  Synthetic
ggcggcgccccgcgccccccg

SEQ ID NO: 13024 - RNA, 22 nt, Artificial Sequence
  Synthetic
gggcggcgccccgcgccccccg

SEQ ID NO: 13025 - RNA, 23 nt, Artificial Sequence
  Synthetic
cgggcggcgccccgcgccccccg

SEQ ID NO: 13026 - RNA, 24 nt, Artificial Sequence
  Synthetic
ccgggcggcgccccgcgccccccg

SEQ ID NO: 13027 - RNA, 18 nt, Artificial Sequence
  Synthetic
cgacggcgacgacgcccg

SEQ ID NO: 13028 - RNA, 19 nt, Artificial Sequence
  Synthetic
acgacggcgacgacgcccg

SEQ ID NO: 13029 - RNA, 20 nt, Artificial Sequence
  Synthetic
cacgacggcgacgacgcccg

SEQ ID NO: 13030 - RNA, 21 nt, Artificial Sequence
  Synthetic
ccacgacggcgacgacgcccg

SEQ ID NO: 13031 - RNA, 22 nt, Artificial Sequence
  Synthetic
gccacgacggcgacgacgcccg

SEQ ID NO: 13032 - RNA, 23 nt, Artificial Sequence
  Synthetic
cgccacgacggcgacgacgcccg

SEQ ID NO: 13033 - RNA, 24 nt, Artificial Sequence
  Synthetic
ccgccacgacggcgacgacgcccg

SEQ ID NO: 13034 - RNA, 18 nt, Artificial Sequence
  Synthetic
cgcugacccgccggcccg

SEQ ID NO: 13035 - RNA, 19 nt, Artificial Sequence
  Synthetic
gcgcugacccgccggcccg

SEQ ID NO: 13036 - RNA, 20 nt, Artificial Sequence
  Synthetic
ggcgcugacccgccggcccg

SEQ ID NO: 13037 - RNA, 21 nt, Artificial Sequence
  Synthetic
cggcgcugacccgccggcccg

SEQ ID NO: 13038 - RNA, 22 nt, Artificial Sequence
  Synthetic
gcggcgcugacccgccggcccg

SEQ ID NO: 13039 - RNA, 23 nt, Artificial Sequence
  Synthetic
cgcggcgcugacccgccggcccg

SEQ ID NO: 13040 - RNA, 24 nt, Artificial Sequence
  Synthetic
ccgcggcgcugacccgccggcccg

SEQ ID NO: 13041 - RNA, 18 nt, Artificial Sequence
  Synthetic
gccgugcgcggcggcccg

SEQ ID NO: 13042 - RNA, 19 nt, Artificial Sequence
  Synthetic
cgccgugcgcggcggcccg

SEQ ID NO: 13043 - RNA, 20 nt, Artificial Sequence
  Synthetic
acgccgugcgcggcggcccg

SEQ ID NO: 13044 - RNA, 21 nt, Artificial Sequence
  Synthetic
gacgccgugcgcggcggcccg

SEQ ID NO: 13045 - RNA, 22 nt, Artificial Sequence
  Synthetic
cgacgccgugcgcggcggcccg

SEQ ID NO: 13046 - RNA, 23 nt, Artificial Sequence
  Synthetic
gcgacgccgugcgcggcggcccg

SEQ ID NO: 13047 - RNA, 24 nt, Artificial Sequence
  Synthetic
cgcgacgccgugcgcggcggcccg

SEQ ID NO: 13048 - RNA, 18 nt, Artificial Sequence
  Synthetic
ccgcggccgccccucccg

SEQ ID NO: 13049 - RNA, 19 nt, Artificial Sequence
  Synthetic
cccgcggccgccccucccg

SEQ ID NO: 13050 - RNA, 20 nt, Artificial Sequence
  Synthetic
ccccgcggccgccccucccg

SEQ ID NO: 13051 - RNA, 21 nt, Artificial Sequence
  Synthetic
gccccgcggccgccccucccg

SEQ ID NO: 13052 - RNA, 22 nt, Artificial Sequence
  Synthetic
cgccccgcggccgccccucccg

SEQ ID NO: 13053 - RNA, 23 nt, Artificial Sequence
  Synthetic
ccgccccgcggccgccccucccg

SEQ ID NO: 13054 - RNA, 24 nt, Artificial Sequence
  Synthetic
cccgccccgcggccgccccucccg

SEQ ID NO: 13055 - RNA, 18 nt, Artificial Sequence
  Synthetic
ggcuggcgccgccagccg

SEQ ID NO: 13056 - RNA, 19 nt, Artificial Sequence
  Synthetic
cggcuggcgccgccagccg

SEQ ID NO: 13057 - RNA, 20 nt, Artificial Sequence
  Synthetic
gcggcuggcgccgccagccg

SEQ ID NO: 13058 - RNA, 21 nt, Artificial Sequence
  Synthetic
ggcggcuggcgccgccagccg

SEQ ID NO: 13059 - RNA, 22 nt, Artificial Sequence
  Synthetic
gggcggcuggcgccgccagccg

SEQ ID NO: 13060 - RNA, 23 nt, Artificial Sequence
  Synthetic
agggcggcuggcgccgccagccg

SEQ ID NO: 13061 - RNA, 24 nt, Artificial Sequence
  Synthetic
cagggcggcuggcgccgccagccg

SEQ ID NO: 13062 - RNA, 18 nt, Artificial Sequence
  Synthetic
gcggggcuggccacgccg

SEQ ID NO: 13063 - RNA, 19 nt, Artificial Sequence
  Synthetic
cgcggggcuggccacgccg

SEQ ID NO: 13064 - RNA, 20 nt, Artificial Sequence
  Synthetic
ccgcggggcuggccacgccg

SEQ ID NO: 13065 - RNA, 21 nt, Artificial Sequence
  Synthetic
gccgcggggcuggccacgccg

SEQ ID NO: 13066 - RNA, 22 nt, Artificial Sequence
  Synthetic
cgccgcggggcuggccacgccg

SEQ ID NO: 13067 - RNA, 23 nt, Artificial Sequence
  Synthetic
ccgccgcggggcuggccacgccg

SEQ ID NO: 13068 - RNA, 24 nt, Artificial Sequence
  Synthetic
accgccgcggggcuggccacgccg

SEQ ID NO: 13069 - RNA, 18 nt, Artificial Sequence
  Synthetic
aggugguggggaccgccg

SEQ ID NO: 13070 - RNA, 19 nt, Artificial Sequence
  Synthetic
gaggugguggggaccgccg

SEQ ID NO: 13071 - RNA, 20 nt, Artificial Sequence
  Synthetic
ggaggugguggggaccgccg

SEQ ID NO: 13072 - RNA, 21 nt, Artificial Sequence
  Synthetic
uggaggugguggggaccgccg

SEQ ID NO: 13073 - RNA, 22 nt, Artificial Sequence
  Synthetic
guggaggugguggggaccgccg

SEQ ID NO: 13074 - RNA, 23 nt, Artificial Sequence
  Synthetic
cguggaggugguggggaccgccg

SEQ ID NO: 13075 - RNA, 24 nt, Artificial Sequence
  Synthetic
gcguggaggugguggggaccgccg

SEQ ID NO: 13076 - RNA, 18 nt, Artificial Sequence
  Synthetic
ccgcggacuggcccgccg

SEQ ID NO: 13077 - RNA, 19 nt, Artificial Sequence
  Synthetic
gccgcggacuggcccgccg

SEQ ID NO: 13078 - RNA, 20 nt, Artificial Sequence
  Synthetic
cgccgcggacuggcccgccg

SEQ ID NO: 13079 - RNA, 21 nt, Artificial Sequence
  Synthetic
gcgccgcggacuggcccgccg

SEQ ID NO: 13080 - RNA, 22 nt, Artificial Sequence
  Synthetic
cgcgccgcggacuggcccgccg

SEQ ID NO: 13081 - RNA, 23 nt, Artificial Sequence
  Synthetic
gcgcgccgcggacuggcccgccg

SEQ ID NO: 13082 - RNA, 24 nt, Artificial Sequence
  Synthetic
ugcgcgccgcggacuggcccgccg

SEQ ID NO: 13083 - RNA, 18 nt, Artificial Sequence
  Synthetic
gggccgccuggagcgccg

SEQ ID NO: 13084 - RNA, 19 nt, Artificial Sequence
  Synthetic
cgggccgccuggagcgccg

SEQ ID NO: 13085 - RNA, 20 nt, Artificial Sequence
  Synthetic
gcgggccgccuggagcgccg

SEQ ID NO: 13086 - RNA, 21 nt, Artificial Sequence
  Synthetic
cgcgggccgccuggagcgccg

SEQ ID NO: 13087 - RNA, 22 nt, Artificial Sequence
  Synthetic
ccgcgggccgccuggagcgccg

SEQ ID NO: 13088 - RNA, 23 nt, Artificial Sequence
  Synthetic
accgcgggccgccuggagcgccg

SEQ ID NO: 13089 - RNA, 24 nt, Artificial Sequence
  Synthetic
gaccgcgggccgccuggagcgccg

SEQ ID NO: 13090 - RNA, 18 nt, Artificial Sequence
  Synthetic
gcgcccgccuccgcgccg

SEQ ID NO: 13091 - RNA, 19 nt, Artificial Sequence
  Synthetic
cgcgcccgccuccgcgccg

SEQ ID NO: 13092 - RNA, 20 nt, Artificial Sequence
  Synthetic
ccgcgcccgccuccgcgccg

SEQ ID NO: 13093 - RNA, 21 nt, Artificial Sequence
  Synthetic
gccgcgcccgccuccgcgccg

SEQ ID NO: 13094 - RNA, 22 nt, Artificial Sequence
  Synthetic
cgccgcgcccgccuccgcgccg

SEQ ID NO: 13095 - RNA, 23 nt, Artificial Sequence
  Synthetic
ucgccgcgcccgccuccgcgccg

SEQ ID NO: 13096 - RNA, 24 nt, Artificial Sequence
  Synthetic
cucgccgcgcccgccuccgcgccg

SEQ ID NO: 13097 - RNA, 18 nt, Artificial Sequence
  Synthetic
ccgccggcuacggcgccg

SEQ ID NO: 13098 - RNA, 19 nt, Artificial Sequence
  Synthetic
cccgccggcuacggcgccg

SEQ ID NO: 13099 - RNA, 20 nt, Artificial Sequence
  Synthetic
gcccgccggcuacggcgccg

SEQ ID NO: 13100 - RNA, 21 nt, Artificial Sequence
  Synthetic
ugcccgccggcuacggcgccg

SEQ ID NO: 13101 - RNA, 22 nt, Artificial Sequence
  Synthetic
gugcccgccggcuacggcgccg

SEQ ID NO: 13102 - RNA, 23 nt, Artificial Sequence
  Synthetic
ggugcccgccggcuacggcgccg

SEQ ID NO: 13103 - RNA, 24 nt, Artificial Sequence
  Synthetic
cggugcccgccggcuacggcgccg

SEQ ID NO: 13104 - RNA, 18 nt, Artificial Sequence
  Synthetic
gccccggccagggcgccg

SEQ ID NO: 13105 - RNA, 19 nt, Artificial Sequence
  Synthetic
cgccccggccagggcgccg

SEQ ID NO: 13106 - RNA, 20 nt, Artificial Sequence
  Synthetic
ccgccccggccagggcgccg

SEQ ID NO: 13107 - RNA, 21 nt, Artificial Sequence
  Synthetic
cccgccccggccagggcgccg

SEQ ID NO: 13108 - RNA, 22 nt, Artificial Sequence
  Synthetic
ccccgccccggccagggcgccg

SEQ ID NO: 13109 - RNA, 23 nt, Artificial Sequence
  Synthetic
gccccgccccggccagggcgccg

SEQ ID NO: 13110 - RNA, 24 nt, Artificial Sequence
  Synthetic
agccccgccccggccagggcgccg

SEQ ID NO: 13111 - RNA, 18 nt, Artificial Sequence
  Synthetic
cggcggcgucgccggccg

SEQ ID NO: 13112 - RNA, 19 nt, Artificial Sequence
  Synthetic
gcggcggcgucgccggccg

SEQ ID NO: 13113 - RNA, 20 nt, Artificial Sequence
  Synthetic
ggcggcggcgucgccggccg

SEQ ID NO: 13114 - RNA, 21 nt, Artificial Sequence
  Synthetic
cggcggcggcgucgccggccg

SEQ ID NO: 13115 - RNA, 22 nt, Artificial Sequence
  Synthetic
ucggcggcggcgucgccggccg

SEQ ID NO: 13116 - RNA, 23 nt, Artificial Sequence
  Synthetic
gucggcggcggcgucgccggccg

SEQ ID NO: 13117 - RNA, 24 nt, Artificial Sequence
  Synthetic
cgucggcggcggcgucgccggccg

SEQ ID NO: 13118 - RNA, 18 nt, Artificial Sequence
  Synthetic
cugggcccggcgcugccg

SEQ ID NO: 13119 - RNA, 19 nt, Artificial Sequence
  Synthetic
ccugggcccggcgcugccg

SEQ ID NO: 13120 - RNA, 20 nt, Artificial Sequence
  Synthetic
cccugggcccggcgcugccg

SEQ ID NO: 13121 - RNA, 21 nt, Artificial Sequence
  Synthetic
gcccugggcccggcgcugccg

SEQ ID NO: 13122 - RNA, 22 nt, Artificial Sequence
  Synthetic
ggcccugggcccggcgcugccg

SEQ ID NO: 13123 - RNA, 23 nt, Artificial Sequence
  Synthetic
gggcccugggcccggcgcugccg

SEQ ID NO: 13124 - RNA, 24 nt, Artificial Sequence
  Synthetic
ggggcccugggcccggcgcugccg

SEQ ID NO: 13125 - RNA, 18 nt, Artificial Sequence
  Synthetic
gccgcugcgccucugccg

SEQ ID NO: 13126 - RNA, 19 nt, Artificial Sequence
  Synthetic
cgccgcugcgccucugccg

SEQ ID NO: 13127 - RNA, 20 nt, Artificial Sequence
  Synthetic
ccgccgcugcgccucugccg

SEQ ID NO: 13128 - RNA, 21 nt, Artificial Sequence
  Synthetic
gccgccgcugcgccucugccg

SEQ ID NO: 13129 - RNA, 22 nt, Artificial Sequence
  Synthetic
cgccgccgcugcgccucugccg

SEQ ID NO: 13130 - RNA, 23 nt, Artificial Sequence
  Synthetic
gcgccgccgcugcgccucugccg

SEQ ID NO: 13131 - RNA, 24 nt, Artificial Sequence
  Synthetic
cgcgccgccgcugcgccucugccg

SEQ ID NO: 13132 - RNA, 18 nt, Artificial Sequence
  Synthetic
gacgacguccgcgguccg

SEQ ID NO: 13133 - RNA, 19 nt, Artificial Sequence
  Synthetic
agacgacguccgcgguccg

SEQ ID NO: 13134 - RNA, 20 nt, Artificial Sequence
  Synthetic
gagacgacguccgcgguccg

SEQ ID NO: 13135 - RNA, 21 nt, Artificial Sequence
  Synthetic
ggagacgacguccgcgguccg

SEQ ID NO: 13136 - RNA, 22 nt, Artificial Sequence
  Synthetic
cggagacgacguccgcgguccg

SEQ ID NO: 13137 - RNA, 23 nt, Artificial Sequence
  Synthetic
ccggagacgacguccgcgguccg

SEQ ID NO: 13138 - RNA, 24 nt, Artificial Sequence
  Synthetic
accggagacgacguccgcgguccg

SEQ ID NO: 13139 - RNA, 18 nt, Artificial Sequence
  Synthetic
cccccccggagugguccg

SEQ ID NO: 13140 - RNA, 19 nt, Artificial Sequence
  Synthetic
ccccccccggagugguccg

SEQ ID NO: 13141 - RNA, 20 nt, Artificial Sequence
  Synthetic
gccccccccggagugguccg

SEQ ID NO: 13142 - RNA, 21 nt, Artificial Sequence
  Synthetic
ggccccccccggagugguccg

SEQ ID NO: 13143 - RNA, 22 nt, Artificial Sequence
  Synthetic
gggccccccccggagugguccg

SEQ ID NO: 13144 - RNA, 23 nt, Artificial Sequence
  Synthetic
cgggccccccccggagugguccg

SEQ ID NO: 13145 - RNA, 24 nt, Artificial Sequence
  Synthetic
gcgggccccccccggagugguccg

SEQ ID NO: 13146 - RNA, 18 nt, Artificial Sequence
  Synthetic
gcgacggguacgucagcg

SEQ ID NO: 13147 - RNA, 19 nt, Artificial Sequence
  Synthetic
cgcgacggguacgucagcg

SEQ ID NO: 13148 - RNA, 20 nt, Artificial Sequence
  Synthetic
ccgcgacggguacgucagcg

SEQ ID NO: 13149 - RNA, 21 nt, Artificial Sequence
  Synthetic
accgcgacggguacgucagcg

SEQ ID NO: 13150 - RNA, 22 nt, Artificial Sequence
  Synthetic
uaccgcgacggguacgucagcg

SEQ ID NO: 13151 - RNA, 23 nt, Artificial Sequence
  Synthetic
cuaccgcgacggguacgucagcg

SEQ ID NO: 13152 - RNA, 24 nt, Artificial Sequence
  Synthetic
gcuaccgcgacggguacgucagcg

SEQ ID NO: 13153 - RNA, 18 nt, Artificial Sequence
  Synthetic
cgucggccgcgggccgcg

SEQ ID NO: 13154 - RNA, 19 nt, Artificial Sequence
  Synthetic
gcgucggccgcgggccgcg

SEQ ID NO: 13155 - RNA, 20 nt, Artificial Sequence
  Synthetic
ggcgucggccgcgggccgcg

SEQ ID NO: 13156 - RNA, 21 nt, Artificial Sequence
  Synthetic
gggcgucggccgcgggccgcg

SEQ ID NO: 13157 - RNA, 22 nt, Artificial Sequence
  Synthetic
ugggcgucggccgcgggccgcg

SEQ ID NO: 13158 - RNA, 23 nt, Artificial Sequence
  Synthetic
cugggcgucggccgcgggccgcg

SEQ ID NO: 13159 - RNA, 24 nt, Artificial Sequence
  Synthetic
gcugggcgucggccgcgggccgcg

SEQ ID NO: 13160 - RNA, 18 nt, Artificial Sequence
  Synthetic
accuggccgcgggccgcg

SEQ ID NO: 13161 - RNA, 19 nt, Artificial Sequence
  Synthetic
gaccuggccgcgggccgcg

SEQ ID NO: 13162 - RNA, 20 nt, Artificial Sequence
  Synthetic
ggaccuggccgcgggccgcg

SEQ ID NO: 13163 - RNA, 21 nt, Artificial Sequence
  Synthetic
aggaccuggccgcgggccgcg

SEQ ID NO: 13164 - RNA, 22 nt, Artificial Sequence
  Synthetic
gaggaccuggccgcgggccgcg

SEQ ID NO: 13165 - RNA, 23 nt, Artificial Sequence
  Synthetic
cgaggaccuggccgcgggccgcg

SEQ ID NO: 13166 - RNA, 24 nt, Artificial Sequence
  Synthetic
gcgaggaccuggccgcgggccgcg

SEQ ID NO: 13167 - RNA, 18 nt, Artificial Sequence
  Synthetic
ggagcugcgcgggccgcg

SEQ ID NO: 13168 - RNA, 19 nt, Artificial Sequence
  Synthetic
cggagcugcgcgggccgcg

SEQ ID NO: 13169 - RNA, 20 nt, Artificial Sequence
  Synthetic
gcggagcugcgcgggccgcg

SEQ ID NO: 13170 - RNA, 21 nt, Artificial Sequence
  Synthetic
ggcggagcugcgcgggccgcg

SEQ ID NO: 13171 - RNA, 22 nt, Artificial Sequence
  Synthetic
cggcggagcugcgcgggccgcg

SEQ ID NO: 13172 - RNA, 23 nt, Artificial Sequence
  Synthetic
ccggcggagcugcgcgggccgcg

SEQ ID NO: 13173 - RNA, 24 nt, Artificial Sequence
  Synthetic
cccggcggagcugcgcgggccgcg

SEQ ID NO: 13174 - RNA, 18 nt, Artificial Sequence
  Synthetic
gggacggugcuggccgcg

SEQ ID NO: 13175 - RNA, 19 nt, Artificial Sequence
  Synthetic
ggggacggugcuggccgcg

SEQ ID NO: 13176 - RNA, 20 nt, Artificial Sequence
  Synthetic
cggggacggugcuggccgcg

SEQ ID NO: 13177 - RNA, 21 nt, Artificial Sequence
  Synthetic
gcggggacggugcuggccgcg

SEQ ID NO: 13178 - RNA, 22 nt, Artificial Sequence
  Synthetic
cgcggggacggugcuggccgcg

SEQ ID NO: 13179 - RNA, 23 nt, Artificial Sequence
  Synthetic
gcgcggggacggugcuggccgcg

SEQ ID NO: 13180 - RNA, 24 nt, Artificial Sequence
  Synthetic
cgcgcggggacggugcuggccgcg

SEQ ID NO: 13181 - RNA, 18 nt, Artificial Sequence
  Synthetic
agugguccgccgagcgcg

SEQ ID NO: 13182 - RNA, 19 nt, Artificial Sequence
  Synthetic
gagugguccgccgagcgcg

SEQ ID NO: 13183 - RNA, 20 nt, Artificial Sequence
  Synthetic
ggagugguccgccgagcgcg

SEQ ID NO: 13184 - RNA, 21 nt, Artificial Sequence
  Synthetic
cggagugguccgccgagcgcg

SEQ ID NO: 13185 - RNA, 22 nt, Artificial Sequence
  Synthetic
ccggagugguccgccgagcgcg

SEQ ID NO: 13186 - RNA, 23 nt, Artificial Sequence
  Synthetic
cccggagugguccgccgagcgcg

SEQ ID NO: 13187 - RNA, 24 nt, Artificial Sequence
  Synthetic
ccccggagugguccgccgagcgcg

SEQ ID NO: 13188 - RNA, 18 nt, Artificial Sequence
  Synthetic
cgccgcuacgaccgcgcg

SEQ ID NO: 13189 - RNA, 19 nt, Artificial Sequence
  Synthetic
ccgccgcuacgaccgcgcg

SEQ ID NO: 13190 - RNA, 20 nt, Artificial Sequence
  Synthetic
gccgccgcuacgaccgcgcg

SEQ ID NO: 13191 - RNA, 21 nt, Artificial Sequence
  Synthetic
agccgccgcuacgaccgcgcg

SEQ ID NO: 13192 - RNA, 22 nt, Artificial Sequence
  Synthetic
gagccgccgcuacgaccgcgcg

SEQ ID NO: 13193 - RNA, 23 nt, Artificial Sequence
  Synthetic
ugagccgccgcuacgaccgcgcg

SEQ ID NO: 13194 - RNA, 24 nt, Artificial Sequence
  Synthetic
augagccgccgcuacgaccgcgcg

SEQ ID NO: 13195 - RNA, 18 nt, Artificial Sequence
  Synthetic
cgggggucuucgcgcgcg

SEQ ID NO: 13196 - RNA, 19 nt, Artificial Sequence
  Synthetic
ccgggggucuucgcgcgcg

SEQ ID NO: 13197 - RNA, 20 nt, Artificial Sequence
  Synthetic
gccgggggucuucgcgcgcg

SEQ ID NO: 13198 - RNA, 21 nt, Artificial Sequence
  Synthetic
ggccgggggucuucgcgcgcg

SEQ ID NO: 13199 - RNA, 22 nt, Artificial Sequence
  Synthetic
gggccgggggucuucgcgcgcg

SEQ ID NO: 13200 - RNA, 23 nt, Artificial Sequence
  Synthetic
cgggccgggggucuucgcgcgcg

SEQ ID NO: 13201 - RNA, 24 nt, Artificial Sequence
  Synthetic
ucgggccgggggucuucgcgcgcg

SEQ ID NO: 13202 - RNA, 18 nt, Artificial Sequence
  Synthetic
gcaccgcgccugcgcgcg

SEQ ID NO: 13203 - RNA, 19 nt, Artificial Sequence
  Synthetic
cgcaccgcgccugcgcgcg

SEQ ID NO: 13204 - RNA, 20 nt, Artificial Sequence
  Synthetic
ucgcaccgcgccugcgcgcg

SEQ ID NO: 13205 - RNA, 21 nt, Artificial Sequence
  Synthetic
cucgcaccgcgccugcgcgcg

SEQ ID NO: 13206 - RNA, 22 nt, Artificial Sequence
  Synthetic
acucgcaccgcgccugcgcgcg

SEQ ID NO: 13207 - RNA, 23 nt, Artificial Sequence
  Synthetic
cacucgcaccgcgccugcgcgcg

SEQ ID NO: 13208 - RNA, 24 nt, Artificial Sequence
  Synthetic
gcacucgcaccgcgccugcgcgcg

SEQ ID NO: 13209 - RNA, 18 nt, Artificial Sequence
  Synthetic
gccauggcgcccggcgcg

SEQ ID NO: 13210 - RNA, 19 nt, Artificial Sequence
  Synthetic
cgccauggcgcccggcgcg

SEQ ID NO: 13211 - RNA, 20 nt, Artificial Sequence
  Synthetic
acgccauggcgcccggcgcg

SEQ ID NO: 13212 - RNA, 21 nt, Artificial Sequence
  Synthetic
gacgccauggcgcccggcgcg

SEQ ID NO: 13213 - RNA, 22 nt, Artificial Sequence
  Synthetic
cgacgccauggcgcccggcgcg

SEQ ID NO: 13214 - RNA, 23 nt, Artificial Sequence
  Synthetic
gcgacgccauggcgcccggcgcg

SEQ ID NO: 13215 - RNA, 24 nt, Artificial Sequence
  Synthetic
ggcgacgccauggcgcccggcgcg

SEQ ID NO: 13216 - RNA, 18 nt, Artificial Sequence
  Synthetic
guggcggcggccggcgcg

SEQ ID NO: 13217 - RNA, 19 nt, Artificial Sequence
  Synthetic
gguggcggcggccggcgcg

SEQ ID NO: 13218 - RNA, 20 nt, Artificial Sequence
  Synthetic
ugguggcggcggccggcgcg

SEQ ID NO: 13219 - RNA, 21 nt, Artificial Sequence
  Synthetic
gugguggcggcggccggcgcg

SEQ ID NO: 13220 - RNA, 22 nt, Artificial Sequence
  Synthetic
ggugguggcggcggccggcgcg

SEQ ID NO: 13221 - RNA, 23 nt, Artificial Sequence
  Synthetic
cggugguggcggcggccggcgcg

SEQ ID NO: 13222 - RNA, 24 nt, Artificial Sequence
  Synthetic
gcggugguggcggcggccggcgcg

SEQ ID NO: 13223 - RNA, 18 nt, Artificial Sequence
  Synthetic
gucucggcgcugggcgcg

SEQ ID NO: 13224 - RNA, 19 nt, Artificial Sequence
  Synthetic
cgucucggcgcugggcgcg

SEQ ID NO: 13225 - RNA, 20 nt, Artificial Sequence
  Synthetic
acgucucggcgcugggcgcg

SEQ ID NO: 13226 - RNA, 21 nt, Artificial Sequence
  Synthetic
gacgucucggcgcugggcgcg

SEQ ID NO: 13227 - RNA, 22 nt, Artificial Sequence
  Synthetic
cgacgucucggcgcugggcgcg

SEQ ID NO: 13228 - RNA, 23 nt, Artificial Sequence
  Synthetic
ccgacgucucggcgcugggcgcg

SEQ ID NO: 13229 - RNA, 24 nt, Artificial Sequence
  Synthetic
cccgacgucucggcgcugggcgcg

SEQ ID NO: 13230 - RNA, 18 nt, Artificial Sequence
  Synthetic
uggggggcgcccgaggcg

SEQ ID NO: 13231 - RNA, 19 nt, Artificial Sequence
  Synthetic
cuggggggcgcccgaggcg

SEQ ID NO: 13232 - RNA, 20 nt, Artificial Sequence
  Synthetic
ucuggggggcgcccgaggcg

SEQ ID NO: 13233 - RNA, 21 nt, Artificial Sequence
  Synthetic
cucuggggggcgcccgaggcg

SEQ ID NO: 13234 - RNA, 22 nt, Artificial Sequence
  Synthetic
ccucuggggggcgcccgaggcg

SEQ ID NO: 13235 - RNA, 23 nt, Artificial Sequence
  Synthetic
gccucuggggggcgcccgaggcg

SEQ ID NO: 13236 - RNA, 24 nt, Artificial Sequence
  Synthetic
ggccucuggggggcgcccgaggcg

SEQ ID NO: 13237 - RNA, 18 nt, Artificial Sequence
  Synthetic
acgccggacgcggaggcg

SEQ ID NO: 13238 - RNA, 19 nt, Artificial Sequence
  Synthetic
cacgccggacgcggaggcg

SEQ ID NO: 13239 - RNA, 20 nt, Artificial Sequence
  Synthetic
acacgccggacgcggaggcg

SEQ ID NO: 13240 - RNA, 21 nt, Artificial Sequence
  Synthetic
uacacgccggacgcggaggcg

SEQ ID NO: 13241 - RNA, 22 nt, Artificial Sequence
  Synthetic
guacacgccggacgcggaggcg

SEQ ID NO: 13242 - RNA, 23 nt, Artificial Sequence
  Synthetic
uguacacgccggacgcggaggcg

SEQ ID NO: 13243 - RNA, 24 nt, Artificial Sequence
  Synthetic
cuguacacgccggacgcggaggcg

SEQ ID NO: 13244 - RNA, 18 nt, Artificial Sequence
  Synthetic
cgcgccgugcucccggcg

SEQ ID NO: 13245 - RNA, 19 nt, Artificial Sequence
  Synthetic
ccgcgccgugcucccggcg

SEQ ID NO: 13246 - RNA, 20 nt, Artificial Sequence
  Synthetic
gccgcgccgugcucccggcg

SEQ ID NO: 13247 - RNA, 21 nt, Artificial Sequence
  Synthetic
cgccgcgccgugcucccggcg

SEQ ID NO: 13248 - RNA, 22 nt, Artificial Sequence
  Synthetic
ccgccgcgccgugcucccggcg

SEQ ID NO: 13249 - RNA, 23 nt, Artificial Sequence
  Synthetic
accgccgcgccgugcucccggcg

SEQ ID NO: 13250 - RNA, 24 nt, Artificial Sequence
  Synthetic
uaccgccgcgccgugcucccggcg

SEQ ID NO: 13251 - RNA, 18 nt, Artificial Sequence
  Synthetic
gugcgcuggccggcggcg

SEQ ID NO: 13252 - RNA, 19 nt, Artificial Sequence
  Synthetic
cgugcgcuggccggcggcg

SEQ ID NO: 13253 - RNA, 20 nt, Artificial Sequence
  Synthetic
ccgugcgcuggccggcggcg

SEQ ID NO: 13254 - RNA, 21 nt, Artificial Sequence
  Synthetic
gccgugcgcuggccggcggcg

SEQ ID NO: 13255 - RNA, 22 nt, Artificial Sequence
  Synthetic
cgccgugcgcuggccggcggcg

SEQ ID NO: 13256 - RNA, 23 nt, Artificial Sequence
  Synthetic
gcgccgugcgcuggccggcggcg

SEQ ID NO: 13257 - RNA, 24 nt, Artificial Sequence
  Synthetic
ugcgccgugcgcuggccggcggcg

SEQ ID NO: 13258 - RNA, 18 nt, Artificial Sequence
  Synthetic
ccgcggcgggcggcggcg

SEQ ID NO: 13259 - RNA, 19 nt, Artificial Sequence
  Synthetic
gccgcggcgggcggcggcg

SEQ ID NO: 13260 - RNA, 20 nt, Artificial Sequence
  Synthetic
ggccgcggcgggcggcggcg

SEQ ID NO: 13261 - RNA, 21 nt, Artificial Sequence
  Synthetic
uggccgcggcgggcggcggcg

SEQ ID NO: 13262 - RNA, 22 nt, Artificial Sequence
  Synthetic
cuggccgcggcgggcggcggcg

SEQ ID NO: 13263 - RNA, 23 nt, Artificial Sequence
  Synthetic
gcuggccgcggcgggcggcggcg

SEQ ID NO: 13264 - RNA, 24 nt, Artificial Sequence
  Synthetic
ugcuggccgcggcgggcggcggcg

SEQ ID NO: 13265 - RNA, 18 nt, Artificial Sequence
  Synthetic
gcccccgacgucucggcg

SEQ ID NO: 13266 - RNA, 19 nt, Artificial Sequence
  Synthetic
cgcccccgacgucucggcg

SEQ ID NO: 13267 - RNA, 20 nt, Artificial Sequence
  Synthetic
gcgcccccgacgucucggcg

SEQ ID NO: 13268 - RNA, 21 nt, Artificial Sequence
  Synthetic
ggcgcccccgacgucucggcg

SEQ ID NO: 13269 - RNA, 22 nt, Artificial Sequence
  Synthetic
cggcgcccccgacgucucggcg

SEQ ID NO: 13270 - RNA, 23 nt, Artificial Sequence
  Synthetic
ccggcgcccccgacgucucggcg

SEQ ID NO: 13271 - RNA, 24 nt, Artificial Sequence
  Synthetic
accggcgcccccgacgucucggcg

SEQ ID NO: 13272 - RNA, 18 nt, Artificial Sequence
  Synthetic
cugggguacgccauggcg

SEQ ID NO: 13273 - RNA, 19 nt, Artificial Sequence
  Synthetic
ccugggguacgccauggcg

SEQ ID NO: 13274 - RNA, 20 nt, Artificial Sequence
  Synthetic
accugggguacgccauggcg

SEQ ID NO: 13275 - RNA, 21 nt, Artificial Sequence
  Synthetic
caccugggguacgccauggcg

SEQ ID NO: 13276 - RNA, 22 nt, Artificial Sequence
  Synthetic
ccaccugggguacgccauggcg

SEQ ID NO: 13277 - RNA, 23 nt, Artificial Sequence
  Synthetic
cccaccugggguacgccauggcg

SEQ ID NO: 13278 - RNA, 24 nt, Artificial Sequence
  Synthetic
ccccaccugggguacgccauggcg

SEQ ID NO: 13279 - RNA, 18 nt, Artificial Sequence
  Synthetic
auccuggaggcgcuggcg

SEQ ID NO: 13280 - RNA, 19 nt, Artificial Sequence
  Synthetic
gauccuggaggcgcuggcg

SEQ ID NO: 13281 - RNA, 20 nt, Artificial Sequence
  Synthetic
ggauccuggaggcgcuggcg

SEQ ID NO: 13282 - RNA, 21 nt, Artificial Sequence
  Synthetic
gggauccuggaggcgcuggcg

SEQ ID NO: 13283 - RNA, 22 nt, Artificial Sequence
  Synthetic
cgggauccuggaggcgcuggcg

SEQ ID NO: 13284 - RNA, 23 nt, Artificial Sequence
  Synthetic
gcgggauccuggaggcgcuggcg

SEQ ID NO: 13285 - RNA, 24 nt, Artificial Sequence
  Synthetic
cgcgggauccuggaggcgcuggcg

SEQ ID NO: 13286 - RNA, 18 nt, Artificial Sequence
  Synthetic
gcgcccggggacguggcg

SEQ ID NO: 13287 - RNA, 19 nt, Artificial Sequence
  Synthetic
ggcgcccggggacguggcg

SEQ ID NO: 13288 - RNA, 20 nt, Artificial Sequence
  Synthetic
uggcgcccggggacguggcg

SEQ ID NO: 13289 - RNA, 21 nt, Artificial Sequence
  Synthetic
guggcgcccggggacguggcg

SEQ ID NO: 13290 - RNA, 22 nt, Artificial Sequence
  Synthetic
cguggcgcccggggacguggcg

SEQ ID NO: 13291 - RNA, 23 nt, Artificial Sequence
  Synthetic
gcguggcgcccggggacguggcg

SEQ ID NO: 13292 - RNA, 24 nt, Artificial Sequence
  Synthetic
cgcguggcgcccggggacguggcg

SEQ ID NO: 13293 - RNA, 18 nt, Artificial Sequence
  Synthetic
cggcccgucuacguggcg

SEQ ID NO: 13294 - RNA, 19 nt, Artificial Sequence
  Synthetic
gcggcccgucuacguggcg

SEQ ID NO: 13295 - RNA, 20 nt, Artificial Sequence
  Synthetic
ugcggcccgucuacguggcg

SEQ ID NO: 13296 - RNA, 21 nt, Artificial Sequence
  Synthetic
cugcggcccgucuacguggcg

SEQ ID NO: 13297 - RNA, 22 nt, Artificial Sequence
  Synthetic
gcugcggcccgucuacguggcg

SEQ ID NO: 13298 - RNA, 23 nt, Artificial Sequence
  Synthetic
cgcugcggcccgucuacguggcg

SEQ ID NO: 13299 - RNA, 24 nt, Artificial Sequence
  Synthetic
ccgcugcggcccgucuacguggcg

SEQ ID NO: 13300 - RNA, 18 nt, Artificial Sequence
  Synthetic
ggugcugaugcgccugcg

SEQ ID NO: 13301 - RNA, 19 nt, Artificial Sequence
  Synthetic
uggugcugaugcgccugcg

SEQ ID NO: 13302 - RNA, 20 nt, Artificial Sequence
  Synthetic
cuggugcugaugcgccugcg

SEQ ID NO: 13303 - RNA, 21 nt, Artificial Sequence
  Synthetic
gcuggugcugaugcgccugcg

SEQ ID NO: 13304 - RNA, 22 nt, Artificial Sequence
  Synthetic
cgcuggugcugaugcgccugcg

SEQ ID NO: 13305 - RNA, 23 nt, Artificial Sequence
  Synthetic
gcgcuggugcugaugcgccugcg

SEQ ID NO: 13306 - RNA, 24 nt, Artificial Sequence
  Synthetic
cgcgcuggugcugaugcgccugcg

SEQ ID NO: 13307 - RNA, 18 nt, Artificial Sequence
  Synthetic
gcgccgugagccuggucg

SEQ ID NO: 13308 - RNA, 19 nt, Artificial Sequence
  Synthetic
cgcgccgugagccuggucg

SEQ ID NO: 13309 - RNA, 20 nt, Artificial Sequence
  Synthetic
gcgcgccgugagccuggucg

SEQ ID NO: 13310 - RNA, 21 nt, Artificial Sequence
  Synthetic
ugcgcgccgugagccuggucg

SEQ ID NO: 13311 - RNA, 22 nt, Artificial Sequence
  Synthetic
gugcgcgccgugagccuggucg

SEQ ID NO: 13312 - RNA, 23 nt, Artificial Sequence
  Synthetic
cgugcgcgccgugagccuggucg

SEQ ID NO: 13313 - RNA, 24 nt, Artificial Sequence
  Synthetic
ccgugcgcgccgugagccuggucg

SEQ ID NO: 13314 - RNA, 18 nt, Artificial Sequence
  Synthetic
ucuggggggcgcccgagg

SEQ ID NO: 13315 - RNA, 19 nt, Artificial Sequence
  Synthetic
cucuggggggcgcccgagg

SEQ ID NO: 13316 - RNA, 20 nt, Artificial Sequence
  Synthetic
ccucuggggggcgcccgagg

SEQ ID NO: 13317 - RNA, 21 nt, Artificial Sequence
  Synthetic
gccucuggggggcgcccgagg

SEQ ID NO: 13318 - RNA, 22 nt, Artificial Sequence
  Synthetic
ggccucuggggggcgcccgagg

SEQ ID NO: 13319 - RNA, 23 nt, Artificial Sequence
  Synthetic
cggccucuggggggcgcccgagg

SEQ ID NO: 13320 - RNA, 24 nt, Artificial Sequence
  Synthetic
ccggccucuggggggcgcccgagg

SEQ ID NO: 13321 - RNA, 18 nt, Artificial Sequence
  Synthetic
cgccggacuucugcgagg

SEQ ID NO: 13322 - RNA, 19 nt, Artificial Sequence
  Synthetic
gcgccggacuucugcgagg

SEQ ID NO: 13323 - RNA, 20 nt, Artificial Sequence
  Synthetic
cgcgccggacuucugcgagg

SEQ ID NO: 13324 - RNA, 21 nt, Artificial Sequence
  Synthetic
gcgcgccggacuucugcgagg

SEQ ID NO: 13325 - RNA, 22 nt, Artificial Sequence
  Synthetic
ggcgcgccggacuucugcgagg

SEQ ID NO: 13326 - RNA, 23 nt, Artificial Sequence
  Synthetic
cggcgcgccggacuucugcgagg

SEQ ID NO: 13327 - RNA, 24 nt, Artificial Sequence
  Synthetic
ccggcgcgccggacuucugcgagg

SEQ ID NO: 13328 - RNA, 18 nt, Artificial Sequence
  Synthetic
gcgcggacgacgaggagg

SEQ ID NO: 13329 - RNA, 19 nt, Artificial Sequence
  Synthetic
ggcgcggacgacgaggagg

SEQ ID NO: 13330 - RNA, 20 nt, Artificial Sequence
  Synthetic
cggcgcggacgacgaggagg

SEQ ID NO: 13331 - RNA, 21 nt, Artificial Sequence
  Synthetic
ucggcgcggacgacgaggagg

SEQ ID NO: 13332 - RNA, 22 nt, Artificial Sequence
  Synthetic
cucggcgcggacgacgaggagg

SEQ ID NO: 13333 - RNA, 23 nt, Artificial Sequence
  Synthetic
ccucggcgcggacgacgaggagg

SEQ ID NO: 13334 - RNA, 24 nt, Artificial Sequence
  Synthetic
cccucggcgcggacgacgaggagg

SEQ ID NO: 13335 - RNA, 18 nt, Artificial Sequence
  Synthetic
ccacgggccgcuucacgg

SEQ ID NO: 13336 - RNA, 19 nt, Artificial Sequence
  Synthetic
gccacgggccgcuucacgg

SEQ ID NO: 13337 - RNA, 20 nt, Artificial Sequence
  Synthetic
cgccacgggccgcuucacgg

SEQ ID NO: 13338 - RNA, 21 nt, Artificial Sequence
  Synthetic
acgccacgggccgcuucacgg

SEQ ID NO: 13339 - RNA, 22 nt, Artificial Sequence
  Synthetic
gacgccacgggccgcuucacgg

SEQ ID NO: 13340 - RNA, 23 nt, Artificial Sequence
  Synthetic
cgacgccacgggccgcuucacgg

SEQ ID NO: 13341 - RNA, 24 nt, Artificial Sequence
  Synthetic
gcgacgccacgggccgcuucacgg

SEQ ID NO: 13342 - RNA, 18 nt, Artificial Sequence
  Synthetic
gcucccggcgcuggacgg

SEQ ID NO: 13343 - RNA, 19 nt, Artificial Sequence
  Synthetic
ugcucccggcgcuggacgg

SEQ ID NO: 13344 - RNA, 20 nt, Artificial Sequence
  Synthetic
gugcucccggcgcuggacgg

SEQ ID NO: 13345 - RNA, 21 nt, Artificial Sequence
  Synthetic
cgugcucccggcgcuggacgg

SEQ ID NO: 13346 - RNA, 22 nt, Artificial Sequence
  Synthetic
ccgugcucccggcgcuggacgg

SEQ ID NO: 13347 - RNA, 23 nt, Artificial Sequence
  Synthetic
gccgugcucccggcgcuggacgg

SEQ ID NO: 13348 - RNA, 24 nt, Artificial Sequence
  Synthetic
cgccgugcucccggcgcuggacgg

SEQ ID NO: 13349 - RNA, 18 nt, Artificial Sequence
  Synthetic
ccgggggcggcgccccgg

SEQ ID NO: 13350 - RNA, 19 nt, Artificial Sequence
  Synthetic
cccgggggcggcgccccgg

SEQ ID NO: 13351 - RNA, 20 nt, Artificial Sequence
  Synthetic
ccccgggggcggcgccccgg

SEQ ID NO: 13352 - RNA, 21 nt, Artificial Sequence
  Synthetic
gccccgggggcggcgccccgg

SEQ ID NO: 13353 - RNA, 22 nt, Artificial Sequence
  Synthetic
ggccccgggggcggcgccccgg

SEQ ID NO: 13354 - RNA, 23 nt, Artificial Sequence
  Synthetic
gggccccgggggcggcgccccgg

SEQ ID NO: 13355 - RNA, 24 nt, Artificial Sequence
  Synthetic
agggccccgggggcggcgccccgg

SEQ ID NO: 13356 - RNA, 18 nt, Artificial Sequence
  Synthetic
ccgugcgcggcggcccgg

SEQ ID NO: 13357 - RNA, 19 nt, Artificial Sequence
  Synthetic
gccgugcgcggcggcccgg

SEQ ID NO: 13358 - RNA, 20 nt, Artificial Sequence
  Synthetic
cgccgugcgcggcggcccgg

SEQ ID NO: 13359 - RNA, 21 nt, Artificial Sequence
  Synthetic
acgccgugcgcggcggcccgg

SEQ ID NO: 13360 - RNA, 22 nt, Artificial Sequence
  Synthetic
gacgccgugcgcggcggcccgg

SEQ ID NO: 13361 - RNA, 23 nt, Artificial Sequence
  Synthetic
cgacgccgugcgcggcggcccgg

SEQ ID NO: 13362 - RNA, 24 nt, Artificial Sequence
  Synthetic
gcgacgccgugcgcggcggcccgg

SEQ ID NO: 13363 - RNA, 18 nt, Artificial Sequence
  Synthetic
cgcccgccuccgcgccgg

SEQ ID NO: 13364 - RNA, 19 nt, Artificial Sequence
  Synthetic
gcgcccgccuccgcgccgg

SEQ ID NO: 13365 - RNA, 20 nt, Artificial Sequence
  Synthetic
cgcgcccgccuccgcgccgg

SEQ ID NO: 13366 - RNA, 21 nt, Artificial Sequence
  Synthetic
ccgcgcccgccuccgcgccgg

SEQ ID NO: 13367 - RNA, 22 nt, Artificial Sequence
  Synthetic
gccgcgcccgccuccgcgccgg

SEQ ID NO: 13368 - RNA, 23 nt, Artificial Sequence
  Synthetic
cgccgcgcccgccuccgcgccgg

SEQ ID NO: 13369 - RNA, 24 nt, Artificial Sequence
  Synthetic
gcgccgcgcccgccuccgcgccgg

SEQ ID NO: 13370 - RNA, 18 nt, Artificial Sequence
  Synthetic
ucuacucgccgcugccgg

SEQ ID NO: 13371 - RNA, 19 nt, Artificial Sequence
  Synthetic
cucuacucgccgcugccgg

SEQ ID NO: 13372 - RNA, 20 nt, Artificial Sequence
  Synthetic
ccucuacucgccgcugccgg

SEQ ID NO: 13373 - RNA, 21 nt, Artificial Sequence
  Synthetic
uccucuacucgccgcugccgg

SEQ ID NO: 13374 - RNA, 22 nt, Artificial Sequence
  Synthetic
auccucuacucgccgcugccgg

SEQ ID NO: 13375 - RNA, 23 nt, Artificial Sequence
  Synthetic
gauccucuacucgccgcugccgg

SEQ ID NO: 13376 - RNA, 24 nt, Artificial Sequence
  Synthetic
ugauccucuacucgccgcugccgg

SEQ ID NO: 13377 - RNA, 18 nt, Artificial Sequence
  Synthetic
ccgcagaccacgccgcgg

SEQ ID NO: 13378 - RNA, 19 nt, Artificial Sequence
  Synthetic
gccgcagaccacgccgcgg

SEQ ID NO: 13379 - RNA, 20 nt, Artificial Sequence
  Synthetic
cgccgcagaccacgccgcgg

SEQ ID NO: 13380 - RNA, 21 nt, Artificial Sequence
  Synthetic
gcgccgcagaccacgccgcgg

SEQ ID NO: 13381 - RNA, 22 nt, Artificial Sequence
  Synthetic
agcgccgcagaccacgccgcgg

SEQ ID NO: 13382 - RNA, 23 nt, Artificial Sequence
  Synthetic
cagcgccgcagaccacgccgcgg

SEQ ID NO: 13383 - RNA, 24 nt, Artificial Sequence
  Synthetic
ccagcgccgcagaccacgccgcgg

SEQ ID NO: 13384 - RNA, 18 nt, Artificial Sequence
  Synthetic
gagcugcgcgggccgcgg

SEQ ID NO: 13385 - RNA, 19 nt, Artificial Sequence
  Synthetic
ggagcugcgcgggccgcgg

SEQ ID NO: 13386 - RNA, 20 nt, Artificial Sequence
  Synthetic
cggagcugcgcgggccgcgg

SEQ ID NO: 13387 - RNA, 21 nt, Artificial Sequence
  Synthetic
gcggagcugcgcgggccgcgg

SEQ ID NO: 13388 - RNA, 22 nt, Artificial Sequence
  Synthetic
ggcggagcugcgcgggccgcgg

SEQ ID NO: 13389 - RNA, 23 nt, Artificial Sequence
  Synthetic
cggcggagcugcgcgggccgcgg

SEQ ID NO: 13390 - RNA, 24 nt, Artificial Sequence
  Synthetic
ccggcggagcugcgcgggccgcgg

SEQ ID NO: 13391 - RNA, 18 nt, Artificial Sequence
  Synthetic
ggggggcgcccgaggcgg

SEQ ID NO: 13392 - RNA, 19 nt, Artificial Sequence
  Synthetic
uggggggcgcccgaggcgg

SEQ ID NO: 13393 - RNA, 20 nt, Artificial Sequence
  Synthetic
cuggggggcgcccgaggcgg

SEQ ID NO: 13394 - RNA, 21 nt, Artificial Sequence
  Synthetic
ucuggggggcgcccgaggcgg

SEQ ID NO: 13395 - RNA, 22 nt, Artificial Sequence
  Synthetic
cucuggggggcgcccgaggcgg

SEQ ID NO: 13396 - RNA, 23 nt, Artificial Sequence
  Synthetic
ccucuggggggcgcccgaggcgg

SEQ ID NO: 13397 - RNA, 24 nt, Artificial Sequence
  Synthetic
gccucuggggggcgcccgaggcgg

SEQ ID NO: 13398 - RNA, 18 nt, Artificial Sequence
  Synthetic
ggcggcgggccgcuucgg

SEQ ID NO: 13399 - RNA, 19 nt, Artificial Sequence
  Synthetic
uggcggcgggccgcuucgg

SEQ ID NO: 13400 - RNA, 20 nt, Artificial Sequence
  Synthetic
auggcggcgggccgcuucgg

SEQ ID NO: 13401 - RNA, 21 nt, Artificial Sequence
  Synthetic
cauggcggcgggccgcuucgg

SEQ ID NO: 13402 - RNA, 22 nt, Artificial Sequence
  Synthetic
ccauggcggcgggccgcuucgg

SEQ ID NO: 13403 - RNA, 23 nt, Artificial Sequence
  Synthetic
gccauggcggcgggccgcuucgg

SEQ ID NO: 13404 - RNA, 24 nt, Artificial Sequence
  Synthetic
cgccauggcggcgggccgcuucgg

SEQ ID NO: 13405 - RNA, 18 nt, Artificial Sequence
  Synthetic
ggccgagcccgcccaggg

SEQ ID NO: 13406 - RNA, 19 nt, Artificial Sequence
  Synthetic
cggccgagcccgcccaggg

SEQ ID NO: 13407 - RNA, 20 nt, Artificial Sequence
  Synthetic
ccggccgagcccgcccaggg

SEQ ID NO: 13408 - RNA, 21 nt, Artificial Sequence
  Synthetic
cccggccgagcccgcccaggg

SEQ ID NO: 13409 - RNA, 22 nt, Artificial Sequence
  Synthetic
ccccggccgagcccgcccaggg

SEQ ID NO: 13410 - RNA, 23 nt, Artificial Sequence
  Synthetic
gccccggccgagcccgcccaggg

SEQ ID NO: 13411 - RNA, 24 nt, Artificial Sequence
  Synthetic
cgccccggccgagcccgcccaggg

SEQ ID NO: 13412 - RNA, 18 nt, Artificial Sequence
  Synthetic
cgcagaccacgccgcggg

SEQ ID NO: 13413 - RNA, 19 nt, Artificial Sequence
  Synthetic
ccgcagaccacgccgcggg

SEQ ID NO: 13414 - RNA, 20 nt, Artificial Sequence
  Synthetic
gccgcagaccacgccgcggg

SEQ ID NO: 13415 - RNA, 21 nt, Artificial Sequence
  Synthetic
cgccgcagaccacgccgcggg

SEQ ID NO: 13416 - RNA, 22 nt, Artificial Sequence
  Synthetic
gcgccgcagaccacgccgcggg

SEQ ID NO: 13417 - RNA, 23 nt, Artificial Sequence
  Synthetic
agcgccgcagaccacgccgcggg

SEQ ID NO: 13418 - RNA, 24 nt, Artificial Sequence
  Synthetic
cagcgccgcagaccacgccgcggg

SEQ ID NO: 13419 - RNA, 18 nt, Artificial Sequence
  Synthetic
cgcgugcuguacggcggg

SEQ ID NO: 13420 - RNA, 19 nt, Artificial Sequence
  Synthetic
gcgcgugcuguacggcggg

SEQ ID NO: 13421 - RNA, 20 nt, Artificial Sequence
  Synthetic
ggcgcgugcuguacggcggg

SEQ ID NO: 13422 - RNA, 21 nt, Artificial Sequence
  Synthetic
gggcgcgugcuguacggcggg

SEQ ID NO: 13423 - RNA, 22 nt, Artificial Sequence
  Synthetic
ggggcgcgugcuguacggcggg

SEQ ID NO: 13424 - RNA, 23 nt, Artificial Sequence
  Synthetic
cggggcgcgugcuguacggcggg

SEQ ID NO: 13425 - RNA, 24 nt, Artificial Sequence
  Synthetic
ccggggcgcgugcuguacggcggg

SEQ ID NO: 13426 - RNA, 18 nt, Artificial Sequence
  Synthetic
ccgggcggccccggcggg

SEQ ID NO: 13427 - RNA, 19 nt, Artificial Sequence
  Synthetic
gccgggcggccccggcggg

SEQ ID NO: 13428 - RNA, 20 nt, Artificial Sequence
  Synthetic
ggccgggcggccccggcggg

SEQ ID NO: 13429 - RNA, 21 nt, Artificial Sequence
  Synthetic
cggccgggcggccccggcggg

SEQ ID NO: 13430 - RNA, 22 nt, Artificial Sequence
  Synthetic
acggccgggcggccccggcggg

SEQ ID NO: 13431 - RNA, 23 nt, Artificial Sequence
  Synthetic
cacggccgggcggccccggcggg

SEQ ID NO: 13432 - RNA, 24 nt, Artificial Sequence
  Synthetic
ucacggccgggcggccccggcggg

SEQ ID NO: 13433 - RNA, 18 nt, Artificial Sequence
  Synthetic
uccggccgcguguucggg

SEQ ID NO: 13434 - RNA, 19 nt, Artificial Sequence
  Synthetic
cuccggccgcguguucggg

SEQ ID NO: 13435 - RNA, 20 nt, Artificial Sequence
  Synthetic
ccuccggccgcguguucggg

SEQ ID NO: 13436 - RNA, 21 nt, Artificial Sequence
  Synthetic
gccuccggccgcguguucggg

SEQ ID NO: 13437 - RNA, 22 nt, Artificial Sequence
  Synthetic
ggccuccggccgcguguucggg

SEQ ID NO: 13438 - RNA, 23 nt, Artificial Sequence
  Synthetic
uggccuccggccgcguguucggg

SEQ ID NO: 13439 - RNA, 24 nt, Artificial Sequence
  Synthetic
cuggccuccggccgcguguucggg

SEQ ID NO: 13440 - RNA, 18 nt, Artificial Sequence
  Synthetic
ccgcgggccgcgccgggg

SEQ ID NO: 13441 - RNA, 19 nt, Artificial Sequence
  Synthetic
gccgcgggccgcgccgggg

SEQ ID NO: 13442 - RNA, 20 nt, Artificial Sequence
  Synthetic
ggccgcgggccgcgccgggg

SEQ ID NO: 13443 - RNA, 21 nt, Artificial Sequence
  Synthetic
uggccgcgggccgcgccgggg

SEQ ID NO: 13444 - RNA, 22 nt, Artificial Sequence
  Synthetic
cuggccgcgggccgcgccgggg

SEQ ID NO: 13445 - RNA, 23 nt, Artificial Sequence
  Synthetic
ccuggccgcgggccgcgccgggg

SEQ ID NO: 13446 - RNA, 24 nt, Artificial Sequence
  Synthetic
accuggccgcgggccgcgccgggg

SEQ ID NO: 13447 - RNA, 18 nt, Artificial Sequence
  Synthetic
cccgccacggccgccugg

SEQ ID NO: 13448 - RNA, 19 nt, Artificial Sequence
  Synthetic
gcccgccacggccgccugg

SEQ ID NO: 13449 - RNA, 20 nt, Artificial Sequence
  Synthetic
ggcccgccacggccgccugg

SEQ ID NO: 13450 - RNA, 21 nt, Artificial Sequence
  Synthetic
gggcccgccacggccgccugg

SEQ ID NO: 13451 - RNA, 22 nt, Artificial Sequence
  Synthetic
cgggcccgccacggccgccugg

SEQ ID NO: 13452 - RNA, 23 nt, Artificial Sequence
  Synthetic
gcgggcccgccacggccgccugg

SEQ ID NO: 13453 - RNA, 24 nt, Artificial Sequence
  Synthetic
ugcgggcccgccacggccgccugg

SEQ ID NO: 13454 - RNA, 18 nt, Artificial Sequence
  Synthetic
ggauccuggaggcgcugg

SEQ ID NO: 13455 - RNA, 19 nt, Artificial Sequence
  Synthetic
gggauccuggaggcgcugg

SEQ ID NO: 13456 - RNA, 20 nt, Artificial Sequence
  Synthetic
cgggauccuggaggcgcugg

SEQ ID NO: 13457 - RNA, 21 nt, Artificial Sequence
  Synthetic
gcgggauccuggaggcgcugg

SEQ ID NO: 13458 - RNA, 22 nt, Artificial Sequence
  Synthetic
cgcgggauccuggaggcgcugg

SEQ ID NO: 13459 - RNA, 23 nt, Artificial Sequence
  Synthetic
ccgcgggauccuggaggcgcugg

SEQ ID NO: 13460 - RNA, 24 nt, Artificial Sequence
  Synthetic
gccgcgggauccuggaggcgcugg

SEQ ID NO: 13461 - RNA, 18 nt, Artificial Sequence
  Synthetic
cggccgugccggggcugg

SEQ ID NO: 13462 - RNA, 19 nt, Artificial Sequence
  Synthetic
gcggccgugccggggcugg

SEQ ID NO: 13463 - RNA, 20 nt, Artificial Sequence
  Synthetic
ggcggccgugccggggcugg

SEQ ID NO: 13464 - RNA, 21 nt, Artificial Sequence
  Synthetic
uggcggccgugccggggcugg

SEQ ID NO: 13465 - RNA, 22 nt, Artificial Sequence
  Synthetic
cuggcggccgugccggggcugg

SEQ ID NO: 13466 - RNA, 23 nt, Artificial Sequence
  Synthetic
ccuggcggccgugccggggcugg

SEQ ID NO: 13467 - RNA, 24 nt, Artificial Sequence
  Synthetic
accuggcggccgugccggggcugg

SEQ ID NO: 13468 - RNA, 18 nt, Artificial Sequence
  Synthetic
gcgccccgcgggccgugg

SEQ ID NO: 13469 - RNA, 19 nt, Artificial Sequence
  Synthetic
ugcgccccgcgggccgugg

SEQ ID NO: 13470 - RNA, 20 nt, Artificial Sequence
  Synthetic
cugcgccccgcgggccgugg

SEQ ID NO: 13471 - RNA, 21 nt, Artificial Sequence
  Synthetic
acugcgccccgcgggccgugg

SEQ ID NO: 13472 - RNA, 22 nt, Artificial Sequence
  Synthetic
uacugcgccccgcgggccgugg

SEQ ID NO: 13473 - RNA, 23 nt, Artificial Sequence
  Synthetic
cuacugcgccccgcgggccgugg

SEQ ID NO: 13474 - RNA, 24 nt, Artificial Sequence
  Synthetic
ccuacugcgccccgcgggccgugg

SEQ ID NO: 13475 - RNA, 18 nt, Artificial Sequence
  Synthetic
gcggcggcguggaggugg

SEQ ID NO: 13476 - RNA, 19 nt, Artificial Sequence
  Synthetic
ggcggcggcguggaggugg

SEQ ID NO: 13477 - RNA, 20 nt, Artificial Sequence
  Synthetic
gggcggcggcguggaggugg

SEQ ID NO: 13478 - RNA, 21 nt, Artificial Sequence
  Synthetic
cgggcggcggcguggaggugg

SEQ ID NO: 13479 - RNA, 22 nt, Artificial Sequence
  Synthetic
gcgggcggcggcguggaggugg

SEQ ID NO: 13480 - RNA, 23 nt, Artificial Sequence
  Synthetic
ggcgggcggcggcguggaggugg

SEQ ID NO: 13481 - RNA, 24 nt, Artificial Sequence
  Synthetic
cggcgggcggcggcguggaggugg

SEQ ID NO: 13482 - RNA, 18 nt, Artificial Sequence
  Synthetic
ccgcggagcccgcgccug

SEQ ID NO: 13483 - RNA, 19 nt, Artificial Sequence
  Synthetic
gccgcggagcccgcgccug

SEQ ID NO: 13484 - RNA, 20 nt, Artificial Sequence
  Synthetic
ugccgcggagcccgcgccug

SEQ ID NO: 13485 - RNA, 21 nt, Artificial Sequence
  Synthetic
cugccgcggagcccgcgccug

SEQ ID NO: 13486 - RNA, 22 nt, Artificial Sequence
  Synthetic
gcugccgcggagcccgcgccug

SEQ ID NO: 13487 - RNA, 23 nt, Artificial Sequence
  Synthetic
cgcugccgcggagcccgcgccug

SEQ ID NO: 13488 - RNA, 24 nt, Artificial Sequence
  Synthetic
gcgcugccgcggagcccgcgccug

SEQ ID NO: 13489 - RNA, 18 nt, Artificial Sequence
  Synthetic
gacauggacgcggagcug

SEQ ID NO: 13490 - RNA, 19 nt, Artificial Sequence
  Synthetic
ggacauggacgcggagcug

SEQ ID NO: 13491 - RNA, 20 nt, Artificial Sequence
  Synthetic
uggacauggacgcggagcug

SEQ ID NO: 13492 - RNA, 21 nt, Artificial Sequence
  Synthetic
guggacauggacgcggagcug

SEQ ID NO: 13493 - RNA, 22 nt, Artificial Sequence
  Synthetic
cguggacauggacgcggagcug

SEQ ID NO: 13494 - RNA, 23 nt, Artificial Sequence
  Synthetic
ccguggacauggacgcggagcug

SEQ ID NO: 13495 - RNA, 24 nt, Artificial Sequence
  Synthetic
cccguggacauggacgcggagcug

SEQ ID NO: 13496 - RNA, 18 nt, Artificial Sequence
  Synthetic
auccucuacucgccgcug

SEQ ID NO: 13497 - RNA, 19 nt, Artificial Sequence
  Synthetic
gauccucuacucgccgcug

SEQ ID NO: 13498 - RNA, 20 nt, Artificial Sequence
  Synthetic
ugauccucuacucgccgcug

SEQ ID NO: 13499 - RNA, 21 nt, Artificial Sequence
  Synthetic
gugauccucuacucgccgcug

SEQ ID NO: 13500 - RNA, 22 nt, Artificial Sequence
  Synthetic
ggugauccucuacucgccgcug

SEQ ID NO: 13501 - RNA, 23 nt, Artificial Sequence
  Synthetic
uggugauccucuacucgccgcug

SEQ ID NO: 13502 - RNA, 24 nt, Artificial Sequence
  Synthetic
guggugauccucuacucgccgcug

SEQ ID NO: 13503 - RNA, 18 nt, Artificial Sequence
  Synthetic
gggauccuggaggcgcug

SEQ ID NO: 13504 - RNA, 19 nt, Artificial Sequence
  Synthetic
cgggauccuggaggcgcug

SEQ ID NO: 13505 - RNA, 20 nt, Artificial Sequence
  Synthetic
gcgggauccuggaggcgcug

SEQ ID NO: 13506 - RNA, 21 nt, Artificial Sequence
  Synthetic
cgcgggauccuggaggcgcug

SEQ ID NO: 13507 - RNA, 22 nt, Artificial Sequence
  Synthetic
ccgcgggauccuggaggcgcug

SEQ ID NO: 13508 - RNA, 23 nt, Artificial Sequence
  Synthetic
gccgcgggauccuggaggcgcug

SEQ ID NO: 13509 - RNA, 24 nt, Artificial Sequence
  Synthetic
ugccgcgggauccuggaggcgcug

SEQ ID NO: 13510 - RNA, 18 nt, Artificial Sequence
  Synthetic
cagccgccccggccucug

SEQ ID NO: 13511 - RNA, 19 nt, Artificial Sequence
  Synthetic
acagccgccccggccucug

SEQ ID NO: 13512 - RNA, 20 nt, Artificial Sequence
  Synthetic
gacagccgccccggccucug

SEQ ID NO: 13513 - RNA, 21 nt, Artificial Sequence
  Synthetic
cgacagccgccccggccucug

SEQ ID NO: 13514 - RNA, 22 nt, Artificial Sequence
  Synthetic
gcgacagccgccccggccucug

SEQ ID NO: 13515 - RNA, 23 nt, Artificial Sequence
  Synthetic
ggcgacagccgccccggccucug

SEQ ID NO: 13516 - RNA, 24 nt, Artificial Sequence
  Synthetic
gggcgacagccgccccggccucug

SEQ ID NO: 13517 - RNA, 18 nt, Artificial Sequence
  Synthetic
ggcgaccuggcggccgug

SEQ ID NO: 13518 - RNA, 19 nt, Artificial Sequence
  Synthetic
cggcgaccuggcggccgug

SEQ ID NO: 13519 - RNA, 20 nt, Artificial Sequence
  Synthetic
acggcgaccuggcggccgug

SEQ ID NO: 13520 - RNA, 21 nt, Artificial Sequence
  Synthetic
gacggcgaccuggcggccgug

SEQ ID NO: 13521 - RNA, 22 nt, Artificial Sequence
  Synthetic
cgacggcgaccuggcggccgug

SEQ ID NO: 13522 - RNA, 23 nt, Artificial Sequence
  Synthetic
ucgacggcgaccuggcggccgug

SEQ ID NO: 13523 - RNA, 24 nt, Artificial Sequence
  Synthetic
uucgacggcgaccuggcggccgug

SEQ ID NO: 13524 - RNA, 18 nt, Artificial Sequence
  Synthetic
ggcggcggcguggaggug

SEQ ID NO: 13525 - RNA, 19 nt, Artificial Sequence
  Synthetic
gggcggcggcguggaggug

SEQ ID NO: 13526 - RNA, 20 nt, Artificial Sequence
  Synthetic
cgggcggcggcguggaggug

SEQ ID NO: 13527 - RNA, 21 nt, Artificial Sequence
  Synthetic
gcgggcggcggcguggaggug

SEQ ID NO: 13528 - RNA, 22 nt, Artificial Sequence
  Synthetic
ggcgggcggcggcguggaggug

SEQ ID NO: 13529 - RNA, 23 nt, Artificial Sequence
  Synthetic
cggcgggcggcggcguggaggug

SEQ ID NO: 13530 - RNA, 24 nt, Artificial Sequence
  Synthetic
gcggcgggcggcggcguggaggug

SEQ ID NO: 13531 - RNA, 18 nt, Artificial Sequence
  Synthetic
cgacagccgccccggccu

SEQ ID NO: 13532 - RNA, 19 nt, Artificial Sequence
  Synthetic
gcgacagccgccccggccu

SEQ ID NO: 13533 - RNA, 20 nt, Artificial Sequence
  Synthetic
ggcgacagccgccccggccu

SEQ ID NO: 13534 - RNA, 21 nt, Artificial Sequence
  Synthetic
gggcgacagccgccccggccu

SEQ ID NO: 13535 - RNA, 22 nt, Artificial Sequence
  Synthetic
ugggcgacagccgccccggccu

SEQ ID NO: 13536 - RNA, 23 nt, Artificial Sequence
  Synthetic
cugggcgacagccgccccggccu

SEQ ID NO: 13537 - RNA, 24 nt, Artificial Sequence
  Synthetic
gcugggcgacagccgccccggccu

SEQ ID NO: 13538 - RNA, 18 nt, Artificial Sequence
  Synthetic
agcacgccuaccuggccu

SEQ ID NO: 13539 - RNA, 19 nt, Artificial Sequence
  Synthetic
cagcacgccuaccuggccu

SEQ ID NO: 13540 - RNA, 20 nt, Artificial Sequence
  Synthetic
gcagcacgccuaccuggccu

SEQ ID NO: 13541 - RNA, 21 nt, Artificial Sequence
  Synthetic
ggcagcacgccuaccuggccu

SEQ ID NO: 13542 - RNA, 22 nt, Artificial Sequence
  Synthetic
cggcagcacgccuaccuggccu

SEQ ID NO: 13543 - RNA, 23 nt, Artificial Sequence
  Synthetic
gcggcagcacgccuaccuggccu

SEQ ID NO: 13544 - RNA, 24 nt, Artificial Sequence
  Synthetic
cgcggcagcacgccuaccuggccu

SEQ ID NO: 13545 - RNA, 18 nt, Artificial Sequence
  Synthetic
acagccgccccggccucu

SEQ ID NO: 13546 - RNA, 19 nt, Artificial Sequence
  Synthetic
gacagccgccccggccucu

SEQ ID NO: 13547 - RNA, 20 nt, Artificial Sequence
  Synthetic
cgacagccgccccggccucu

SEQ ID NO: 13548 - RNA, 21 nt, Artificial Sequence
  Synthetic
gcgacagccgccccggccucu

SEQ ID NO: 13549 - RNA, 22 nt, Artificial Sequence
  Synthetic
ggcgacagccgccccggccucu

SEQ ID NO: 13550 - RNA, 23 nt, Artificial Sequence
  Synthetic
gggcgacagccgccccggccucu

SEQ ID NO: 13551 - RNA, 24 nt, Artificial Sequence
  Synthetic
ugggcgacagccgccccggccucu

SEQ ID NO: 13552 - RNA, 18 nt, Artificial Sequence
  Synthetic
cccugggcaaccggcucu

SEQ ID NO: 13553 - RNA, 19 nt, Artificial Sequence
  Synthetic
gcccugggcaaccggcucu

SEQ ID NO: 13554 - RNA, 20 nt, Artificial Sequence
  Synthetic
ggcccugggcaaccggcucu

SEQ ID NO: 13555 - RNA, 21 nt, Artificial Sequence
  Synthetic
cggcccugggcaaccggcucu

SEQ ID NO: 13556 - RNA, 22 nt, Artificial Sequence
  Synthetic
gcggcccugggcaaccggcucu

SEQ ID NO: 13557 - RNA, 23 nt, Artificial Sequence
  Synthetic
ggcggcccugggcaaccggcucu

SEQ ID NO: 13558 - RNA, 24 nt, Artificial Sequence
  Synthetic
uggcggcccugggcaaccggcucu

SEQ ID NO: 13559 - RNA, 18 nt, Artificial Sequence
  Synthetic
ccggcgcgccggacuucu

SEQ ID NO: 13560 - RNA, 19 nt, Artificial Sequence
  Synthetic
cccggcgcgccggacuucu

SEQ ID NO: 13561 - RNA, 20 nt, Artificial Sequence
  Synthetic
gcccggcgcgccggacuucu

SEQ ID NO: 13562 - RNA, 21 nt, Artificial Sequence
  Synthetic
cgcccggcgcgccggacuucu

SEQ ID NO: 13563 - RNA, 22 nt, Artificial Sequence
  Synthetic
gcgcccggcgcgccggacuucu

SEQ ID NO: 13564 - RNA, 23 nt, Artificial Sequence
  Synthetic
ggcgcccggcgcgccggacuucu

SEQ ID NO: 13565 - RNA, 24 nt, Artificial Sequence
  Synthetic
uggcgcccggcgcgccggacuucu

SEQ ID NO: 13566 - RNA, 18 nt, Artificial Sequence
  Synthetic
gggcgccccggcgcccgu

SEQ ID NO: 13567 - RNA, 19 nt, Artificial Sequence
  Synthetic
cgggcgccccggcgcccgu

SEQ ID NO: 13568 - RNA, 20 nt, Artificial Sequence
  Synthetic
ucgggcgccccggcgcccgu

SEQ ID NO: 13569 - RNA, 21 nt, Artificial Sequence
  Synthetic
cucgggcgccccggcgcccgu

SEQ ID NO: 13570 - RNA, 22 nt, Artificial Sequence
  Synthetic
ccucgggcgccccggcgcccgu

SEQ ID NO: 13571 - RNA, 23 nt, Artificial Sequence
  Synthetic
gccucgggcgccccggcgcccgu

SEQ ID NO: 13572 - RNA, 24 nt, Artificial Sequence
  Synthetic
ggccucgggcgccccggcgcccgu

SEQ ID NO: 13573 - RNA, 18 nt, Artificial Sequence
  Synthetic
aggaggcgcgggcccggu

SEQ ID NO: 13574 - RNA, 19 nt, Artificial Sequence
  Synthetic
gaggaggcgcgggcccggu

SEQ ID NO: 13575 - RNA, 20 nt, Artificial Sequence
  Synthetic
ggaggaggcgcgggcccggu

SEQ ID NO: 13576 - RNA, 21 nt, Artificial Sequence
  Synthetic
cggaggaggcgcgggcccggu

SEQ ID NO: 13577 - RNA, 22 nt, Artificial Sequence
  Synthetic
gcggaggaggcgcgggcccggu

SEQ ID NO: 13578 - RNA, 23 nt, Artificial Sequence
  Synthetic
ggcggaggaggcgcgggcccggu

SEQ ID NO: 13579 - RNA, 24 nt, Artificial Sequence
  Synthetic
aggcggaggaggcgcgggcccggu

SEQ ID NO: 13580 - RNA, 18 nt, Artificial Sequence
  Synthetic
cggcggcguggagguggu

SEQ ID NO: 13581 - RNA, 19 nt, Artificial Sequence
  Synthetic
gcggcggcguggagguggu

SEQ ID NO: 13582 - RNA, 20 nt, Artificial Sequence
  Synthetic
ggcggcggcguggagguggu

SEQ ID NO: 13583 - RNA, 21 nt, Artificial Sequence
  Synthetic
gggcggcggcguggagguggu

SEQ ID NO: 13584 - RNA, 22 nt, Artificial Sequence
  Synthetic
cgggcggcggcguggagguggu

SEQ ID NO: 13585 - RNA, 23 nt, Artificial Sequence
  Synthetic
gcgggcggcggcguggagguggu

SEQ ID NO: 13586 - RNA, 24 nt, Artificial Sequence
  Synthetic
ggcgggcggcggcguggagguggu

SEQ ID NO: 13587 - RNA, 18 nt, Artificial Sequence
  Synthetic
acgacgacgacggacugu

SEQ ID NO: 13588 - RNA, 19 nt, Artificial Sequence
  Synthetic
gacgacgacgacggacugu

SEQ ID NO: 13589 - RNA, 20 nt, Artificial Sequence
  Synthetic
ggacgacgacgacggacugu

SEQ ID NO: 13590 - RNA, 21 nt, Artificial Sequence
  Synthetic
aggacgacgacgacggacugu

SEQ ID NO: 13591 - RNA, 22 nt, Artificial Sequence
  Synthetic
gaggacgacgacgacggacugu

SEQ ID NO: 13592 - RNA, 23 nt, Artificial Sequence
  Synthetic
ggaggacgacgacgacggacugu

SEQ ID NO: 13593 - RNA, 24 nt, Artificial Sequence
  Synthetic
uggaggacgacgacgacggacugu

SEQ ID NO: 13594 - RNA, 18 nt, Artificial Sequence
  Synthetic
uggccuccggccgcgugu

SEQ ID NO: 13595 - RNA, 19 nt, Artificial Sequence
  Synthetic
cuggccuccggccgcgugu

SEQ ID NO: 13596 - RNA, 20 nt, Artificial Sequence
  Synthetic
gcuggccuccggccgcgugu

SEQ ID NO: 13597 - RNA, 21 nt, Artificial Sequence
  Synthetic
ugcuggccuccggccgcgugu

SEQ ID NO: 13598 - RNA, 22 nt, Artificial Sequence
  Synthetic
gugcuggccuccggccgcgugu

SEQ ID NO: 13599 - RNA, 23 nt, Artificial Sequence
  Synthetic
cgugcuggccuccggccgcgugu

SEQ ID NO: 13600 - RNA, 24 nt, Artificial Sequence
  Synthetic
ccgugcuggccuccggccgcgugu

SEQ ID NO: 13601 - RNA, 18 nt, Artificial Sequence
  Synthetic
cgacgacgacggacuguu

SEQ ID NO: 13602 - RNA, 19 nt, Artificial Sequence
  Synthetic
acgacgacgacggacuguu

SEQ ID NO: 13603 - RNA, 20 nt, Artificial Sequence
  Synthetic
gacgacgacgacggacuguu

SEQ ID NO: 13604 - RNA, 21 nt, Artificial Sequence
  Synthetic
ggacgacgacgacggacuguu

SEQ ID NO: 13605 - RNA, 22 nt, Artificial Sequence
  Synthetic
aggacgacgacgacggacuguu

SEQ ID NO: 13606 - RNA, 23 nt, Artificial Sequence
  Synthetic
gaggacgacgacgacggacuguu

SEQ ID NO: 13607 - RNA, 24 nt, Artificial Sequence
  Synthetic
ggaggacgacgacgacggacuguu

SEQ ID NO: 13608 - RNA, 18 nt, Artificial Sequence
  Synthetic
gacgacgacggacuguuu

SEQ ID NO: 13609 - RNA, 19 nt, Artificial Sequence
  Synthetic
cgacgacgacggacuguuu

SEQ ID NO: 13610 - RNA, 20 nt, Artificial Sequence
  Synthetic
acgacgacgacggacuguuu

SEQ ID NO: 13611 - RNA, 21 nt, Artificial Sequence
  Synthetic
gacgacgacgacggacuguuu

SEQ ID NO: 13612 - RNA, 22 nt, Artificial Sequence
  Synthetic
ggacgacgacgacggacuguuu

SEQ ID NO: 13613 - RNA, 23 nt, Artificial Sequence
  Synthetic
aggacgacgacgacggacuguuu

SEQ ID NO: 13614 - RNA, 24 nt, Artificial Sequence
  Synthetic
gaggacgacgacgacggacuguuu

SEQ ID NO: 13615 - RNA, 17 nt, Artificial Sequence
  Synthetic
ggcggagaaggcgagcg

SEQ ID NO: 13616 - RNA, 17 nt, Artificial Sequence
  Synthetic
cggacccccuccaugcg

SEQ ID NO: 13617 - RNA, 20 nt, Artificial Sequence
  Synthetic
cgcggcggagaaggcgagcg

SEQ ID NO: 13618 - RNA, 20 nt, Artificial Sequence
  Synthetic
ccgcggacccccuccaugcg

SEQ ID NO: 13619 - RNA, 17 nt, Artificial Sequence
  Synthetic
gacgccgacgacgagga

SEQ ID NO: 13620 - RNA, 17 nt, Artificial Sequence
  Synthetic
ugcgguaccgcgugcgc

SEQ ID NO: 13621 - RNA, 17 nt, Artificial Sequence
  Synthetic
uggccggggcggggcuc

SEQ ID NO: 13622 - RNA, 17 nt, Artificial Sequence
  Synthetic
acguggcgcuggaccag

SEQ ID NO: 13623 - RNA, 17 nt, Artificial Sequence
  Synthetic
gcuacgaccgcgcgcag

SEQ ID NO: 13624 - RNA, 17 nt, Artificial Sequence
  Synthetic
ccggccgcgacgccacg

SEQ ID NO: 13625 - RNA, 17 nt, Artificial Sequence
  Synthetic
acggggcggcggcggcg

SEQ ID NO: 13626 - RNA, 17 nt, Artificial Sequence
  Synthetic
gguacgccauggcggcg

SEQ ID NO: 13627 - RNA, 17 nt, Artificial Sequence
  Synthetic
uccuggaggcgcuggcg

SEQ ID NO: 13628 - RNA, 20 nt, Artificial Sequence
  Synthetic
gaggacgccgacgacgagga

SEQ ID NO: 13629 - RNA, 20 nt, Artificial Sequence
  Synthetic
acgugcgguaccgcgugcgc

SEQ ID NO: 13630 - RNA, 20 nt, Artificial Sequence
  Synthetic
cccuggccggggcggggcuc

SEQ ID NO: 13631 - RNA, 20 nt, Artificial Sequence
  Synthetic
gggacguggcgcuggaccag

SEQ ID NO: 13632 - RNA, 20 nt, Artificial Sequence
  Synthetic
gccgcuacgaccgcgcgcag

SEQ ID NO: 13633 - RNA, 20 nt, Artificial Sequence
  Synthetic
uggccggccgcgacgccacg

SEQ ID NO: 13634 - RNA, 20 nt, Artificial Sequence
  Synthetic
gcaacggggcggcggcggcg

SEQ ID NO: 13635 - RNA, 20 nt, Artificial Sequence
  Synthetic
ugggguacgccauggcggcg

SEQ ID NO: 13636 - RNA, 20 nt, Artificial Sequence
  Synthetic
ggauccuggaggcgcuggcg

SEQ ID NO: 13637 - RNA, 17 nt, Artificial Sequence
  Synthetic
ggcgggcccaccccgaa

SEQ ID NO: 13638 - RNA, 17 nt, Artificial Sequence
  Synthetic
gagcgcggcugccgaca

SEQ ID NO: 13639 - RNA, 17 nt, Artificial Sequence
  Synthetic
ggacggcgggcggccca

SEQ ID NO: 13640 - RNA, 17 nt, Artificial Sequence
  Synthetic
gggcucauauaguccca

SEQ ID NO: 13641 - RNA, 17 nt, Artificial Sequence
  Synthetic
gcggacgaagcgcggga

SEQ ID NO: 13642 - RNA, 17 nt, Artificial Sequence
  Synthetic
gacgacgcccggcggga

SEQ ID NO: 13643 - RNA, 17 nt, Artificial Sequence
  Synthetic
gcgcggcgagcgucuga

SEQ ID NO: 13644 - RNA, 17 nt, Artificial Sequence
  Synthetic
gcacgguaggucaccua

SEQ ID NO: 13645 - RNA, 17 nt, Artificial Sequence
  Synthetic
gcccggggacggccaac

SEQ ID NO: 13646 - RNA, 17 nt, Artificial Sequence
  Synthetic
gcaugcuaacgaggaac

SEQ ID NO: 13647 - RNA, 17 nt, Artificial Sequence
  Synthetic
gcggaacuagcgcggac

SEQ ID NO: 13648 - RNA, 17 nt, Artificial Sequence
  Synthetic
gcccguuggccgucccc

SEQ ID NO: 13649 - RNA, 17 nt, Artificial Sequence
  Synthetic
gauccacgacccgacgc

SEQ ID NO: 13650 - RNA, 17 nt, Artificial Sequence
  Synthetic
guucggggugggcccgc

SEQ ID NO: 13651 - RNA, 17 nt, Artificial Sequence
  Synthetic
gcuaacgaggaacgggc

SEQ ID NO: 13652 - RNA, 17 nt, Artificial Sequence
  Synthetic
gacgccaucgccgaugc

SEQ ID NO: 13653 - RNA, 17 nt, Artificial Sequence
  Synthetic
gcggaaaccgccggauc

SEQ ID NO: 13654 - RNA, 17 nt, Artificial Sequence
  Synthetic
gaugcggggcgauccuc

SEQ ID NO: 13655 - RNA, 17 nt, Artificial Sequence
  Synthetic
gucugacggucugucuc

SEQ ID NO: 13656 - RNA, 17 nt, Artificial Sequence
  Synthetic
gcccagaccgcgacgag

SEQ ID NO: 13657 - RNA, 17 nt, Artificial Sequence
  Synthetic
ggauccacgacccgacg

SEQ ID NO: 13658 - RNA, 17 nt, Artificial Sequence
  Synthetic
gacccccgccgucgacg

SEQ ID NO: 13659 - RNA, 17 nt, Artificial Sequence
  Synthetic
gccgggacgccgauacg

SEQ ID NO: 13660 - RNA, 17 nt, Artificial Sequence
  Synthetic
guucgaccaacgggccg

SEQ ID NO: 13661 - RNA, 17 nt, Artificial Sequence
  Synthetic
ggggucgucgggguccg

SEQ ID NO: 13662 - RNA, 17 nt, Artificial Sequence
  Synthetic
gauacgcggacgaagcg

SEQ ID NO: 13663 - RNA, 17 nt, Artificial Sequence
  Synthetic
guuccgcgucgacggcg

SEQ ID NO: 13664 - RNA, 17 nt, Artificial Sequence
  Synthetic
guaucggcgucccggcg

SEQ ID NO: 13665 - RNA, 17 nt, Artificial Sequence
  Synthetic
gauggcgcggaugggcg

SEQ ID NO: 13666 - RNA, 17 nt, Artificial Sequence
  Synthetic
gucgcggucugggcucg

SEQ ID NO: 13667 - RNA, 17 nt, Artificial Sequence
  Synthetic
gccgaaccgggaagucg

SEQ ID NO: 13668 - RNA, 17 nt, Artificial Sequence
  Synthetic
gggccccccgcucgucg

SEQ ID NO: 13669 - RNA, 17 nt, Artificial Sequence
  Synthetic
gacggcgggggucgucg

SEQ ID NO: 13670 - RNA, 17 nt, Artificial Sequence
  Synthetic
gggcgucgucgaggucg

SEQ ID NO: 13671 - RNA, 17 nt, Artificial Sequence
  Synthetic
ggauacggcugcgacgg

SEQ ID NO: 13672 - RNA, 17 nt, Artificial Sequence
  Synthetic
gaaaccgccggaucggg

SEQ ID NO: 13673 - RNA, 17 nt, Artificial Sequence
  Synthetic
gcgugccggcgucgggg

SEQ ID NO: 13674 - RNA, 17 nt, Artificial Sequence
  Synthetic
gccggccaauggggggg

SEQ ID NO: 13675 - RNA, 17 nt, Artificial Sequence
  Synthetic
gcgccaucugccauggg

SEQ ID NO: 13676 - RNA, 17 nt, Artificial Sequence
  Synthetic
gcgucgucgaggucgug

SEQ ID NO: 13677 - RNA, 17 nt, Artificial Sequence
  Synthetic
ggaggaucgccccgcau

SEQ ID NO: 13678 - RNA, 17 nt, Artificial Sequence
  Synthetic
gcgcuucguccgcguau

SEQ ID NO: 13679 - RNA, 17 nt, Artificial Sequence
  Synthetic
gacgagcggggggcccu

SEQ ID NO: 13680 - RNA, 17 nt, Artificial Sequence
  Synthetic
gacgaucggggcguccu

SEQ ID NO: 13681 - RNA, 17 nt, Artificial Sequence
  Synthetic
gcggaccggucgaugcu

SEQ ID NO: 13682 - RNA, 17 nt, Artificial Sequence
  Synthetic
gccgcccgccgucccgu

SEQ ID NO: 13683 - RNA, 17 nt, Artificial Sequence
  Synthetic
ggcgucgucgaggucgu

SEQ ID NO: 13684 - RNA, 17 nt, Artificial Sequence
  Synthetic
ggcggacguagcacggu

SEQ ID NO: 13685 - RNA, 17 nt, Artificial Sequence
  Synthetic
ggcggcggcccgucggu

SEQ ID NO: 13686 - RNA, 17 nt, Artificial Sequence
  Synthetic
ggaauuccguucggggu

SEQ ID NO: 13687 - RNA, 17 nt, Artificial Sequence
  Synthetic
gggucguggauccgugu

SEQ ID NO: 13688 - RNA, 20 nt, Artificial Sequence
  Synthetic
gggggcccggggacggccaa

SEQ ID NO: 13689 - RNA, 20 nt, Artificial Sequence
  Synthetic
ggaucgccccgcaucggcga

SEQ ID NO: 13690 - RNA, 20 nt, Artificial Sequence
  Synthetic
ggucaccuacggacucucga

SEQ ID NO: 13691 - RNA, 20 nt, Artificial Sequence
  Synthetic
ggacgccgggaccaacggga

SEQ ID NO: 13692 - RNA, 20 nt, Artificial Sequence
  Synthetic
guagcacgguaggucaccua

SEQ ID NO: 13693 - RNA, 20 nt, Artificial Sequence
  Synthetic
ggggcccggggacggccaac

SEQ ID NO: 13694 - RNA, 20 nt, Artificial Sequence
  Synthetic
guaucucauuaccgccgaac

SEQ ID NO: 13695 - RNA, 20 nt, Artificial Sequence
  Synthetic
gaccaacgggccgcggccac

SEQ ID NO: 13696 - RNA, 20 nt, Artificial Sequence
  Synthetic
gcuccccgggccccaccgac

SEQ ID NO: 13697 - RNA, 20 nt, Artificial Sequence
  Synthetic
gacgcggaacuagcgcggac

SEQ ID NO: 13698 - RNA, 20 nt, Artificial Sequence
  Synthetic
gaaccgggaagucggggccc

SEQ ID NO: 13699 - RNA, 20 nt, Artificial Sequence
  Synthetic
gcggcccgucgguggggccc

SEQ ID NO: 13700 - RNA, 20 nt, Artificial Sequence
  Synthetic
gcgcgcccguuggccguccc

SEQ ID NO: 13701 - RNA, 20 nt, Artificial Sequence
  Synthetic
gcccgccgucccguuggucc

SEQ ID NO: 13702 - RNA, 20 nt, Artificial Sequence
  Synthetic
gagcccagaccgcgacgagc

SEQ ID NO: 13703 - RNA, 20 nt, Artificial Sequence
  Synthetic
gcuaguuccgcgucgacggc

SEQ ID NO: 13704 - RNA, 20 nt, Artificial Sequence
  Synthetic
ggugggcccgccgggggggc

SEQ ID NO: 13705 - RNA, 20 nt, Artificial Sequence
  Synthetic
gccacgggcccccggcgugc

SEQ ID NO: 13706 - RNA, 20 nt, Artificial Sequence
  Synthetic
gaagcggaaaccgccggauc

SEQ ID NO: 13707 - RNA, 20 nt, Artificial Sequence
  Synthetic
gcgacgagcggggggcccuc

SEQ ID NO: 13708 - RNA, 20 nt, Artificial Sequence
  Synthetic
gccgaugcggggcgauccuc

SEQ ID NO: 13709 - RNA, 20 nt, Artificial Sequence
  Synthetic
gcucgucgcggucugggcuc

SEQ ID NO: 13710 - RNA, 20 nt, Artificial Sequence
  Synthetic
gucucuggcggucccgcguc

SEQ ID NO: 13711 - RNA, 20 nt, Artificial Sequence
  Synthetic
gucccguuggucccggcguc

SEQ ID NO: 13712 - RNA, 20 nt, Artificial Sequence
  Synthetic
gccccccgcucgucgcgguc

SEQ ID NO: 13713 - RNA, 20 nt, Artificial Sequence
  Synthetic
guuagcaugcggaacggaag

SEQ ID NO: 13714 - RNA, 20 nt, Artificial Sequence
  Synthetic
gacgacccccgccgucgacg

SEQ ID NO: 13715 - RNA, 20 nt, Artificial Sequence
  Synthetic
gcguccggcgggcgggaccg

SEQ ID NO: 13716 - RNA, 20 nt, Artificial Sequence
  Synthetic
gccggcacgccgggggcccg

SEQ ID NO: 13717 - RNA, 20 nt, Artificial Sequence
  Synthetic
gccccgacgccggcacgccg

SEQ ID NO: 13718 - RNA, 20 nt, Artificial Sequence
  Synthetic
gggguucgaccaacgggccg

SEQ ID NO: 13719 - RNA, 20 nt, Artificial Sequence
  Synthetic
gccgauacgcggacgaagcg

SEQ ID NO: 13720 - RNA, 20 nt, Artificial Sequence
  Synthetic
ggacggccaacgggcgcgcg

SEQ ID NO: 13721 - RNA, 20 nt, Artificial Sequence
  Synthetic
gucgacggcgggggucgucg

SEQ ID NO: 13722 - RNA, 20 nt, Artificial Sequence
  Synthetic
gccgggcgucgucgaggucg

SEQ ID NO: 13723 - RNA, 20 nt, Artificial Sequence
  Synthetic
ggcggucccgcgucgggucg

SEQ ID NO: 13724 - RNA, 20 nt, Artificial Sequence
  Synthetic
gcauaauggaauuccguucg

SEQ ID NO: 13725 - RNA, 20 nt, Artificial Sequence
  Synthetic
ggacucucgauggggggagg

SEQ ID NO: 13726 - RNA, 20 nt, Artificial Sequence
  Synthetic
guucggggugggcccgccgg

SEQ ID NO: 13727 - RNA, 20 nt, Artificial Sequence
  Synthetic
gcccagaccgcgacgagcgg

SEQ ID NO: 13728 - RNA, 20 nt, Artificial Sequence
  Synthetic
gccccgacuucccgguucgg

SEQ ID NO: 13729 - RNA, 20 nt, Artificial Sequence
  Synthetic
gggaccaacgggacggcggg

SEQ ID NO: 13730 - RNA, 20 nt, Artificial Sequence
  Synthetic
gcggaaaccgccggaucggg

SEQ ID NO: 13731 - RNA, 20 nt, Artificial Sequence
  Synthetic
gucugacggucugucucugg

SEQ ID NO: 13732 - RNA, 20 nt, Artificial Sequence
  Synthetic
gggcgucgucgaggucgugg

SEQ ID NO: 13733 - RNA, 20 nt, Artificial Sequence
  Synthetic
ggcgguaaugagaugccaug

SEQ ID NO: 13734 - RNA, 20 nt, Artificial Sequence
  Synthetic
gcccguuccucguuagcaug

SEQ ID NO: 13735 - RNA, 20 nt, Artificial Sequence
  Synthetic
gucaccuacggacucucgau

SEQ ID NO: 13736 - RNA, 20 nt, Artificial Sequence
  Synthetic
ggaagcggaaaccgccggau

SEQ ID NO: 13737 - RNA, 20 nt, Artificial Sequence
  Synthetic
ggcccguggccgcggcccgu

SEQ ID NO: 13738 - RNA, 20 nt, Artificial Sequence
  Synthetic
ggcccccggcgugccggcgu

SEQ ID NO: 13739 - RNA, 20 nt, Artificial Sequence
  Synthetic
gcgucgacggcgggggucgu

SEQ ID NO: 13740 - RNA, 20 nt, Artificial Sequence
  Synthetic
gacggcggacguagcacggu

SEQ ID NO: 13741 - RNA, 20 nt, Artificial Sequence
  Synthetic
gucgggucguggauccgugu

SEQ ID NO: 13742 - RNA, 20 nt, Artificial Sequence
  Synthetic
gcgcggaccggucgaugcuu

SEQ ID NO: 13743 - RNA, 20 nt, Artificial Sequence
  Synthetic
gugcauaauggaauuccguu

SEQ ID NO: 13744 - RNA, 17 nt, Artificial Sequence
  Synthetic
ucccgcccgccggccaa

SEQ ID NO: 13745 - RNA, 17 nt, Artificial Sequence
  Synthetic
cgcaugcuaacgaggaa

SEQ ID NO: 13746 - RNA, 17 nt, Artificial Sequence
  Synthetic
cucguuagcaugcggaa

SEQ ID NO: 13747 - RNA, 17 nt, Artificial Sequence
  Synthetic
ccaacgggccgcggcca

SEQ ID NO: 13748 - RNA, 17 nt, Artificial Sequence
  Synthetic
auccgcgccaucugcca

SEQ ID NO: 13749 - RNA, 17 nt, Artificial Sequence
  Synthetic
cgacggcggacguagca

SEQ ID NO: 13750 - RNA, 17 nt, Artificial Sequence
  Synthetic
ucgccccgcaucggcga

SEQ ID NO: 13751 - RNA, 17 nt, Artificial Sequence
  Synthetic
cggggauacggcugcga

SEQ ID NO: 13752 - RNA, 17 nt, Artificial Sequence
  Synthetic
caccuacggacucucga

SEQ ID NO: 13753 - RNA, 17 nt, Artificial Sequence
  Synthetic
cgcuaguuccgcgucga

SEQ ID NO: 13754 - RNA, 17 nt, Artificial Sequence
  Synthetic
cgccgggaccaacggga

SEQ ID NO: 13755 - RNA, 17 nt, Artificial Sequence
  Synthetic
ccggggguucgaccaac

SEQ ID NO: 13756 - RNA, 17 nt, Artificial Sequence
  Synthetic
ucucauuaccgccgaac

SEQ ID NO: 13757 - RNA, 17 nt, Artificial Sequence
  Synthetic
caacgggccgcggccac

SEQ ID NO: 13758 - RNA, 17 nt, Artificial Sequence
  Synthetic
cguccggcgggcgggac

SEQ ID NO: 13759 - RNA, 17 nt, Artificial Sequence
  Synthetic
cccguuggucgaacccc

SEQ ID NO: 13760 - RNA, 17 nt, Artificial Sequence
  Synthetic
cgucgcagccguauccc

SEQ ID NO: 13761 - RNA, 17 nt, Artificial Sequence
  Synthetic
cgggcucauauaguccc

SEQ ID NO: 13762 - RNA, 17 nt, Artificial Sequence
  Synthetic
cgcccguuggccguccc

SEQ ID NO: 13763 - RNA, 17 nt, Artificial Sequence
  Synthetic
cccgacgccggcacgcc

SEQ ID NO: 13764 - RNA, 17 nt, Artificial Sequence
  Synthetic
acgaccucgacgacgcc

SEQ ID NO: 13765 - RNA, 17 nt, Artificial Sequence
  Synthetic
uucggggugggcccgcc

SEQ ID NO: 13766 - RNA, 17 nt, Artificial Sequence
  Synthetic
augcggggcgauccucc

SEQ ID NO: 13767 - RNA, 17 nt, Artificial Sequence
  Synthetic
uccgcguaucggcgucc

SEQ ID NO: 13768 - RNA, 17 nt, Artificial Sequence
  Synthetic
cgccgucccguuggucc

SEQ ID NO: 13769 - RNA, 17 nt, Artificial Sequence
  Synthetic
cccagaccgcgacgagc

SEQ ID NO: 13770 - RNA, 17 nt, Artificial Sequence
  Synthetic
acggaagcggaaaccgc

SEQ ID NO: 13771 - RNA, 17 nt, Artificial Sequence
  Synthetic
auacgcggacgaagcgc

SEQ ID NO: 13772 - RNA, 17 nt, Artificial Sequence
  Synthetic
ucagacgcucgccgcgc

SEQ ID NO: 13773 - RNA, 17 nt, Artificial Sequence
  Synthetic
acggccaacgggcgcgc

SEQ ID NO: 13774 - RNA, 17 nt, Artificial Sequence
  Synthetic
aguuccgcgucgacggc

SEQ ID NO: 13775 - RNA, 17 nt, Artificial Sequence
  Synthetic
ccucgacgacgcccggc

SEQ ID NO: 13776 - RNA, 17 nt, Artificial Sequence
  Synthetic
agauggcgcggaugggc

SEQ ID NO: 13777 - RNA, 17 nt, Artificial Sequence
  Synthetic
acgggcccccggcgugc

SEQ ID NO: 13778 - RNA, 17 nt, Artificial Sequence
  Synthetic
cucauuaccgcccgauc

SEQ ID NO: 13779 - RNA, 17 nt, Artificial Sequence
  Synthetic
acgagcggggggcccuc

SEQ ID NO: 13780 - RNA, 17 nt, Artificial Sequence
  Synthetic
acgaucggggcguccuc

SEQ ID NO: 13781 - RNA, 17 nt, Artificial Sequence
  Synthetic
cgucgcggucugggcuc

SEQ ID NO: 13782 - RNA, 17 nt, Artificial Sequence
  Synthetic
cgccgaaccgggaaguc

SEQ ID NO: 13783 - RNA, 17 nt, Artificial Sequence
  Synthetic
ucuggcggucccgcguc

SEQ ID NO: 13784 - RNA, 17 nt, Artificial Sequence
  Synthetic
ccguuggucccggcguc

SEQ ID NO: 13785 - RNA, 17 nt, Artificial Sequence
  Synthetic
cgacggcgggggucguc

SEQ ID NO: 13786 - RNA, 17 nt, Artificial Sequence
  Synthetic
ccccgcucgucgcgguc

SEQ ID NO: 13787 - RNA, 17 nt, Artificial Sequence
  Synthetic
agcaugcggaacggaag

SEQ ID NO: 13788 - RNA, 17 nt, Artificial Sequence
  Synthetic
uaacgaggaacgggcag

SEQ ID NO: 13789 - RNA, 17 nt, Artificial Sequence
  Synthetic
cggacgaagcgcgggag

SEQ ID NO: 13790 - RNA, 17 nt, Artificial Sequence
  Synthetic
acucucgauggggggag

SEQ ID NO: 13791 - RNA, 17 nt, Artificial Sequence
  Synthetic
cguuccgcaugcuaacg

SEQ ID NO: 13792 - RNA, 17 nt, Artificial Sequence
  Synthetic
ccgacgccggcacgccg

SEQ ID NO: 13793 - RNA, 17 nt, Artificial Sequence
  Synthetic
ccagaccgcgacgagcg

SEQ ID NO: 13794 - RNA, 17 nt, Artificial Sequence
  Synthetic
ucgacgcggaacuagcg

SEQ ID NO: 13795 - RNA, 17 nt, Artificial Sequence
  Synthetic
agaugccaugcggggcg

SEQ ID NO: 13796 - RNA, 17 nt, Artificial Sequence
  Synthetic
acgccaucgccgaugcg

SEQ ID NO: 13797 - RNA, 17 nt, Artificial Sequence
  Synthetic
ccggcgugccggcgucg

SEQ ID NO: 13798 - RNA, 17 nt, Artificial Sequence
  Synthetic
cccgccgggcgucgucg

SEQ ID NO: 13799 - RNA, 17 nt, Artificial Sequence
  Synthetic
uaauggaauuccguucg

SEQ ID NO: 13800 - RNA, 17 nt, Artificial Sequence
  Synthetic
aacgaggaacgggcagg

SEQ ID NO: 13801 - RNA, 17 nt, Artificial Sequence
  Synthetic
uaguuccgcgucgacgg

SEQ ID NO: 13802 - RNA, 17 nt, Artificial Sequence
  Synthetic
cgggaccaacgggacgg

SEQ ID NO: 13803 - RNA, 17 nt, Artificial Sequence
  Synthetic
cgcagccguauccccgg

SEQ ID NO: 13804 - RNA, 17 nt, Artificial Sequence
  Synthetic
accucgacgacgcccgg

SEQ ID NO: 13805 - RNA, 17 nt, Artificial Sequence
  Synthetic
cgacgccggcacgccgg

SEQ ID NO: 13806 - RNA, 17 nt, Artificial Sequence
  Synthetic
auuaccgcccgauccgg

SEQ ID NO: 13807 - RNA, 17 nt, Artificial Sequence
  Synthetic
uuggucccggcguccgg

SEQ ID NO: 13808 - RNA, 17 nt, Artificial Sequence
  Synthetic
cagaccgcgacgagcgg

SEQ ID NO: 13809 - RNA, 17 nt, Artificial Sequence
  Synthetic
uuccgcgucgacggcgg

SEQ ID NO: 13810 - RNA, 17 nt, Artificial Sequence
  Synthetic
ccgacuucccgguucgg

SEQ ID NO: 13811 - RNA, 17 nt, Artificial Sequence
  Synthetic
agaccgcgacgagcggg

SEQ ID NO: 13812 - RNA, 17 nt, Artificial Sequence
  Synthetic
cgcggacgaagcgcggg

SEQ ID NO: 13813 - RNA, 17 nt, Artificial Sequence
  Synthetic
ucccggcguccggcggg

SEQ ID NO: 13814 - RNA, 17 nt, Artificial Sequence
  Synthetic
uggaauuccguucgggg

SEQ ID NO: 13815 - RNA, 17 nt, Artificial Sequence
  Synthetic
cgucgaggucguggggg

SEQ ID NO: 13816 - RNA, 17 nt, Artificial Sequence
  Synthetic
uacggacucucgauggg

SEQ ID NO: 13817 - RNA, 17 nt, Artificial Sequence
  Synthetic
accggucgaugcuuggg

SEQ ID NO: 13818 - RNA, 17 nt, Artificial Sequence
  Synthetic
cgcccgccggccaaugg

SEQ ID NO: 13819 - RNA, 17 nt, Artificial Sequence
  Synthetic
cuacggacucucgaugg

SEQ ID NO: 13820 - RNA, 17 nt, Artificial Sequence
  Synthetic
cgucgucgaggucgugg

SEQ ID NO: 13821 - RNA, 17 nt, Artificial Sequence
  Synthetic
ccgcccgccggccaaug

SEQ ID NO: 13822 - RNA, 17 nt, Artificial Sequence
  Synthetic
cguuccucguuagcaug

SEQ ID NO: 13823 - RNA, 17 nt, Artificial Sequence
  Synthetic
cgacgccaucgccgaug

SEQ ID NO: 13824 - RNA, 17 nt, Artificial Sequence
  Synthetic
ccuacggacucucgaug

SEQ ID NO: 13825 - RNA, 17 nt, Artificial Sequence
  Synthetic
ccuugccgcccccccau

SEQ ID NO: 13826 - RNA, 17 nt, Artificial Sequence
  Synthetic
uccgcgccaucugccau

SEQ ID NO: 13827 - RNA, 17 nt, Artificial Sequence
  Synthetic
accuacggacucucgau

SEQ ID NO: 13828 - RNA, 17 nt, Artificial Sequence
  Synthetic
agcggaaaccgccggau

SEQ ID NO: 13829 - RNA, 17 nt, Artificial Sequence
  Synthetic
uggcagauggcgcggau

SEQ ID NO: 13830 - RNA, 17 nt, Artificial Sequence
  Synthetic
ucgucgcggucugggcu

SEQ ID NO: 13831 - RNA, 17 nt, Artificial Sequence
  Synthetic
cccgcucgucgcggucu

SEQ ID NO: 13832 - RNA, 17 nt, Artificial Sequence
  Synthetic
ccgccgaaccgggaagu

SEQ ID NO: 13833 - RNA, 17 nt, Artificial Sequence
  Synthetic
ccguggccgcggcccgu

SEQ ID NO: 13834 - RNA, 17 nt, Artificial Sequence
  Synthetic
ccccaucgagaguccgu

SEQ ID NO: 13835 - RNA, 17 nt, Artificial Sequence
  Synthetic
cucuggcggucccgcgu

SEQ ID NO: 13836 - RNA, 17 nt, Artificial Sequence
  Synthetic
ccccggcgugccggcgu

SEQ ID NO: 13837 - RNA, 17 nt, Artificial Sequence
  Synthetic
cgcaucggcgauggcgu

SEQ ID NO: 13838 - RNA, 17 nt, Artificial Sequence
  Synthetic
ucgacggcgggggucgu

SEQ ID NO: 13839 - RNA, 17 nt, Artificial Sequence
  Synthetic
ccggucgaugcuugggu

SEQ ID NO: 13840 - RNA, 17 nt, Artificial Sequence
  Synthetic
cggaccggucgaugcuu

SEQ ID NO: 13841 - RNA, 20 nt, Artificial Sequence
  Synthetic
ucgaugcuugggugggaaaa

SEQ ID NO: 13842 - RNA, 20 nt, Artificial Sequence
  Synthetic
cgggacggcgggcggcccaa

SEQ ID NO: 13843 - RNA, 20 nt, Artificial Sequence
  Synthetic
cggucccgcccgccggccaa

SEQ ID NO: 13844 - RNA, 20 nt, Artificial Sequence
  Synthetic
uuccgcaugcuaacgaggaa

SEQ ID NO: 13845 - RNA, 20 nt, Artificial Sequence
  Synthetic
uuccucguuagcaugcggaa

SEQ ID NO: 13846 - RNA, 20 nt, Artificial Sequence
  Synthetic
acggagcgcggcugccgaca

SEQ ID NO: 13847 - RNA, 20 nt, Artificial Sequence
  Synthetic
acgggacggcgggcggccca

SEQ ID NO: 13848 - RNA, 20 nt, Artificial Sequence
  Synthetic
cucgggcucauauaguccca

SEQ ID NO: 13849 - RNA, 20 nt, Artificial Sequence
  Synthetic
cugcgacggcggacguagca

SEQ ID NO: 13850 - RNA, 20 nt, Artificial Sequence
  Synthetic
augcuaacgaggaacgggca

SEQ ID NO: 13851 - RNA, 20 nt, Artificial Sequence
  Synthetic
ccucggguggggcgcggaga

SEQ ID NO: 13852 - RNA, 20 nt, Artificial Sequence
  Synthetic
cgucuccgcgccccacccga

SEQ ID NO: 13853 - RNA, 20 nt, Artificial Sequence
  Synthetic
cuccggggauacggcugcga

SEQ ID NO: 13854 - RNA, 20 nt, Artificial Sequence
  Synthetic
ccgcgcuaguuccgcgucga

SEQ ID NO: 13855 - RNA, 20 nt, Artificial Sequence
  Synthetic
cccauggcagauggcgcgga

SEQ ID NO: 13856 - RNA, 20 nt, Artificial Sequence
  Synthetic
uacgcggacgaagcgcggga

SEQ ID NO: 13857 - RNA, 20 nt, Artificial Sequence
  Synthetic
acggacucucgaugggggga

SEQ ID NO: 13858 - RNA, 20 nt, Artificial Sequence
  Synthetic
ccggcgcggcgagcgucuga

SEQ ID NO: 13859 - RNA, 20 nt, Artificial Sequence
  Synthetic
cgccggacgccgggaccaac

SEQ ID NO: 13860 - RNA, 20 nt, Artificial Sequence
  Synthetic
uccgcaugcuaacgaggaac

SEQ ID NO: 13861 - RNA, 20 nt, Artificial Sequence
  Synthetic
ucgacgacgcccggcgggac

SEQ ID NO: 13862 - RNA, 20 nt, Artificial Sequence
  Synthetic
uaucucauuaccgccgaacc

SEQ ID NO: 13863 - RNA, 20 nt, Artificial Sequence
  Synthetic
cggcccguuggucgaacccc

SEQ ID NO: 13864 - RNA, 20 nt, Artificial Sequence
  Synthetic
cgcgcccguuggccgucccc

SEQ ID NO: 13865 - RNA, 20 nt, Artificial Sequence
  Synthetic
ucggagaacaagcagcgccc

SEQ ID NO: 13866 - RNA, 20 nt, Artificial Sequence
  Synthetic
cgccgucgcagccguauccc

SEQ ID NO: 13867 - RNA, 20 nt, Artificial Sequence
  Synthetic
ccucgggcucauauaguccc

SEQ ID NO: 13868 - RNA, 20 nt, Artificial Sequence
  Synthetic
cgccccgacgccggcacgcc

SEQ ID NO: 13869 - RNA, 20 nt, Artificial Sequence
  Synthetic
cccacgaccucgacgacgcc

SEQ ID NO: 13870 - RNA, 20 nt, Artificial Sequence
  Synthetic
cgucagacgcucgccgcgcc

SEQ ID NO: 13871 - RNA, 20 nt, Artificial Sequence
  Synthetic
ccgaugcggggcgauccucc

SEQ ID NO: 13872 - RNA, 20 nt, Artificial Sequence
  Synthetic
ucguccgcguaucggcgucc

SEQ ID NO: 13873 - RNA, 20 nt, Artificial Sequence
  Synthetic
acggauccacgacccgacgc

SEQ ID NO: 13874 - RNA, 20 nt, Artificial Sequence
  Synthetic
uccguucggggugggcccgc

SEQ ID NO: 13875 - RNA, 20 nt, Artificial Sequence
  Synthetic
ccgauacgcggacgaagcgc

SEQ ID NO: 13876 - RNA, 20 nt, Artificial Sequence
  Synthetic
ccgucagacgcucgccgcgc

SEQ ID NO: 13877 - RNA, 20 nt, Artificial Sequence
  Synthetic
caaugggggggcggcaaggc

SEQ ID NO: 13878 - RNA, 20 nt, Artificial Sequence
  Synthetic
auauagucccaggggccggc

SEQ ID NO: 13879 - RNA, 20 nt, Artificial Sequence
  Synthetic
caugcuaacgaggaacgggc

SEQ ID NO: 13880 - RNA, 20 nt, Artificial Sequence
  Synthetic
aaugagaugccaugcggggc

SEQ ID NO: 13881 - RNA, 20 nt, Artificial Sequence
  Synthetic
cggcgugccggcgucggggc

SEQ ID NO: 13882 - RNA, 20 nt, Artificial Sequence
  Synthetic
acgaggaacgggcagggggc

SEQ ID NO: 13883 - RNA, 20 nt, Artificial Sequence
  Synthetic
uccgacgccaucgccgaugc

SEQ ID NO: 13884 - RNA, 20 nt, Artificial Sequence
  Synthetic
caucucauuaccgcccgauc

SEQ ID NO: 13885 - RNA, 20 nt, Artificial Sequence
  Synthetic
agcgucugacggucugucuc

SEQ ID NO: 13886 - RNA, 20 nt, Artificial Sequence
  Synthetic
uaccgccgaaccgggaaguc

SEQ ID NO: 13887 - RNA, 20 nt, Artificial Sequence
  Synthetic
cgucgacggcgggggucguc

SEQ ID NO: 13888 - RNA, 20 nt, Artificial Sequence
  Synthetic
ugcauaauggaauuccguuc

SEQ ID NO: 13889 - RNA, 20 nt, Artificial Sequence
  Synthetic
ucgggcucauauagucccag

SEQ ID NO: 13890 - RNA, 20 nt, Artificial Sequence
  Synthetic
ugcuaacgaggaacgggcag

SEQ ID NO: 13891 - RNA, 20 nt, Artificial Sequence
  Synthetic
cgagcccagaccgcgacgag

SEQ ID NO: 13892 - RNA, 20 nt, Artificial Sequence
  Synthetic
acgcggacgaagcgcgggag

SEQ ID NO: 13893 - RNA, 20 nt, Artificial Sequence
  Synthetic
cggacucucgauggggggag

SEQ ID NO: 13894 - RNA, 20 nt, Artificial Sequence
  Synthetic
uuccguuccgcaugcuaacg

SEQ ID NO: 13895 - RNA, 20 nt, Artificial Sequence
  Synthetic
cacggauccacgacccgacg

SEQ ID NO: 13896 - RNA, 20 nt, Artificial Sequence
  Synthetic
cgcgccgggacgccgauacg

SEQ ID NO: 13897 - RNA, 20 nt, Artificial Sequence
  Synthetic
ccgucuccgcgccccacccg

SEQ ID NO: 13898 - RNA, 20 nt, Artificial Sequence
  Synthetic
ccugggacuauaugagcccg

SEQ ID NO: 13899 - RNA, 20 nt, Artificial Sequence
  Synthetic
cguucggggugggcccgccg

SEQ ID NO: 13900 - RNA, 20 nt, Artificial Sequence
  Synthetic
cgaugcggggcgauccuccg

SEQ ID NO: 13901 - RNA, 20 nt, Artificial Sequence
  Synthetic
agcccagaccgcgacgagcg

SEQ ID NO: 13902 - RNA, 20 nt, Artificial Sequence
  Synthetic
ccgucgacgcggaacuagcg

SEQ ID NO: 13903 - RNA, 20 nt, Artificial Sequence
  Synthetic
cuaguuccgcgucgacggcg

SEQ ID NO: 13904 - RNA, 20 nt, Artificial Sequence
  Synthetic
cgcguaucggcgucccggcg

SEQ ID NO: 13905 - RNA, 20 nt, Artificial Sequence
  Synthetic
cgaggaacgggcagggggcg

SEQ ID NO: 13906 - RNA, 20 nt, Artificial Sequence
  Synthetic
cgcgccaucugccaugggcg

SEQ ID NO: 13907 - RNA, 20 nt, Artificial Sequence
  Synthetic
cgguaaugagaugccaugcg

SEQ ID NO: 13908 - RNA, 20 nt, Artificial Sequence
  Synthetic
ccgacgccaucgccgaugcg

SEQ ID NO: 13909 - RNA, 20 nt, Artificial Sequence
  Synthetic
cucgucgcggucugggcucg

SEQ ID NO: 13910 - RNA, 20 nt, Artificial Sequence
  Synthetic
accgccgaaccgggaagucg

SEQ ID NO: 13911 - RNA, 20 nt, Artificial Sequence
  Synthetic
cgagggccccccgcucgucg

SEQ ID NO: 13912 - RNA, 20 nt, Artificial Sequence
  Synthetic
cgucccgccgggcgucgucg

SEQ ID NO: 13913 - RNA, 20 nt, Artificial Sequence
  Synthetic
cggguggggcgcggagacgg

SEQ ID NO: 13914 - RNA, 20 nt, Artificial Sequence
  Synthetic
cggggauacggcugcgacgg

SEQ ID NO: 13915 - RNA, 20 nt, Artificial Sequence
  Synthetic
cgcuaguuccgcgucgacgg

SEQ ID NO: 13916 - RNA, 20 nt, Artificial Sequence
  Synthetic
cguccggcgggcgggaccgg

SEQ ID NO: 13917 - RNA, 20 nt, Artificial Sequence
  Synthetic
cgucgcagccguauccccgg

SEQ ID NO: 13918 - RNA, 20 nt, Artificial Sequence
  Synthetic
acgaccucgacgacgcccgg

SEQ ID NO: 13919 - RNA, 20 nt, Artificial Sequence
  Synthetic
ccccgacgccggcacgccgg

SEQ ID NO: 13920 - RNA, 20 nt, Artificial Sequence
  Synthetic
cucauuaccgcccgauccgg

SEQ ID NO: 13921 - RNA, 20 nt, Artificial Sequence
  Synthetic
uaguuccgcgucgacggcgg

SEQ ID NO: 13922 - RNA, 20 nt, Artificial Sequence
  Synthetic
uucggggugggcccgccggg

SEQ ID NO: 13923 - RNA, 20 nt, Artificial Sequence
  Synthetic
cccagaccgcgacgagcggg

SEQ ID NO: 13924 - RNA, 20 nt, Artificial Sequence
  Synthetic
auacgcggacgaagcgcggg

SEQ ID NO: 13925 - RNA, 20 nt, Artificial Sequence
  Synthetic
uggucccggcguccggcggg

SEQ ID NO: 13926 - RNA, 20 nt, Artificial Sequence
  Synthetic
acgagcggggggcccucggg

SEQ ID NO: 13927 - RNA, 20 nt, Artificial Sequence
  Synthetic
uaaugagaugccaugcgggg

SEQ ID NO: 13928 - RNA, 20 nt, Artificial Sequence
  Synthetic
ccggcgugccggcgucgggg

SEQ ID NO: 13929 - RNA, 20 nt, Artificial Sequence
  Synthetic
uaauggaauuccguucgggg

SEQ ID NO: 13930 - RNA, 20 nt, Artificial Sequence
  Synthetic
aacgaggaacgggcaggggg

SEQ ID NO: 13931 - RNA, 20 nt, Artificial Sequence
  Synthetic
uacggacucucgaugggggg

SEQ ID NO: 13932 - RNA, 20 nt, Artificial Sequence
  Synthetic
cgucgucgaggucguggggg

SEQ ID NO: 13933 - RNA, 20 nt, Artificial Sequence
  Synthetic
ccgcccgccggccaaugggg

SEQ ID NO: 13934 - RNA, 20 nt, Artificial Sequence
  Synthetic
uccgcgccaucugccauggg

SEQ ID NO: 13935 - RNA, 20 nt, Artificial Sequence
  Synthetic
accuacggacucucgauggg

SEQ ID NO: 13936 - RNA, 20 nt, Artificial Sequence
  Synthetic
cggaccggucgaugcuuggg

SEQ ID NO: 13937 - RNA, 20 nt, Artificial Sequence
  Synthetic
ucccgcccgccggccaaugg

SEQ ID NO: 13938 - RNA, 20 nt, Artificial Sequence
  Synthetic
cuccgacgccaucgccgaug

SEQ ID NO: 13939 - RNA, 20 nt, Artificial Sequence
  Synthetic
ucaccuacggacucucgaug

SEQ ID NO: 13940 - RNA, 20 nt, Artificial Sequence
  Synthetic
cgggcgucgucgaggucgug

SEQ ID NO: 13941 - RNA, 20 nt, Artificial Sequence
  Synthetic
ccgccuugccgcccccccau

SEQ ID NO: 13942 - RNA, 20 nt, Artificial Sequence
  Synthetic
cccggaggaucgccccgcau

SEQ ID NO: 13943 - RNA, 20 nt, Artificial Sequence
  Synthetic
ccauggcagauggcgcggau

SEQ ID NO: 13944 - RNA, 20 nt, Artificial Sequence
  Synthetic
acgaagcgcgggagggggau

SEQ ID NO: 13945 - RNA, 20 nt, Artificial Sequence
  Synthetic
cccgcgcuucguccgcguau

SEQ ID NO: 13946 - RNA, 20 nt, Artificial Sequence
  Synthetic
cgcgacgagcggggggcccu

SEQ ID NO: 13947 - RNA, 20 nt, Artificial Sequence
  Synthetic
agcgcggaccggucgaugcu

SEQ ID NO: 13948 - RNA, 20 nt, Artificial Sequence
  Synthetic
ccccccgcucgucgcggucu

SEQ ID NO: 13949 - RNA, 20 nt, Artificial Sequence
  Synthetic
uuaccgccgaaccgggaagu

SEQ ID NO: 13950 - RNA, 20 nt, Artificial Sequence
  Synthetic
uacgagccccgcgcgcccgu

SEQ ID NO: 13951 - RNA, 20 nt, Artificial Sequence
  Synthetic
ugggccgcccgccgucccgu

SEQ ID NO: 13952 - RNA, 20 nt, Artificial Sequence
  Synthetic
uccccccaucgagaguccgu

SEQ ID NO: 13953 - RNA, 20 nt, Artificial Sequence
  Synthetic
cgggggucgucgggguccgu

SEQ ID NO: 13954 - RNA, 20 nt, Artificial Sequence
  Synthetic
ugucucuggcggucccgcgu

SEQ ID NO: 13955 - RNA, 20 nt, Artificial Sequence
  Synthetic
ccccgcaucggcgauggcgu

SEQ ID NO: 13956 - RNA, 20 nt, Artificial Sequence
  Synthetic
ccgggcgucgucgaggucgu

SEQ ID NO: 13957 - RNA, 20 nt, Artificial Sequence
  Synthetic
aauggaauuccguucggggu

SEQ ID NO: 13958 - RNA, 17 nt, Artificial Sequence
  Synthetic
gccggggguucgaccaa

SEQ ID NO: 13959 - RNA, 17 nt, Artificial Sequence
  Synthetic
gacggcgggcggcccaa

SEQ ID NO: 13960 - RNA, 17 nt, Artificial Sequence
  Synthetic
ggcccggggacggccaa

SEQ ID NO: 13961 - RNA, 17 nt, Artificial Sequence
  Synthetic
ggcggggucgugcauaa

SEQ ID NO: 13962 - RNA, 17 nt, Artificial Sequence
  Synthetic
gggugggaaaaaggaca

SEQ ID NO: 13963 - RNA, 17 nt, Artificial Sequence
  Synthetic
ggagggggcgagaccca

SEQ ID NO: 13964 - RNA, 17 nt, Artificial Sequence
  Synthetic
gccccgcccauggcaga

SEQ ID NO: 13965 - RNA, 17 nt, Artificial Sequence
  Synthetic
ggcgcggagacggagga

SEQ ID NO: 13966 - RNA, 17 nt, Artificial Sequence
  Synthetic
gggaaaaaggacaggga

SEQ ID NO: 13967 - RNA, 17 nt, Artificial Sequence
  Synthetic
gacucucgaugggggga

SEQ ID NO: 13968 - RNA, 17 nt, Artificial Sequence
  Synthetic
gcgauccuccggggaua

SEQ ID NO: 13969 - RNA, 17 nt, Artificial Sequence
  Synthetic
guccggcgggcgggacc

SEQ ID NO: 13970 - RNA, 17 nt, Artificial Sequence
  Synthetic
gccguccccgggccccc

SEQ ID NO: 13971 - RNA, 17 nt, Artificial Sequence
  Synthetic
gagaacaagcagcgccc

SEQ ID NO: 13972 - RNA, 17 nt, Artificial Sequence
  Synthetic
ggcagggggcggggccc

SEQ ID NO: 13973 - RNA, 17 nt, Artificial Sequence
  Synthetic
gcgggaccggggggccc

SEQ ID NO: 13974 - RNA, 17 nt, Artificial Sequence
  Synthetic
gcccgucgguggggccc

SEQ ID NO: 13975 - RNA, 17 nt, Artificial Sequence
  Synthetic
gcagcgccccggcuccc

SEQ ID NO: 13976 - RNA, 17 nt, Artificial Sequence
  Synthetic
guggggcccggggagcc

SEQ ID NO: 13977 - RNA, 17 nt, Artificial Sequence
  Synthetic
ggcccucccgucccgcc

SEQ ID NO: 13978 - RNA, 17 nt, Artificial Sequence
  Synthetic
gggcagggggcggggcc

SEQ ID NO: 13979 - RNA, 17 nt, Artificial Sequence
  Synthetic
ggcgggaccggggggcc

SEQ ID NO: 13980 - RNA, 17 nt, Artificial Sequence
  Synthetic
ggcccgucgguggggcc

SEQ ID NO: 13981 - RNA, 17 nt, Artificial Sequence
  Synthetic
gguggggcccggggagc

SEQ ID NO: 13982 - RNA, 17 nt, Artificial Sequence
  Synthetic
gggcccucccgucccgc

SEQ ID NO: 13983 - RNA, 17 nt, Artificial Sequence
  Synthetic
ggagcagcggaggccgc

SEQ ID NO: 13984 - RNA, 17 nt, Artificial Sequence
  Synthetic
gggaccaacgggacggc

SEQ ID NO: 13985 - RNA, 17 nt, Artificial Sequence
  Synthetic
gggcggggcgcgagggc

SEQ ID NO: 13986 - RNA, 17 nt, Artificial Sequence
  Synthetic
gcgcggaugggcggggc

SEQ ID NO: 13987 - RNA, 17 nt, Artificial Sequence
  Synthetic
gagaugccaugcggggc

SEQ ID NO: 13988 - RNA, 17 nt, Artificial Sequence
  Synthetic
gggcccgccgggggggc

SEQ ID NO: 13989 - RNA, 17 nt, Artificial Sequence
  Synthetic
gccgcccccccauuggc

SEQ ID NO: 13990 - RNA, 17 nt, Artificial Sequence
  Synthetic
guaaugagaugccaugc

SEQ ID NO: 13991 - RNA, 17 nt, Artificial Sequence
  Synthetic
ggcucauauagucccag

SEQ ID NO: 13992 - RNA, 17 nt, Artificial Sequence
  Synthetic
gcgggaaggaggagcag

SEQ ID NO: 13993 - RNA, 17 nt, Artificial Sequence
  Synthetic
ggacgggagggcccccg

SEQ ID NO: 13994 - RNA, 17 nt, Artificial Sequence
  Synthetic
gggacuauaugagcccg

SEQ ID NO: 13995 - RNA, 17 nt, Artificial Sequence
  Synthetic
ggcacgccgggggcccg

SEQ ID NO: 13996 - RNA, 17 nt, Artificial Sequence
  Synthetic
gcggaugggcggggccg

SEQ ID NO: 13997 - RNA, 17 nt, Artificial Sequence
  Synthetic
gacggccaacgggcgcg

SEQ ID NO: 13998 - RNA, 17 nt, Artificial Sequence
  Synthetic
gccaugggcggggcgcg

SEQ ID NO: 13999 - RNA, 17 nt, Artificial Sequence
  Synthetic
ggagacggaggagggcg

SEQ ID NO: 14000 - RNA, 17 nt, Artificial Sequence
  Synthetic
gugccggcgucggggcg

SEQ ID NO: 14001 - RNA, 17 nt, Artificial Sequence
  Synthetic
ggaacgggcagggggcg

SEQ ID NO: 14002 - RNA, 17 nt, Artificial Sequence
  Synthetic
ggcccgccgggggggcg

SEQ ID NO: 14003 - RNA, 17 nt, Artificial Sequence
  Synthetic
ggcccucggguggggcg

SEQ ID NO: 14004 - RNA, 17 nt, Artificial Sequence
  Synthetic
gccaucugccaugggcg

SEQ ID NO: 14005 - RNA, 17 nt, Artificial Sequence
  Synthetic
gcccauggcagauggcg

SEQ ID NO: 14006 - RNA, 17 nt, Artificial Sequence
  Synthetic
ggucccgcgucgggucg

SEQ ID NO: 14007 - RNA, 17 nt, Artificial Sequence
  Synthetic
ggggguggucggggucg

SEQ ID NO: 14008 - RNA, 17 nt, Artificial Sequence
  Synthetic
ggucggggucguggucg

SEQ ID NO: 14009 - RNA, 17 nt, Artificial Sequence
  Synthetic
ggucguggggguggucg

SEQ ID NO: 14010 - RNA, 17 nt, Artificial Sequence
  Synthetic
gggcgcggagacggagg

SEQ ID NO: 14011 - RNA, 17 nt, Artificial Sequence
  Synthetic
ggacgaagcgcgggagg

SEQ ID NO: 14012 - RNA, 17 nt, Artificial Sequence
  Synthetic
guggggcgcggagacgg

SEQ ID NO: 14013 - RNA, 17 nt, Artificial Sequence
  Synthetic
gccccccgcccccccgg

SEQ ID NO: 14014 - RNA, 17 nt, Artificial Sequence
  Synthetic
ggggggcggggggccgg

SEQ ID NO: 14015 - RNA, 17 nt, Artificial Sequence
  Synthetic
gcccccccauuggccgg

SEQ ID NO: 14016 - RNA, 17 nt, Artificial Sequence
  Synthetic
ggaaggaggagcagcgg

SEQ ID NO: 14017 - RNA, 17 nt, Artificial Sequence
  Synthetic
gcccgccgggggggcgg

SEQ ID NO: 14018 - RNA, 17 nt, Artificial Sequence
  Synthetic
gggcucggggugggcgg

SEQ ID NO: 14019 - RNA, 17 nt, Artificial Sequence
  Synthetic
gggcggcggcccgucgg

SEQ ID NO: 14020 - RNA, 17 nt, Artificial Sequence
  Synthetic
gcggagacggaggaggg

SEQ ID NO: 14021 - RNA, 17 nt, Artificial Sequence
  Synthetic
ggggugggcccgccggg

SEQ ID NO: 14022 - RNA, 17 nt, Artificial Sequence
  Synthetic
gggggcggcaaggcggg

SEQ ID NO: 14023 - RNA, 17 nt, Artificial Sequence
  Synthetic
gggugggcccgccgggg

SEQ ID NO: 14024 - RNA, 17 nt, Artificial Sequence
  Synthetic
gcggucugggcucgggg

SEQ ID NO: 14025 - RNA, 17 nt, Artificial Sequence
  Synthetic
gaggaacgggcaggggg

SEQ ID NO: 14026 - RNA, 17 nt, Artificial Sequence
  Synthetic
ggacucucgaugggggg

SEQ ID NO: 14027 - RNA, 17 nt, Artificial Sequence
  Synthetic
gcccgccggccaauggg

SEQ ID NO: 14028 - RNA, 17 nt, Artificial Sequence
  Synthetic
gguaaugagaugccaug

SEQ ID NO: 14029 - RNA, 17 nt, Artificial Sequence
  Synthetic
gcggcggcccgucggug

SEQ ID NO: 14030 - RNA, 17 nt, Artificial Sequence
  Synthetic
gcaaggcgggcggcccu

SEQ ID NO: 14031 - RNA, 17 nt, Artificial Sequence
  Synthetic
gagccccgcgcgcccgu

SEQ ID NO: 14032 - RNA, 17 nt, Artificial Sequence
  Synthetic
ggugggcggcggcccgu

SEQ ID NO: 14033 - RNA, 17 nt, Artificial Sequence
  Synthetic
gggucgucgggguccgu

SEQ ID NO: 14034 - RNA, 17 nt, Artificial Sequence
  Synthetic
ggggcgcgagggcgggu

SEQ ID NO: 14035 - RNA, 17 nt, Artificial Sequence
  Synthetic
gcggggggcccucgggu

SEQ ID NO: 14036 - RNA, 17 nt, Artificial Sequence
  Synthetic
guggucggggucguggu

SEQ ID NO: 14037 - RNA, 17 nt, Artificial Sequence
  Synthetic
gaggucguggggguggu

SEQ ID NO: 14038 - RNA, 17 nt, Artificial Sequence
  Synthetic
gccccgacuucccgguu

SEQ ID NO: 14039 - RNA, 20 nt, Artificial Sequence
  Synthetic
ggggccggggguucgaccaa

SEQ ID NO: 14040 - RNA, 20 nt, Artificial Sequence
  Synthetic
gggggagggggcgagaccca

SEQ ID NO: 14041 - RNA, 20 nt, Artificial Sequence
  Synthetic
gguccgcgccccgccccgca

SEQ ID NO: 14042 - RNA, 20 nt, Artificial Sequence
  Synthetic
ggcuccccgggccccaccga

SEQ ID NO: 14043 - RNA, 20 nt, Artificial Sequence
  Synthetic
ggugggaaaaaggacaggga

SEQ ID NO: 14044 - RNA, 20 nt, Artificial Sequence
  Synthetic
gggaccggggggcccgggga

SEQ ID NO: 14045 - RNA, 20 nt, Artificial Sequence
  Synthetic
ggggcgauccuccggggaua

SEQ ID NO: 14046 - RNA, 20 nt, Artificial Sequence
  Synthetic
gggccggggguucgaccaac

SEQ ID NO: 14047 - RNA, 20 nt, Artificial Sequence
  Synthetic
gcuugggugggaaaaaggac

SEQ ID NO: 14048 - RNA, 20 nt, Artificial Sequence
  Synthetic
ggcguccggcgggcgggacc

SEQ ID NO: 14049 - RNA, 20 nt, Artificial Sequence
  Synthetic
gggccgcggccacgggcccc

SEQ ID NO: 14050 - RNA, 20 nt, Artificial Sequence
  Synthetic
ggucccgcccgccggacgcc

SEQ ID NO: 14051 - RNA, 20 nt, Artificial Sequence
  Synthetic
gggggcccucccgucccgcc

SEQ ID NO: 14052 - RNA, 20 nt, Artificial Sequence
  Synthetic
gcgggcgggaccggggggcc

SEQ ID NO: 14053 - RNA, 20 nt, Artificial Sequence
  Synthetic
ggcggcccgucgguggggcc

SEQ ID NO: 14054 - RNA, 20 nt, Artificial Sequence
  Synthetic
gggcccgggccccgacuucc

SEQ ID NO: 14055 - RNA, 20 nt, Artificial Sequence
  Synthetic
gucgguggggcccggggagc

SEQ ID NO: 14056 - RNA, 20 nt, Artificial Sequence
  Synthetic
gcacgaccccgccccgacgc

SEQ ID NO: 14057 - RNA, 20 nt, Artificial Sequence
  Synthetic
ggaacggaagcggaaaccgc

SEQ ID NO: 14058 - RNA, 20 nt, Artificial Sequence
  Synthetic
ggccccccggucccgcccgc

SEQ ID NO: 14059 - RNA, 20 nt, Artificial Sequence
  Synthetic
ggaggagcagcggaggccgc

SEQ ID NO: 14060 - RNA, 20 nt, Artificial Sequence
  Synthetic
gggacggccaacgggcgcgc

SEQ ID NO: 14061 - RNA, 20 nt, Artificial Sequence
  Synthetic
gccgggaccaacgggacggc

SEQ ID NO: 14062 - RNA, 20 nt, Artificial Sequence
  Synthetic
gcgcggagacggaggagggc

SEQ ID NO: 14063 - RNA, 20 nt, Artificial Sequence
  Synthetic
ggucccggcguccggcgggc

SEQ ID NO: 14064 - RNA, 20 nt, Artificial Sequence
  Synthetic
gcucauauagucccaggggc

SEQ ID NO: 14065 - RNA, 20 nt, Artificial Sequence
  Synthetic
ggcagauggcgcggaugggc

SEQ ID NO: 14066 - RNA, 20 nt, Artificial Sequence
  Synthetic
gcgguaaugagaugccaugc

SEQ ID NO: 14067 - RNA, 20 nt, Artificial Sequence
  Synthetic
gcccccggcgugccggcguc

SEQ ID NO: 14068 - RNA, 20 nt, Artificial Sequence
  Synthetic
ggguggucggggucgugguc

SEQ ID NO: 14069 - RNA, 20 nt, Artificial Sequence
  Synthetic
gcgggacgggagggcccccg

SEQ ID NO: 14070 - RNA, 20 nt, Artificial Sequence
  Synthetic
gggcgggaccggggggcccg

SEQ ID NO: 14071 - RNA, 20 nt, Artificial Sequence
  Synthetic
ggcgcggaugggcggggccg

SEQ ID NO: 14072 - RNA, 20 nt, Artificial Sequence
  Synthetic
gcgggggucgucgggguccg

SEQ ID NO: 14073 - RNA, 20 nt, Artificial Sequence
  Synthetic
ggggacggccaacgggcgcg

SEQ ID NO: 14074 - RNA, 20 nt, Artificial Sequence
  Synthetic
ggcgugccggcgucggggcg

SEQ ID NO: 14075 - RNA, 20 nt, Artificial Sequence
  Synthetic
gugggcccgccgggggggcg

SEQ ID NO: 14076 - RNA, 20 nt, Artificial Sequence
  Synthetic
gggggcccucggguggggcg

SEQ ID NO: 14077 - RNA, 20 nt, Artificial Sequence
  Synthetic
gcagauggcgcggaugggcg

SEQ ID NO: 14078 - RNA, 20 nt, Artificial Sequence
  Synthetic
gguggucggggucguggucg

SEQ ID NO: 14079 - RNA, 20 nt, Artificial Sequence
  Synthetic
gcuaacgaggaacgggcagg

SEQ ID NO: 14080 - RNA, 20 nt, Artificial Sequence
  Synthetic
guggggcgcggagacggagg

SEQ ID NO: 14081 - RNA, 20 nt, Artificial Sequence
  Synthetic
gcgcggaugggcggggccgg

SEQ ID NO: 14082 - RNA, 20 nt, Artificial Sequence
  Synthetic
gccgcccccccauuggccgg

SEQ ID NO: 14083 - RNA, 20 nt, Artificial Sequence
  Synthetic
gcgggaaggaggagcagcgg

SEQ ID NO: 14084 - RNA, 20 nt, Artificial Sequence
  Synthetic
ggugggcggcggcccgucgg

SEQ ID NO: 14085 - RNA, 20 nt, Artificial Sequence
  Synthetic
ggcgcggagacggaggaggg

SEQ ID NO: 14086 - RNA, 20 nt, Artificial Sequence
  Synthetic
guccggcgggcgggaccggg

SEQ ID NO: 14087 - RNA, 20 nt, Artificial Sequence
  Synthetic
gggcggggcgcgagggcggg

SEQ ID NO: 14088 - RNA, 20 nt, Artificial Sequence
  Synthetic
gggcccgccgggggggcggg

SEQ ID NO: 14089 - RNA, 20 nt, Artificial Sequence
  Synthetic
gucgcggucugggcucgggg

SEQ ID NO: 14090 - RNA, 20 nt, Artificial Sequence
  Synthetic
gggugggcccgccggggggg

SEQ ID NO: 14091 - RNA, 20 nt, Artificial Sequence
  Synthetic
gucccgcccgccggccaaug

SEQ ID NO: 14092 - RNA, 20 nt, Artificial Sequence
  Synthetic
gagcggggggcccucgggug

SEQ ID NO: 14093 - RNA, 20 nt, Artificial Sequence
  Synthetic
ggucccgcccgccggccaau

SEQ ID NO: 14094 - RNA, 20 nt, Artificial Sequence
  Synthetic
gcggcaaggcgggcggcccu

SEQ ID NO: 14095 - RNA, 20 nt, Artificial Sequence
  Synthetic
gugggcggcggcccgucggu

SEQ ID NO: 14096 - RNA, 20 nt, Artificial Sequence
  Synthetic
ggcggggcgcgagggcgggu

SEQ ID NO: 14097 - RNA, 20 nt, Artificial Sequence
  Synthetic
ggaccggucgaugcuugggu

SEQ ID NO: 14098 - RNA, 20 nt, Artificial Sequence
  Synthetic
gggguggucggggucguggu

SEQ ID NO: 14099 - RNA, 20 nt, Artificial Sequence
  Synthetic
gucgaggucguggggguggu

SEQ ID NO: 14100 - RNA, 17 nt, Artificial Sequence
  Synthetic
augcuugggugggaaaa

SEQ ID NO: 14101 - RNA, 17 nt, Artificial Sequence
  Synthetic
ccggacgccgggaccaa

SEQ ID NO: 14102 - RNA, 17 nt, Artificial Sequence
  Synthetic
cccucgcgccccgccca

SEQ ID NO: 14103 - RNA, 17 nt, Artificial Sequence
  Synthetic
ccgcgccccgccccgca

SEQ ID NO: 14104 - RNA, 17 nt, Artificial Sequence
  Synthetic
ccaaugggggggcggca

SEQ ID NO: 14105 - RNA, 17 nt, Artificial Sequence
  Synthetic
cuaacgaggaacgggca

SEQ ID NO: 14106 - RNA, 17 nt, Artificial Sequence
  Synthetic
cggguggggcgcggaga

SEQ ID NO: 14107 - RNA, 17 nt, Artificial Sequence
  Synthetic
uccccgggccccaccga

SEQ ID NO: 14108 - RNA, 17 nt, Artificial Sequence
  Synthetic
cuccgcgccccacccga

SEQ ID NO: 14109 - RNA, 17 nt, Artificial Sequence
  Synthetic
ccaugggcggggcgcga

SEQ ID NO: 14110 - RNA, 17 nt, Artificial Sequence
  Synthetic
auggcagauggcgcgga

SEQ ID NO: 14111 - RNA, 17 nt, Artificial Sequence
  Synthetic
cgcccggcgggacggga

SEQ ID NO: 14112 - RNA, 17 nt, Artificial Sequence
  Synthetic
cccaggggccggcggga

SEQ ID NO: 14113 - RNA, 17 nt, Artificial Sequence
  Synthetic
accggggggcccgggga

SEQ ID NO: 14114 - RNA, 17 nt, Artificial Sequence
  Synthetic
cggacgccgggaccaac

SEQ ID NO: 14115 - RNA, 17 nt, Artificial Sequence
  Synthetic
ccccgggccccaccgac

SEQ ID NO: 14116 - RNA, 17 nt, Artificial Sequence
  Synthetic
cccacccaagcaucgac

SEQ ID NO: 14117 - RNA, 17 nt, Artificial Sequence
  Synthetic
ugggugggaaaaaggac

SEQ ID NO: 14118 - RNA, 17 nt, Artificial Sequence
  Synthetic
acgacgcccggcgggac

SEQ ID NO: 14119 - RNA, 17 nt, Artificial Sequence
  Synthetic
cucauuaccgccgaacc

SEQ ID NO: 14120 - RNA, 17 nt, Artificial Sequence
  Synthetic
ccggccccccgcccccc

SEQ ID NO: 14121 - RNA, 17 nt, Artificial Sequence
  Synthetic
uccuucccgccggcccc

SEQ ID NO: 14122 - RNA, 17 nt, Artificial Sequence
  Synthetic
ccgcggccacgggcccc

SEQ ID NO: 14123 - RNA, 17 nt, Artificial Sequence
  Synthetic
cagcgccccggcucccc

SEQ ID NO: 14124 - RNA, 17 nt, Artificial Sequence
  Synthetic
ccgggaagucggggccc

SEQ ID NO: 14125 - RNA, 17 nt, Artificial Sequence
  Synthetic
cccgcccgccggacgcc

SEQ ID NO: 14126 - RNA, 17 nt, Artificial Sequence
  Synthetic
cagacgcucgccgcgcc

SEQ ID NO: 14127 - RNA, 17 nt, Artificial Sequence
  Synthetic
cgcggaugggcggggcc

SEQ ID NO: 14128 - RNA, 17 nt, Artificial Sequence
  Synthetic
accgggaagucggggcc

SEQ ID NO: 14129 - RNA, 17 nt, Artificial Sequence
  Synthetic
cccgggccccgacuucc

SEQ ID NO: 14130 - RNA, 17 nt, Artificial Sequence
  Synthetic
ccccgacgccggcacgc

SEQ ID NO: 14131 - RNA, 17 nt, Artificial Sequence
  Synthetic
cgaccccgccccgacgc

SEQ ID NO: 14132 - RNA, 17 nt, Artificial Sequence
  Synthetic
ucccgcccgccggacgc

SEQ ID NO: 14133 - RNA, 17 nt, Artificial Sequence
  Synthetic
cccccggucccgcccgc

SEQ ID NO: 14134 - RNA, 17 nt, Artificial Sequence
  Synthetic
cugcuccuccuucccgc

SEQ ID NO: 14135 - RNA, 17 nt, Artificial Sequence
  Synthetic
ugggggggcggcaaggc

SEQ ID NO: 14136 - RNA, 17 nt, Artificial Sequence
  Synthetic
ccccccgcccccccggc

SEQ ID NO: 14137 - RNA, 17 nt, Artificial Sequence
  Synthetic
uagucccaggggccggc

SEQ ID NO: 14138 - RNA, 17 nt, Artificial Sequence
  Synthetic
cccccccauuggccggc

SEQ ID NO: 14139 - RNA, 17 nt, Artificial Sequence
  Synthetic
uggucccggcguccggc

SEQ ID NO: 14140 - RNA, 17 nt, Artificial Sequence
  Synthetic
cggagacggaggagggc

SEQ ID NO: 14141 - RNA, 17 nt, Artificial Sequence
  Synthetic
cccauuggccggcgggc

SEQ ID NO: 14142 - RNA, 17 nt, Artificial Sequence
  Synthetic
cccggcguccggcgggc

SEQ ID NO: 14143 - RNA, 17 nt, Artificial Sequence
  Synthetic
cauauagucccaggggc

SEQ ID NO: 14144 - RNA, 17 nt, Artificial Sequence
  Synthetic
cgugccggcgucggggc

SEQ ID NO: 14145 - RNA, 17 nt, Artificial Sequence
  Synthetic
aggaacgggcagggggc

SEQ ID NO: 14146 - RNA, 17 nt, Artificial Sequence
  Synthetic
ccgggggggcggggggc

SEQ ID NO: 14147 - RNA, 17 nt, Artificial Sequence
  Synthetic
cgccaucugccaugggc

SEQ ID NO: 14148 - RNA, 17 nt, Artificial Sequence
  Synthetic
cccggcgugccggcguc

SEQ ID NO: 14149 - RNA, 17 nt, Artificial Sequence
  Synthetic
uggucggggucgugguc

SEQ ID NO: 14150 - RNA, 17 nt, Artificial Sequence
  Synthetic
aggucgugggggugguc

SEQ ID NO: 14151 - RNA, 17 nt, Artificial Sequence
  Synthetic
auaauggaauuccguuc

SEQ ID NO: 14152 - RNA, 17 nt, Artificial Sequence
  Synthetic
uccggcgggcgggaccg

SEQ ID NO: 14153 - RNA, 17 nt, Artificial Sequence
  Synthetic
ucuccgcgccccacccg

SEQ ID NO: 14154 - RNA, 17 nt, Artificial Sequence
  Synthetic
cgggaccggggggcccg

SEQ ID NO: 14155 - RNA, 17 nt, Artificial Sequence
  Synthetic
cccgucgguggggcccg

SEQ ID NO: 14156 - RNA, 17 nt, Artificial Sequence
  Synthetic
uggggcccggggagccg

SEQ ID NO: 14157 - RNA, 17 nt, Artificial Sequence
  Synthetic
ucggggugggcccgccg

SEQ ID NO: 14158 - RNA, 17 nt, Artificial Sequence
  Synthetic
ccgggggcccguggccg

SEQ ID NO: 14159 - RNA, 17 nt, Artificial Sequence
  Synthetic
ugcggggcgauccuccg

SEQ ID NO: 14160 - RNA, 17 nt, Artificial Sequence
  Synthetic
cggccaacgggcgcgcg

SEQ ID NO: 14161 - RNA, 17 nt, Artificial Sequence
  Synthetic
ccaugcggggcggggcg

SEQ ID NO: 14162 - RNA, 17 nt, Artificial Sequence
  Synthetic
uaaugagaugccaugcg

SEQ ID NO: 14163 - RNA, 17 nt, Artificial Sequence
  Synthetic
augggggggcggcaagg

SEQ ID NO: 14164 - RNA, 17 nt, Artificial Sequence
  Synthetic
aggggccggcgggaagg

SEQ ID NO: 14165 - RNA, 17 nt, Artificial Sequence
  Synthetic
cucucgauggggggagg

SEQ ID NO: 14166 - RNA, 17 nt, Artificial Sequence
  Synthetic
ccggcgggcgggaccgg

SEQ ID NO: 14167 - RNA, 17 nt, Artificial Sequence
  Synthetic
cggggugggcccgccgg

SEQ ID NO: 14168 - RNA, 17 nt, Artificial Sequence
  Synthetic
auagucccaggggccgg

SEQ ID NO: 14169 - RNA, 17 nt, Artificial Sequence
  Synthetic
cggaugggcggggccgg

SEQ ID NO: 14170 - RNA, 17 nt, Artificial Sequence
  Synthetic
ugggcggggcgcgaggg

SEQ ID NO: 14171 - RNA, 17 nt, Artificial Sequence
  Synthetic
acgcccggcgggacggg

SEQ ID NO: 14172 - RNA, 17 nt, Artificial Sequence
  Synthetic
cggcgggcgggaccggg

SEQ ID NO: 14173 - RNA, 17 nt, Artificial Sequence
  Synthetic
accaacgggacggcggg

SEQ ID NO: 14174 - RNA, 17 nt, Artificial Sequence
  Synthetic
ccccauuggccggcggg

SEQ ID NO: 14175 - RNA, 17 nt, Artificial Sequence
  Synthetic
cggggcgcgagggcggg

SEQ ID NO: 14176 - RNA, 17 nt, Artificial Sequence
  Synthetic
cccgccgggggggcggg

SEQ ID NO: 14177 - RNA, 17 nt, Artificial Sequence
  Synthetic
agcggggggcccucggg

SEQ ID NO: 14178 - RNA, 17 nt, Artificial Sequence
  Synthetic
ugagaugccaugcgggg

SEQ ID NO: 14179 - RNA, 17 nt, Artificial Sequence
  Synthetic
ugggcccgccggggggg

SEQ ID NO: 14180 - RNA, 17 nt, Artificial Sequence
  Synthetic
cccgccggccaaugggg

SEQ ID NO: 14181 - RNA, 17 nt, Artificial Sequence
  Synthetic
cagauggcgcggauggg

SEQ ID NO: 14182 - RNA, 17 nt, Artificial Sequence
  Synthetic
ucugggcucgggguggg

SEQ ID NO: 14183 - RNA, 17 nt, Artificial Sequence
  Synthetic
ugacggucugucucugg

SEQ ID NO: 14184 - RNA, 17 nt, Artificial Sequence
  Synthetic
cggggggcccucgggug

SEQ ID NO: 14185 - RNA, 17 nt, Artificial Sequence
  Synthetic
cccgcccgccggccaau

SEQ ID NO: 14186 - RNA, 17 nt, Artificial Sequence
  Synthetic
aagcgcgggagggggau

SEQ ID NO: 14187 - RNA, 17 nt, Artificial Sequence
  Synthetic
ccuucccgccggccccu

SEQ ID NO: 14188 - RNA, 17 nt, Artificial Sequence
  Synthetic
cggucugggcucggggu

SEQ ID NO: 14189 - RNA, 17 nt, Artificial Sequence
  Synthetic
caaggcgggcggcccuu

SEQ ID NO: 14190 - RNA, 17 nt, Artificial Sequence
  Synthetic
cauaauggaauuccguu

SEQ ID NO: 14191 - RNA, 20 nt, Artificial Sequence
  Synthetic
ccgccggacgccgggaccaa

SEQ ID NO: 14192 - RNA, 20 nt, Artificial Sequence
  Synthetic
cccggcgggcccaccccgaa

SEQ ID NO: 14193 - RNA, 20 nt, Artificial Sequence
  Synthetic
cggggcggggucgugcauaa

SEQ ID NO: 14194 - RNA, 20 nt, Artificial Sequence
  Synthetic
cuugggugggaaaaaggaca

SEQ ID NO: 14195 - RNA, 20 nt, Artificial Sequence
  Synthetic
ccgcccucgcgccccgccca

SEQ ID NO: 14196 - RNA, 20 nt, Artificial Sequence
  Synthetic
cgaccaacgggccgcggcca

SEQ ID NO: 14197 - RNA, 20 nt, Artificial Sequence
  Synthetic
cccauccgcgccaucugcca

SEQ ID NO: 14198 - RNA, 20 nt, Artificial Sequence
  Synthetic
cggccaaugggggggcggca

SEQ ID NO: 14199 - RNA, 20 nt, Artificial Sequence
  Synthetic
cgcgccccgcccauggcaga

SEQ ID NO: 14200 - RNA, 20 nt, Artificial Sequence
  Synthetic
cugccaugggcggggcgcga

SEQ ID NO: 14201 - RNA, 20 nt, Artificial Sequence
  Synthetic
uggggcgcggagacggagga

SEQ ID NO: 14202 - RNA, 20 nt, Artificial Sequence
  Synthetic
cgacgcccggcgggacggga

SEQ ID NO: 14203 - RNA, 20 nt, Artificial Sequence
  Synthetic
cucgacgacgcccggcggga

SEQ ID NO: 14204 - RNA, 20 nt, Artificial Sequence
  Synthetic
agucccaggggccggcggga

SEQ ID NO: 14205 - RNA, 20 nt, Artificial Sequence
  Synthetic
uuucccacccaagcaucgac

SEQ ID NO: 14206 - RNA, 20 nt, Artificial Sequence
  Synthetic
cggcguccggcgggcgggac

SEQ ID NO: 14207 - RNA, 20 nt, Artificial Sequence
  Synthetic
ccgccggccccccgcccccc

SEQ ID NO: 14208 - RNA, 20 nt, Artificial Sequence
  Synthetic
uuggccguccccgggccccc

SEQ ID NO: 14209 - RNA, 20 nt, Artificial Sequence
  Synthetic
uccuccuucccgccggcccc

SEQ ID NO: 14210 - RNA, 20 nt, Artificial Sequence
  Synthetic
aagcagcgccccggcucccc

SEQ ID NO: 14211 - RNA, 20 nt, Artificial Sequence
  Synthetic
acgggcagggggcggggccc

SEQ ID NO: 14212 - RNA, 20 nt, Artificial Sequence
  Synthetic
cgggcgggaccggggggccc

SEQ ID NO: 14213 - RNA, 20 nt, Artificial Sequence
  Synthetic
caagcagcgccccggcuccc

SEQ ID NO: 14214 - RNA, 20 nt, Artificial Sequence
  Synthetic
ucgguggggcccggggagcc

SEQ ID NO: 14215 - RNA, 20 nt, Artificial Sequence
  Synthetic
ccguucggggugggcccgcc

SEQ ID NO: 14216 - RNA, 20 nt, Artificial Sequence
  Synthetic
aacgggcagggggcggggcc

SEQ ID NO: 14217 - RNA, 20 nt, Artificial Sequence
  Synthetic
uggcgcggaugggcggggcc

SEQ ID NO: 14218 - RNA, 20 nt, Artificial Sequence
  Synthetic
cgaaccgggaagucggggcc

SEQ ID NO: 14219 - RNA, 20 nt, Artificial Sequence
  Synthetic
ccgccccgacgccggcacgc

SEQ ID NO: 14220 - RNA, 20 nt, Artificial Sequence
  Synthetic
cggucccgcccgccggacgc

SEQ ID NO: 14221 - RNA, 20 nt, Artificial Sequence
  Synthetic
cgggggcccucccgucccgc

SEQ ID NO: 14222 - RNA, 20 nt, Artificial Sequence
  Synthetic
ccgcugcuccuccuucccgc

SEQ ID NO: 14223 - RNA, 20 nt, Artificial Sequence
  Synthetic
cggccccccgcccccccggc

SEQ ID NO: 14224 - RNA, 20 nt, Artificial Sequence
  Synthetic
cgaccucgacgacgcccggc

SEQ ID NO: 14225 - RNA, 20 nt, Artificial Sequence
  Synthetic
ccgcccccccauuggccggc

SEQ ID NO: 14226 - RNA, 20 nt, Artificial Sequence
  Synthetic
cguuggucccggcguccggc

SEQ ID NO: 14227 - RNA, 20 nt, Artificial Sequence
  Synthetic
caugggcggggcgcgagggc

SEQ ID NO: 14228 - RNA, 20 nt, Artificial Sequence
  Synthetic
ccccccauuggccggcgggc

SEQ ID NO: 14229 - RNA, 20 nt, Artificial Sequence
  Synthetic
auggcgcggaugggcggggc

SEQ ID NO: 14230 - RNA, 20 nt, Artificial Sequence
  Synthetic
ccgccgggggggcggggggc

SEQ ID NO: 14231 - RNA, 20 nt, Artificial Sequence
  Synthetic
ccgcgccaucugccaugggc

SEQ ID NO: 14232 - RNA, 20 nt, Artificial Sequence
  Synthetic
cuugccgcccccccauuggc

SEQ ID NO: 14233 - RNA, 20 nt, Artificial Sequence
  Synthetic
ucgaggucgugggggugguc

SEQ ID NO: 14234 - RNA, 20 nt, Artificial Sequence
  Synthetic
ccggcgggaaggaggagcag

SEQ ID NO: 14235 - RNA, 20 nt, Artificial Sequence
  Synthetic
cggcccgucgguggggcccg

SEQ ID NO: 14236 - RNA, 20 nt, Artificial Sequence
  Synthetic
cgguggggcccggggagccg

SEQ ID NO: 14237 - RNA, 20 nt, Artificial Sequence
  Synthetic
acgccgggggcccguggccg

SEQ ID NO: 14238 - RNA, 20 nt, Artificial Sequence
  Synthetic
ucugccaugggcggggcgcg

SEQ ID NO: 14239 - RNA, 20 nt, Artificial Sequence
  Synthetic
cgcggagacggaggagggcg

SEQ ID NO: 14240 - RNA, 20 nt, Artificial Sequence
  Synthetic
augccaugcggggcggggcg

SEQ ID NO: 14241 - RNA, 20 nt, Artificial Sequence
  Synthetic
augagaugccaugcggggcg

SEQ ID NO: 14242 - RNA, 20 nt, Artificial Sequence
  Synthetic
cccgcccauggcagauggcg

SEQ ID NO: 14243 - RNA, 20 nt, Artificial Sequence
  Synthetic
cccccggcgugccggcgucg

SEQ ID NO: 14244 - RNA, 20 nt, Artificial Sequence
  Synthetic
cguggggguggucggggucg

SEQ ID NO: 14245 - RNA, 20 nt, Artificial Sequence
  Synthetic
cgaggucguggggguggucg

SEQ ID NO: 14246 - RNA, 20 nt, Artificial Sequence
  Synthetic
ccaaugggggggcggcaagg

SEQ ID NO: 14247 - RNA, 20 nt, Artificial Sequence
  Synthetic
cccaggggccggcgggaagg

SEQ ID NO: 14248 - RNA, 20 nt, Artificial Sequence
  Synthetic
cgcggacgaagcgcgggagg

SEQ ID NO: 14249 - RNA, 20 nt, Artificial Sequence
  Synthetic
cgccgggaccaacgggacgg

SEQ ID NO: 14250 - RNA, 20 nt, Artificial Sequence
  Synthetic
ccggccccccgcccccccgg

SEQ ID NO: 14251 - RNA, 20 nt, Artificial Sequence
  Synthetic
cauauagucccaggggccgg

SEQ ID NO: 14252 - RNA, 20 nt, Artificial Sequence
  Synthetic
ccgggggggcggggggccgg

SEQ ID NO: 14253 - RNA, 20 nt, Artificial Sequence
  Synthetic
ccguuggucccggcguccgg

SEQ ID NO: 14254 - RNA, 20 nt, Artificial Sequence
  Synthetic
ugggcccgccgggggggcgg

SEQ ID NO: 14255 - RNA, 20 nt, Artificial Sequence
  Synthetic
ucugggcucggggugggcgg

SEQ ID NO: 14256 - RNA, 20 nt, Artificial Sequence
  Synthetic
ccaugggcggggcgcgaggg

SEQ ID NO: 14257 - RNA, 20 nt, Artificial Sequence
  Synthetic
acgacgcccggcgggacggg

SEQ ID NO: 14258 - RNA, 20 nt, Artificial Sequence
  Synthetic
ugggggggcggcaaggcggg

SEQ ID NO: 14259 - RNA, 20 nt, Artificial Sequence
  Synthetic
cccccccauuggccggcggg

SEQ ID NO: 14260 - RNA, 20 nt, Artificial Sequence
  Synthetic
ucggggugggcccgccgggg

SEQ ID NO: 14261 - RNA, 20 nt, Artificial Sequence
  Synthetic
cccgccggccaauggggggg

SEQ ID NO: 14262 - RNA, 20 nt, Artificial Sequence
  Synthetic
cccgcccgccggccaauggg

SEQ ID NO: 14263 - RNA, 20 nt, Artificial Sequence
  Synthetic
uggcagauggcgcggauggg

SEQ ID NO: 14264 - RNA, 20 nt, Artificial Sequence
  Synthetic
cggucugggcucgggguggg

SEQ ID NO: 14265 - RNA, 20 nt, Artificial Sequence
  Synthetic
caccuacggacucucgaugg

SEQ ID NO: 14266 - RNA, 20 nt, Artificial Sequence
  Synthetic
ugggcggcggcccgucggug

SEQ ID NO: 14267 - RNA, 20 nt, Artificial Sequence
  Synthetic
ccauccgcgccaucugccau

SEQ ID NO: 14268 - RNA, 20 nt, Artificial Sequence
  Synthetic
ccuccuucccgccggccccu

SEQ ID NO: 14269 - RNA, 20 nt, Artificial Sequence
  Synthetic
cgcucgucgcggucugggcu

SEQ ID NO: 14270 - RNA, 20 nt, Artificial Sequence
  Synthetic
cggggugggcggcggcccgu

SEQ ID NO: 14271 - RNA, 20 nt, Artificial Sequence
  Synthetic
cgagcggggggcccucgggu

SEQ ID NO: 14272 - RNA, 20 nt, Artificial Sequence
  Synthetic
ucgcggucugggcucggggu

SEQ ID NO: 14273 - RNA, 20 nt, Artificial Sequence
  Synthetic
cggcaaggcgggcggcccuu

SEQ ID NO: 14274 - RNA, 20 nt, Artificial Sequence
  Synthetic
cgggccccgacuucccgguu

SEQ ID NO: 14275 - RNA, 17 nt, Artificial Sequence
  Synthetic
gcuuacccgugcaaaaa

SEQ ID NO: 14276 - RNA, 17 nt, Artificial Sequence
  Synthetic
cgggaucgcaucggaaa

SEQ ID NO: 14277 - RNA, 17 nt, Artificial Sequence
  Synthetic
cggcccggggccgcgaa

SEQ ID NO: 14278 - RNA, 17 nt, Artificial Sequence
  Synthetic
aucgucgucggcucgaa

SEQ ID NO: 14279 - RNA, 17 nt, Artificial Sequence
  Synthetic
ucgggaucgcaucggaa

SEQ ID NO: 14280 - RNA, 17 nt, Artificial Sequence
  Synthetic
cucuccggcgcacauaa

SEQ ID NO: 14281 - RNA, 17 nt, Artificial Sequence
  Synthetic
cccacccacgaaacaca

SEQ ID NO: 14282 - RNA, 17 nt, Artificial Sequence
  Synthetic
gacggccuccucuacca

SEQ ID NO: 14283 - RNA, 17 nt, Artificial Sequence
  Synthetic
ccuccuccgcccaccca

SEQ ID NO: 14284 - RNA, 17 nt, Artificial Sequence
  Synthetic
cgcguauccggacccca

SEQ ID NO: 14285 - RNA, 17 nt, Artificial Sequence
  Synthetic
ggcucugcuggccucca

SEQ ID NO: 14286 - RNA, 17 nt, Artificial Sequence
  Synthetic
cggcgcggagucgggca

SEQ ID NO: 14287 - RNA, 17 nt, Artificial Sequence
  Synthetic
gguccgccuuuuuugca

SEQ ID NO: 14288 - RNA, 17 nt, Artificial Sequence
  Synthetic
ccgcggagacgucguca

SEQ ID NO: 14289 - RNA, 17 nt, Artificial Sequence
  Synthetic
cgaccgacgcccgcaga

SEQ ID NO: 14290 - RNA, 17 nt, Artificial Sequence
  Synthetic
ggagcgggagucgcaga

SEQ ID NO: 14291 - RNA, 17 nt, Artificial Sequence
  Synthetic
cagcugucgcggcgaga

SEQ ID NO: 14292 - RNA, 17 nt, Artificial Sequence
  Synthetic
gcgccggccacgaacga

SEQ ID NO: 14293 - RNA, 17 nt, Artificial Sequence
  Synthetic
gaggacgaggacgacga

SEQ ID NO: 14294 - RNA, 17 nt, Artificial Sequence
  Synthetic
cgacggaccccgcccga

SEQ ID NO: 14295 - RNA, 17 nt, Artificial Sequence
  Synthetic
gaggucgaugacgccga

SEQ ID NO: 14296 - RNA, 17 nt, Artificial Sequence
  Synthetic
gacgccguccgcuccga

SEQ ID NO: 14297 - RNA, 17 nt, Artificial Sequence
  Synthetic
gccggcgccgcgcucga

SEQ ID NO: 14298 - RNA, 17 nt, Artificial Sequence
  Synthetic
gacgcgggggcggagga

SEQ ID NO: 14299 - RNA, 17 nt, Artificial Sequence
  Synthetic
cuugggugggcggagga

SEQ ID NO: 14300 - RNA, 17 nt, Artificial Sequence
  Synthetic
cgucgggaucguccgga

SEQ ID NO: 14301 - RNA, 17 nt, Artificial Sequence
  Synthetic
agggccgucggagcgga

SEQ ID NO: 14302 - RNA, 17 nt, Artificial Sequence
  Synthetic
cgagccgacgacgauga

SEQ ID NO: 14303 - RNA, 17 nt, Artificial Sequence
  Synthetic
auauauauauauuauua

SEQ ID NO: 14304 - RNA, 17 nt, Artificial Sequence
  Synthetic
ggcccggggccgcgaac

SEQ ID NO: 14305 - RNA, 17 nt, Artificial Sequence
  Synthetic
ccccacccacgaaacac

SEQ ID NO: 14306 - RNA, 17 nt, Artificial Sequence
  Synthetic
cgacgacagaaacccac

SEQ ID NO: 14307 - RNA, 17 nt, Artificial Sequence
  Synthetic
acgccgauggccgccac

SEQ ID NO: 14308 - RNA, 17 nt, Artificial Sequence
  Synthetic
gggcgaagugcgagcac

SEQ ID NO: 14309 - RNA, 17 nt, Artificial Sequence
  Synthetic
guccgccuuuuuugcac

SEQ ID NO: 14310 - RNA, 17 nt, Artificial Sequence
  Synthetic
cgccggccacgaacgac

SEQ ID NO: 14311 - RNA, 17 nt, Artificial Sequence
  Synthetic
ccgacgccgccggcgac

SEQ ID NO: 14312 - RNA, 17 nt, Artificial Sequence
  Synthetic
ccggcgggcgcggcgac

SEQ ID NO: 14313 - RNA, 17 nt, Artificial Sequence
  Synthetic
cugcggagcacgcggac

SEQ ID NO: 14314 - RNA, 17 nt, Artificial Sequence
  Synthetic
gugcaaaaaaggcggac

SEQ ID NO: 14315 - RNA, 17 nt, Artificial Sequence
  Synthetic
gagccgacgacgaugac

SEQ ID NO: 14316 - RNA, 17 nt, Artificial Sequence
  Synthetic
cgacgccgccggcgacc

SEQ ID NO: 14317 - RNA, 17 nt, Artificial Sequence
  Synthetic
cgacgaggacgaggacc

SEQ ID NO: 14318 - RNA, 17 nt, Artificial Sequence
  Synthetic
ugcggagcacgcggacc

SEQ ID NO: 14319 - RNA, 17 nt, Artificial Sequence
  Synthetic
uucucacuucuuuuacc

SEQ ID NO: 14320 - RNA, 17 nt, Artificial Sequence
  Synthetic
acacaggggacgcaccc

SEQ ID NO: 14321 - RNA, 17 nt, Artificial Sequence
  Synthetic
cacaggggacgcacccc

SEQ ID NO: 14322 - RNA, 17 nt, Artificial Sequence
  Synthetic
cggcgccggcagccccc

SEQ ID NO: 14323 - RNA, 17 nt, Artificial Sequence
  Synthetic
cgcccgggcccgccccc

SEQ ID NO: 14324 - RNA, 17 nt, Artificial Sequence
  Synthetic
ugucgucggaggccccc

SEQ ID NO: 14325 - RNA, 17 nt, Artificial Sequence
  Synthetic
gcggcgccggcagcccc

SEQ ID NO: 14326 - RNA, 17 nt, Artificial Sequence
  Synthetic
ccgcccgggcccgcccc

SEQ ID NO: 14327 - RNA, 17 nt, Artificial Sequence
  Synthetic
cugucgucggaggcccc

SEQ ID NO: 14328 - RNA, 17 nt, Artificial Sequence
  Synthetic
gacuccgcgccggcccc

SEQ ID NO: 14329 - RNA, 17 nt, Artificial Sequence
  Synthetic
cucccguucgcggcccc

SEQ ID NO: 14330 - RNA, 17 nt, Artificial Sequence
  Synthetic
ucggcaucgcgacgccc

SEQ ID NO: 14331 - RNA, 17 nt, Artificial Sequence
  Synthetic
cccgccccccgccgccc

SEQ ID NO: 14332 - RNA, 17 nt, Artificial Sequence
  Synthetic
ccgcggccucgccgccc

SEQ ID NO: 14333 - RNA, 17 nt, Artificial Sequence
  Synthetic
cgaccgggccccggccc

SEQ ID NO: 14334 - RNA, 17 nt, Artificial Sequence
  Synthetic
cgacuccgcgccggccc

SEQ ID NO: 14335 - RNA, 17 nt, Artificial Sequence
  Synthetic
ccucccguucgcggccc

SEQ ID NO: 14336 - RNA, 17 nt, Artificial Sequence
  Synthetic
cgccggcgaccgggccc

SEQ ID NO: 14337 - RNA, 17 nt, Artificial Sequence
  Synthetic
gccccgggggcgggccc

SEQ ID NO: 14338 - RNA, 17 nt, Artificial Sequence
  Synthetic
cggcgagacggcguccc

SEQ ID NO: 14339 - RNA, 17 nt, Artificial Sequence
  Synthetic
gaucccgaucccgagcc

SEQ ID NO: 14340 - RNA, 17 nt, Artificial Sequence
  Synthetic
acgccggcgaggacgcc

SEQ ID NO: 14341 - RNA, 17 nt, Artificial Sequence
  Synthetic
acccgccccccgccgcc

SEQ ID NO: 14342 - RNA, 17 nt, Artificial Sequence
  Synthetic
aagggggcggggccgcc

SEQ ID NO: 14343 - RNA, 17 nt, Artificial Sequence
  Synthetic
cgggcgucggucgcgcc

SEQ ID NO: 14344 - RNA, 17 nt, Artificial Sequence
  Synthetic
cggcgcacauaaaggcc

SEQ ID NO: 14345 - RNA, 17 nt, Artificial Sequence
  Synthetic
gcgaccgggccccggcc

SEQ ID NO: 14346 - RNA, 17 nt, Artificial Sequence
  Synthetic
guucgcggccccgggcc

SEQ ID NO: 14347 - RNA, 17 nt, Artificial Sequence
  Synthetic
ggccccgggggcgggcc

SEQ ID NO: 14348 - RNA, 17 nt, Artificial Sequence
  Synthetic
ggccccgggccggggcc

SEQ ID NO: 14349 - RNA, 17 nt, Artificial Sequence
  Synthetic
cgaccucgucggacucc

SEQ ID NO: 14350 - RNA, 17 nt, Artificial Sequence
  Synthetic
ucugcgacucccgcucc

SEQ ID NO: 14351 - RNA, 17 nt, Artificial Sequence
  Synthetic
ucgaaaggcgggggucc

SEQ ID NO: 14352 - RNA, 17 nt, Artificial Sequence
  Synthetic
cgucucgccgcgacagc

SEQ ID NO: 14353 - RNA, 17 nt, Artificial Sequence
  Synthetic
cgaucccgaucccgagc

SEQ ID NO: 14354 - RNA, 17 nt, Artificial Sequence
  Synthetic
gcacgcggaccgggagc

SEQ ID NO: 14355 - RNA, 17 nt, Artificial Sequence
  Synthetic
gauacgcgccgcguagc

SEQ ID NO: 14356 - RNA, 17 nt, Artificial Sequence
  Synthetic
gacgccggcgaggacgc

SEQ ID NO: 14357 - RNA, 17 nt, Artificial Sequence
  Synthetic
aagggacacgcggacgc

SEQ ID NO: 14358 - RNA, 17 nt, Artificial Sequence
  Synthetic
ggaggagggggggacgc

SEQ ID NO: 14359 - RNA, 17 nt, Artificial Sequence
  Synthetic
ccugucgccgcgcccgc

SEQ ID NO: 14360 - RNA, 17 nt, Artificial Sequence
  Synthetic
gacgcagccgacgccgc

SEQ ID NO: 14361 - RNA, 17 nt, Artificial Sequence
  Synthetic
cggggcggcgaggccgc

SEQ ID NO: 14362 - RNA, 17 nt, Artificial Sequence
  Synthetic
caagggggcggggccgc

SEQ ID NO: 14363 - RNA, 17 nt, Artificial Sequence
  Synthetic
cgugcccgacuccgcgc

SEQ ID NO: 14364 - RNA, 17 nt, Artificial Sequence
  Synthetic
gcgggcgucggucgcgc

SEQ ID NO: 14365 - RNA, 17 nt, Artificial Sequence
  Synthetic
ccacgcacgcgaggcgc

SEQ ID NO: 14366 - RNA, 17 nt, Artificial Sequence
  Synthetic
acgcccgcagacggcgc

SEQ ID NO: 14367 - RNA, 17 nt, Artificial Sequence
  Synthetic
uccgucgagcgcggcgc

SEQ ID NO: 14368 - RNA, 17 nt, Artificial Sequence
  Synthetic
cgggccuuuaugugcgc

SEQ ID NO: 14369 - RNA, 17 nt, Artificial Sequence
  Synthetic
guccccggcguccucgc

SEQ ID NO: 14370 - RNA, 17 nt, Artificial Sequence
  Synthetic
ggccggggcccggucgc

SEQ ID NO: 14371 - RNA, 17 nt, Artificial Sequence
  Synthetic
ucgucggcucgaaaggc

SEQ ID NO: 14372 - RNA, 17 nt, Artificial Sequence
  Synthetic
ggagacgucgucacggc

SEQ ID NO: 14373 - RNA, 17 nt, Artificial Sequence
  Synthetic
gcggcggcugggccggc

SEQ ID NO: 14374 - RNA, 17 nt, Artificial Sequence
  Synthetic
gacgucuccgcggcggc

SEQ ID NO: 14375 - RNA, 17 nt, Artificial Sequence
  Synthetic
gggcgggcccgggcggc

SEQ ID NO: 14376 - RNA, 17 nt, Artificial Sequence
  Synthetic
cguucgcggccccgggc

SEQ ID NO: 14377 - RNA, 17 nt, Artificial Sequence
  Synthetic
ggcgcgggccgucgggc

SEQ ID NO: 14378 - RNA, 17 nt, Artificial Sequence
  Synthetic
gggcccgcccccggggc

SEQ ID NO: 14379 - RNA, 17 nt, Artificial Sequence
  Synthetic
gcgccggccccgggggc

SEQ ID NO: 14380 - RNA, 17 nt, Artificial Sequence
  Synthetic
cccgggcggcggggggc

SEQ ID NO: 14381 - RNA, 17 nt, Artificial Sequence
  Synthetic
cuccgcggcggcugggc

SEQ ID NO: 14382 - RNA, 17 nt, Artificial Sequence
  Synthetic
ucguggguggggugggc

SEQ ID NO: 14383 - RNA, 17 nt, Artificial Sequence
  Synthetic
cucccgucguucguggc

SEQ ID NO: 14384 - RNA, 17 nt, Artificial Sequence
  Synthetic
gcgacagcuggcucugc

SEQ ID NO: 14385 - RNA, 17 nt, Artificial Sequence
  Synthetic
uggccggcgccgucugc

SEQ ID NO: 14386 - RNA, 17 nt, Artificial Sequence
  Synthetic
cgccccggcucgggauc

SEQ ID NO: 14387 - RNA, 17 nt, Artificial Sequence
  Synthetic
gcuacgcggcgcguauc

SEQ ID NO: 14388 - RNA, 17 nt, Artificial Sequence
  Synthetic
ucgaccucgucggacuc

SEQ ID NO: 14389 - RNA, 17 nt, Artificial Sequence
  Synthetic
ucgcgacgccccggcuc

SEQ ID NO: 14390 - RNA, 17 nt, Artificial Sequence
  Synthetic
cggggggcgggucucuc

SEQ ID NO: 14391 - RNA, 17 nt, Artificial Sequence
  Synthetic
ggggccggcgcggaguc

SEQ ID NO: 14392 - RNA, 17 nt, Artificial Sequence
  Synthetic
ugguagaggaggccguc

SEQ ID NO: 14393 - RNA, 17 nt, Artificial Sequence
  Synthetic
gcgaggcgcgggccguc

SEQ ID NO: 14394 - RNA, 17 nt, Artificial Sequence
  Synthetic
ccgcggggucgggcguc

SEQ ID NO: 14395 - RNA, 17 nt, Artificial Sequence
  Synthetic
cgggcgucgggaucguc

SEQ ID NO: 14396 - RNA, 17 nt, Artificial Sequence
  Synthetic
ggcgaggccgcgggguc

SEQ ID NO: 14397 - RNA, 17 nt, Artificial Sequence
  Synthetic
cucgaaaggcggggguc

SEQ ID NO: 14398 - RNA, 17 nt, Artificial Sequence
  Synthetic
aggcgguccgugggguc

SEQ ID NO: 14399 - RNA, 17 nt, Artificial Sequence
  Synthetic
ggacgacgaggacgaag

SEQ ID NO: 14400 - RNA, 17 nt, Artificial Sequence
  Synthetic
ccacccacgaaacacag

SEQ ID NO: 14401 - RNA, 17 nt, Artificial Sequence
  Synthetic
gggagcgggagucgcag

SEQ ID NO: 14402 - RNA, 17 nt, Artificial Sequence
  Synthetic
acgcgggggcggaggag

SEQ ID NO: 14403 - RNA, 17 nt, Artificial Sequence
  Synthetic
uugggugggcggaggag

SEQ ID NO: 14404 - RNA, 17 nt, Artificial Sequence
  Synthetic
gcagagggccgucggag

SEQ ID NO: 14405 - RNA, 17 nt, Artificial Sequence
  Synthetic
gccacgaacgacgggag

SEQ ID NO: 14406 - RNA, 17 nt, Artificial Sequence
  Synthetic
agcacgcggaccgggag

SEQ ID NO: 14407 - RNA, 17 nt, Artificial Sequence
  Synthetic
ggauacgcgccgcguag

SEQ ID NO: 14408 - RNA, 17 nt, Artificial Sequence
  Synthetic
gcuggccuccaugguag

SEQ ID NO: 14409 - RNA, 17 nt, Artificial Sequence
  Synthetic
caucggaaagggacacg

SEQ ID NO: 14410 - RNA, 17 nt, Artificial Sequence
  Synthetic
agcggcugcggagcacg

SEQ ID NO: 14411 - RNA, 17 nt, Artificial Sequence
  Synthetic
cgacgacggcaacgacg

SEQ ID NO: 14412 - RNA, 17 nt, Artificial Sequence
  Synthetic
agaggaugcggacgacg

SEQ ID NO: 14413 - RNA, 17 nt, Artificial Sequence
  Synthetic
guccucgucggacgacg

SEQ ID NO: 14414 - RNA, 17 nt, Artificial Sequence
  Synthetic
ggacccggaguccgacg

SEQ ID NO: 14415 - RNA, 17 nt, Artificial Sequence
  Synthetic
guccucgucguccgacg

SEQ ID NO: 14416 - RNA, 17 nt, Artificial Sequence
  Synthetic
ugcggacgacgaggacg

SEQ ID NO: 14417 - RNA, 17 nt, Artificial Sequence
  Synthetic
gucguccgacgaggacg

SEQ ID NO: 14418 - RNA, 17 nt, Artificial Sequence
  Synthetic
aaagggacacgcggacg

SEQ ID NO: 14419 - RNA, 17 nt, Artificial Sequence
  Synthetic
cggaggagggggggacg

SEQ ID NO: 14420 - RNA, 17 nt, Artificial Sequence
  Synthetic
agccgacgacgaugacg

SEQ ID NO: 14421 - RNA, 17 nt, Artificial Sequence
  Synthetic
cgggaggccccgcuacg

SEQ ID NO: 14422 - RNA, 17 nt, Artificial Sequence
  Synthetic
acaggggacgcaccccg

SEQ ID NO: 14423 - RNA, 17 nt, Artificial Sequence
  Synthetic
cccgacgcccgaccccg

SEQ ID NO: 14424 - RNA, 17 nt, Artificial Sequence
  Synthetic
gcccgggcccgcccccg

SEQ ID NO: 14425 - RNA, 17 nt, Artificial Sequence
  Synthetic
gucgucggaggcccccg

SEQ ID NO: 14426 - RNA, 17 nt, Artificial Sequence
  Synthetic
acuccgcgccggccccg

SEQ ID NO: 14427 - RNA, 17 nt, Artificial Sequence
  Synthetic
gaccgggccccggcccg

SEQ ID NO: 14428 - RNA, 17 nt, Artificial Sequence
  Synthetic
aucccgaucccgagccg

SEQ ID NO: 14429 - RNA, 17 nt, Artificial Sequence
  Synthetic
cgccggcgaggacgccg

SEQ ID NO: 14430 - RNA, 17 nt, Artificial Sequence
  Synthetic
cgccggcccagccgccg

SEQ ID NO: 14431 - RNA, 17 nt, Artificial Sequence
  Synthetic
ccggggcggcgaggccg

SEQ ID NO: 14432 - RNA, 17 nt, Artificial Sequence
  Synthetic
uucgcggccccgggccg

SEQ ID NO: 14433 - RNA, 17 nt, Artificial Sequence
  Synthetic
ccgugacgacgucuccg

SEQ ID NO: 14434 - RNA, 17 nt, Artificial Sequence
  Synthetic
cggcgacaggcgguccg

SEQ ID NO: 14435 - RNA, 17 nt, Artificial Sequence
  Synthetic
cgaaaggcggggguccg

SEQ ID NO: 14436 - RNA, 17 nt, Artificial Sequence
  Synthetic
gcgggguccgucgagcg

SEQ ID NO: 14437 - RNA, 17 nt, Artificial Sequence
  Synthetic
auacgcgccgcguagcg

SEQ ID NO: 14438 - RNA, 17 nt, Artificial Sequence
  Synthetic
ggccgaccacgcacgcg

SEQ ID NO: 14439 - RNA, 17 nt, Artificial Sequence
  Synthetic
agggacacgcggacgcg

SEQ ID NO: 14440 - RNA, 17 nt, Artificial Sequence
  Synthetic
gaggagggggggacgcg

SEQ ID NO: 14441 - RNA, 17 nt, Artificial Sequence
  Synthetic
ggggcggcgaggccgcg

SEQ ID NO: 14442 - RNA, 17 nt, Artificial Sequence
  Synthetic
cgucggcucgaaaggcg

SEQ ID NO: 14443 - RNA, 17 nt, Artificial Sequence
  Synthetic
accacgcacgcgaggcg

SEQ ID NO: 14444 - RNA, 17 nt, Artificial Sequence
  Synthetic
gggcaccgacgccggcg

SEQ ID NO: 14445 - RNA, 17 nt, Artificial Sequence
  Synthetic
cgcccccggggccggcg

SEQ ID NO: 14446 - RNA, 17 nt, Artificial Sequence
  Synthetic
ggcgggcccgggcggcg

SEQ ID NO: 14447 - RNA, 17 nt, Artificial Sequence
  Synthetic
ggggguccggggcggcg

SEQ ID NO: 14448 - RNA, 17 nt, Artificial Sequence
  Synthetic
ggcugggccggcgggcg

SEQ ID NO: 14449 - RNA, 17 nt, Artificial Sequence
  Synthetic
gcgcgggccgucgggcg

SEQ ID NO: 14450 - RNA, 17 nt, Artificial Sequence
  Synthetic
cccgcgccucgcgugcg

SEQ ID NO: 14451 - RNA, 17 nt, Artificial Sequence
  Synthetic
agcagagccagcugucg

SEQ ID NO: 14452 - RNA, 17 nt, Artificial Sequence
  Synthetic
gcggggccucccguucg

SEQ ID NO: 14453 - RNA, 17 nt, Artificial Sequence
  Synthetic
gccgcucccgucguucg

SEQ ID NO: 14454 - RNA, 17 nt, Artificial Sequence
  Synthetic
gcguccccuguguuucg

SEQ ID NO: 14455 - RNA, 17 nt, Artificial Sequence
  Synthetic
uacccgugcaaaaaagg

SEQ ID NO: 14456 - RNA, 17 nt, Artificial Sequence
  Synthetic
gucgucggcucgaaagg

SEQ ID NO: 14457 - RNA, 17 nt, Artificial Sequence
  Synthetic
gcgggcgcggcgacagg

SEQ ID NO: 14458 - RNA, 17 nt, Artificial Sequence
  Synthetic
ggccuccaugguagagg

SEQ ID NO: 14459 - RNA, 17 nt, Artificial Sequence
  Synthetic
cgcgggggcggaggagg

SEQ ID NO: 14460 - RNA, 17 nt, Artificial Sequence
  Synthetic
ugggugggcggaggagg

SEQ ID NO: 14461 - RNA, 17 nt, Artificial Sequence
  Synthetic
ggacgcgggggcggagg

SEQ ID NO: 14462 - RNA, 17 nt, Artificial Sequence
  Synthetic
ccuugggugggcggagg

SEQ ID NO: 14463 - RNA, 17 nt, Artificial Sequence
  Synthetic
caaaaaaggcggaccgg

SEQ ID NO: 14464 - RNA, 17 nt, Artificial Sequence
  Synthetic
ucacuucuuuuacccgg

SEQ ID NO: 14465 - RNA, 17 nt, Artificial Sequence
  Synthetic
caggggacgcaccccgg

SEQ ID NO: 14466 - RNA, 17 nt, Artificial Sequence
  Synthetic
cuccgcgccggccccgg

SEQ ID NO: 14467 - RNA, 17 nt, Artificial Sequence
  Synthetic
cggggcccggucgccgg

SEQ ID NO: 14468 - RNA, 17 nt, Artificial Sequence
  Synthetic
gacgucgucacggccgg

SEQ ID NO: 14469 - RNA, 17 nt, Artificial Sequence
  Synthetic
cgcggcggcugggccgg

SEQ ID NO: 14470 - RNA, 17 nt, Artificial Sequence
  Synthetic
gggacacgcggacgcgg

SEQ ID NO: 14471 - RNA, 17 nt, Artificial Sequence
  Synthetic
aggagggggggacgcgg

SEQ ID NO: 14472 - RNA, 17 nt, Artificial Sequence
  Synthetic
ugacgacgucuccgcgg

SEQ ID NO: 14473 - RNA, 17 nt, Artificial Sequence
  Synthetic
gucggcucgaaaggcgg

SEQ ID NO: 14474 - RNA, 17 nt, Artificial Sequence
  Synthetic
gcgggcccgggcggcgg

SEQ ID NO: 14475 - RNA, 17 nt, Artificial Sequence
  Synthetic
ggggcgggcccgggcgg

SEQ ID NO: 14476 - RNA, 17 nt, Artificial Sequence
  Synthetic
gggggacgcgggggcgg

SEQ ID NO: 14477 - RNA, 17 nt, Artificial Sequence
  Synthetic
gcaccuugggugggcgg

SEQ ID NO: 14478 - RNA, 17 nt, Artificial Sequence
  Synthetic
uggguuucugucgucgg

SEQ ID NO: 14479 - RNA, 17 nt, Artificial Sequence
  Synthetic
gcgggggcggaggaggg

SEQ ID NO: 14480 - RNA, 17 nt, Artificial Sequence
  Synthetic
gggugggcggaggaggg

SEQ ID NO: 14481 - RNA, 17 nt, Artificial Sequence
  Synthetic
ccggggccgcgaacggg

SEQ ID NO: 14482 - RNA, 17 nt, Artificial Sequence
  Synthetic
ccgggggcgggcccggg

SEQ ID NO: 14483 - RNA, 17 nt, Artificial Sequence
  Synthetic
ggacacgcggacgcggg

SEQ ID NO: 14484 - RNA, 17 nt, Artificial Sequence
  Synthetic
cgggcccgggcggcggg

SEQ ID NO: 14485 - RNA, 17 nt, Artificial Sequence
  Synthetic
aggcgcgggccgucggg

SEQ ID NO: 14486 - RNA, 17 nt, Artificial Sequence
  Synthetic
ggugggcggaggagggg

SEQ ID NO: 14487 - RNA, 17 nt, Artificial Sequence
  Synthetic
aaggcggggguccgggg

SEQ ID NO: 14488 - RNA, 17 nt, Artificial Sequence
  Synthetic
gacacgcggacgcgggg

SEQ ID NO: 14489 - RNA, 17 nt, Artificial Sequence
  Synthetic
cgcgccggccccggggg

SEQ ID NO: 14490 - RNA, 17 nt, Artificial Sequence
  Synthetic
agggggggacgcggggg

SEQ ID NO: 14491 - RNA, 17 nt, Artificial Sequence
  Synthetic
gcccgggcggcgggggg

SEQ ID NO: 14492 - RNA, 17 nt, Artificial Sequence
  Synthetic
guguuucgugggugggg

SEQ ID NO: 14493 - RNA, 17 nt, Artificial Sequence
  Synthetic
ccccuguguuucguggg

SEQ ID NO: 14494 - RNA, 17 nt, Artificial Sequence
  Synthetic
uucgugggugggguggg

SEQ ID NO: 14495 - RNA, 17 nt, Artificial Sequence
  Synthetic
uaagcaccuuggguggg

SEQ ID NO: 14496 - RNA, 17 nt, Artificial Sequence
  Synthetic
cggguaagcaccuuggg

SEQ ID NO: 14497 - RNA, 17 nt, Artificial Sequence
  Synthetic
ggccuccucuaccaugg

SEQ ID NO: 14498 - RNA, 17 nt, Artificial Sequence
  Synthetic
gucgucacggccggugg

SEQ ID NO: 14499 - RNA, 17 nt, Artificial Sequence
  Synthetic
cgaggacgaagaggaug

SEQ ID NO: 14500 - RNA, 17 nt, Artificial Sequence
  Synthetic
aacgacgggagcggcug

SEQ ID NO: 14501 - RNA, 17 nt, Artificial Sequence
  Synthetic
guggccggcgccgucug

SEQ ID NO: 14502 - RNA, 17 nt, Artificial Sequence
  Synthetic
gcgacaggcgguccgug

SEQ ID NO: 14503 - RNA, 17 nt, Artificial Sequence
  Synthetic
ccuguguuucgugggug

SEQ ID NO: 14504 - RNA, 17 nt, Artificial Sequence
  Synthetic
cggccgguggcggccau

SEQ ID NO: 14505 - RNA, 17 nt, Artificial Sequence
  Synthetic
cgggaucgggaucgcau

SEQ ID NO: 14506 - RNA, 17 nt, Artificial Sequence
  Synthetic
acgccccggcucgggau

SEQ ID NO: 14507 - RNA, 17 nt, Artificial Sequence
  Synthetic
uaauaauauauauauau

SEQ ID NO: 14508 - RNA, 17 nt, Artificial Sequence
  Synthetic
ugcacggguaagcaccu

SEQ ID NO: 14509 - RNA, 17 nt, Artificial Sequence
  Synthetic
cggcggccccgcccccu

SEQ ID NO: 14510 - RNA, 17 nt, Artificial Sequence
  Synthetic
aucgcgacgccccggcu

SEQ ID NO: 14511 - RNA, 17 nt, Artificial Sequence
  Synthetic
acgucuccgcggcggcu

SEQ ID NO: 14512 - RNA, 17 nt, Artificial Sequence
  Synthetic
cggggccggcgcggagu

SEQ ID NO: 14513 - RNA, 17 nt, Artificial Sequence
  Synthetic
gagucgcagagggccgu

SEQ ID NO: 14514 - RNA, 17 nt, Artificial Sequence
  Synthetic
cgcgaggcgcgggccgu

SEQ ID NO: 14515 - RNA, 17 nt, Artificial Sequence
  Synthetic
ggcgacaggcgguccgu

SEQ ID NO: 14516 - RNA, 17 nt, Artificial Sequence
  Synthetic
gucggagcggacggcgu

SEQ ID NO: 14517 - RNA, 17 nt, Artificial Sequence
  Synthetic
ggcguccucgccggcgu

SEQ ID NO: 14518 - RNA, 17 nt, Artificial Sequence
  Synthetic
ccggucgccggcggcgu

SEQ ID NO: 14519 - RNA, 17 nt, Artificial Sequence
  Synthetic
gcgccgucugcgggcgu

SEQ ID NO: 14520 - RNA, 17 nt, Artificial Sequence
  Synthetic
gccgcggggucgggcgu

SEQ ID NO: 14521 - RNA, 17 nt, Artificial Sequence
  Synthetic
ggcgucaucgaccucgu

SEQ ID NO: 14522 - RNA, 17 nt, Artificial Sequence
  Synthetic
gucguccucguccucgu

SEQ ID NO: 14523 - RNA, 17 nt, Artificial Sequence
  Synthetic
guccccgucaucgucgu

SEQ ID NO: 14524 - RNA, 17 nt, Artificial Sequence
  Synthetic
cgguggguuucugucgu

SEQ ID NO: 14525 - RNA, 17 nt, Artificial Sequence
  Synthetic
cguccccuguguuucgu

SEQ ID NO: 14526 - RNA, 17 nt, Artificial Sequence
  Synthetic
aaaaaaggcggaccggu

SEQ ID NO: 14527 - RNA, 17 nt, Artificial Sequence
  Synthetic
cggcgaggccgcggggu

SEQ ID NO: 14528 - RNA, 17 nt, Artificial Sequence
  Synthetic
uguuucguggguggggu

SEQ ID NO: 14529 - RNA, 17 nt, Artificial Sequence
  Synthetic
cccuguguuucgugggu

SEQ ID NO: 14530 - RNA, 17 nt, Artificial Sequence
  Synthetic
ggguaagcaccuugggu

SEQ ID NO: 14531 - RNA, 17 nt, Artificial Sequence
  Synthetic
cgccucgcgugcguggu

SEQ ID NO: 14532 - RNA, 17 nt, Artificial Sequence
  Synthetic
aauaauauauauauauu

SEQ ID NO: 14533 - RNA, 17 nt, Artificial Sequence
  Synthetic
aauauauauauauuauu

SEQ ID NO: 14534 - RNA, 17 nt, Artificial Sequence
  Synthetic
gcacggguaagcaccuu

SEQ ID NO: 14535 - RNA, 17 nt, Artificial Sequence
  Synthetic
ggcggccccgcccccuu

SEQ ID NO: 14536 - RNA, 20 nt, Artificial Sequence
  Synthetic
ggugcuuacccgugcaaaaa

SEQ ID NO: 14537 - RNA, 20 nt, Artificial Sequence
  Synthetic
gaucgggaucgcaucggaaa

SEQ ID NO: 14538 - RNA, 20 nt, Artificial Sequence
  Synthetic
ccccggcccggggccgcgaa

SEQ ID NO: 14539 - RNA, 20 nt, Artificial Sequence
  Synthetic
gucaucgucgucggcucgaa

SEQ ID NO: 14540 - RNA, 20 nt, Artificial Sequence
  Synthetic
ggaucgggaucgcaucggaa

SEQ ID NO: 14541 - RNA, 20 nt, Artificial Sequence
  Synthetic
ggucucuccggcgcacauaa

SEQ ID NO: 14542 - RNA, 20 nt, Artificial Sequence
  Synthetic
caccccacccacgaaacaca

SEQ ID NO: 14543 - RNA, 20 nt, Artificial Sequence
  Synthetic
ccggacggccuccucuacca

SEQ ID NO: 14544 - RNA, 20 nt, Artificial Sequence
  Synthetic
cccccuccuccgcccaccca

SEQ ID NO: 14545 - RNA, 20 nt, Artificial Sequence
  Synthetic
cggcgcguauccggacccca

SEQ ID NO: 14546 - RNA, 20 nt, Artificial Sequence
  Synthetic
gcuggcucugcuggccucca

SEQ ID NO: 14547 - RNA, 20 nt, Artificial Sequence
  Synthetic
ggccggcgcggagucgggca

SEQ ID NO: 14548 - RNA, 20 nt, Artificial Sequence
  Synthetic
accgguccgccuuuuuugca

SEQ ID NO: 14549 - RNA, 20 nt, Artificial Sequence
  Synthetic
ccgccgcggagacgucguca

SEQ ID NO: 14550 - RNA, 20 nt, Artificial Sequence
  Synthetic
gcgcgaccgacgcccgcaga

SEQ ID NO: 14551 - RNA, 20 nt, Artificial Sequence
  Synthetic
ccgggagcgggagucgcaga

SEQ ID NO: 14552 - RNA, 20 nt, Artificial Sequence
  Synthetic
agccagcugucgcggcgaga

SEQ ID NO: 14553 - RNA, 20 nt, Artificial Sequence
  Synthetic
acggcgccggccacgaacga

SEQ ID NO: 14554 - RNA, 20 nt, Artificial Sequence
  Synthetic
gacgaggacgaggacgacga

SEQ ID NO: 14555 - RNA, 20 nt, Artificial Sequence
  Synthetic
gcucgacggaccccgcccga

SEQ ID NO: 14556 - RNA, 20 nt, Artificial Sequence
  Synthetic
gacgaggucgaugacgccga

SEQ ID NO: 14557 - RNA, 20 nt, Artificial Sequence
  Synthetic
gccgacgccguccgcuccga

SEQ ID NO: 14558 - RNA, 20 nt, Artificial Sequence
  Synthetic
gcugccggcgccgcgcucga

SEQ ID NO: 14559 - RNA, 20 nt, Artificial Sequence
  Synthetic
ggggacgcgggggcggagga

SEQ ID NO: 14560 - RNA, 20 nt, Artificial Sequence
  Synthetic
caccuugggugggcggagga

SEQ ID NO: 14561 - RNA, 20 nt, Artificial Sequence
  Synthetic
gggcgucgggaucguccgga

SEQ ID NO: 14562 - RNA, 20 nt, Artificial Sequence
  Synthetic
cagagggccgucggagcgga

SEQ ID NO: 14563 - RNA, 20 nt, Artificial Sequence
  Synthetic
uuucgagccgacgacgauga

SEQ ID NO: 14564 - RNA, 20 nt, Artificial Sequence
  Synthetic
ccaauauauauauauuauua

SEQ ID NO: 14565 - RNA, 20 nt, Artificial Sequence
  Synthetic
cccggcccggggccgcgaac

SEQ ID NO: 14566 - RNA, 20 nt, Artificial Sequence
  Synthetic
ccaccccacccacgaaacac

SEQ ID NO: 14567 - RNA, 20 nt, Artificial Sequence
  Synthetic
cuccgacgacagaaacccac

SEQ ID NO: 14568 - RNA, 20 nt, Artificial Sequence
  Synthetic
augacgccgauggccgccac

SEQ ID NO: 14569 - RNA, 20 nt, Artificial Sequence
  Synthetic
uuagggcgaagugcgagcac

SEQ ID NO: 14570 - RNA, 20 nt, Artificial Sequence
  Synthetic
ccgguccgccuuuuuugcac

SEQ ID NO: 14571 - RNA, 20 nt, Artificial Sequence
  Synthetic
cggcgccggccacgaacgac

SEQ ID NO: 14572 - RNA, 20 nt, Artificial Sequence
  Synthetic
cagccgacgccgccggcgac

SEQ ID NO: 14573 - RNA, 20 nt, Artificial Sequence
  Synthetic
gggccggcgggcgcggcgac

SEQ ID NO: 14574 - RNA, 20 nt, Artificial Sequence
  Synthetic
cggcugcggagcacgcggac

SEQ ID NO: 14575 - RNA, 20 nt, Artificial Sequence
  Synthetic
cccgugcaaaaaaggcggac

SEQ ID NO: 14576 - RNA, 20 nt, Artificial Sequence
  Synthetic
uucgagccgacgacgaugac

SEQ ID NO: 14577 - RNA, 20 nt, Artificial Sequence
  Synthetic
agccgacgccgccggcgacc

SEQ ID NO: 14578 - RNA, 20 nt, Artificial Sequence
  Synthetic
ggacgacgaggacgaggacc

SEQ ID NO: 14579 - RNA, 20 nt, Artificial Sequence
  Synthetic
ggcugcggagcacgcggacc

SEQ ID NO: 14580 - RNA, 20 nt, Artificial Sequence
  Synthetic
gcguucucacuucuuuuacc

SEQ ID NO: 14581 - RNA, 20 nt, Artificial Sequence
  Synthetic
gaaacacaggggacgcaccc

SEQ ID NO: 14582 - RNA, 20 nt, Artificial Sequence
  Synthetic
aaacacaggggacgcacccc

SEQ ID NO: 14583 - RNA, 20 nt, Artificial Sequence
  Synthetic
gcgcggcgccggcagccccc

SEQ ID NO: 14584 - RNA, 20 nt, Artificial Sequence
  Synthetic
cgccgcccgggcccgccccc

SEQ ID NO: 14585 - RNA, 20 nt, Artificial Sequence
  Synthetic
uucugucgucggaggccccc

SEQ ID NO: 14586 - RNA, 20 nt, Artificial Sequence
  Synthetic
agcgcggcgccggcagcccc

SEQ ID NO: 14587 - RNA, 20 nt, Artificial Sequence
  Synthetic
ccgccgcccgggcccgcccc

SEQ ID NO: 14588 - RNA, 20 nt, Artificial Sequence
  Synthetic
uuucugucgucggaggcccc

SEQ ID NO: 14589 - RNA, 20 nt, Artificial Sequence
  Synthetic
cccgacuccgcgccggcccc

SEQ ID NO: 14590 - RNA, 20 nt, Artificial Sequence
  Synthetic
ggccucccguucgcggcccc

SEQ ID NO: 14591 - RNA, 20 nt, Artificial Sequence
  Synthetic
gcgucggcaucgcgacgccc

SEQ ID NO: 14592 - RNA, 20 nt, Artificial Sequence
  Synthetic
agacccgccccccgccgccc

SEQ ID NO: 14593 - RNA, 20 nt, Artificial Sequence
  Synthetic
accccgcggccucgccgccc

SEQ ID NO: 14594 - RNA, 20 nt, Artificial Sequence
  Synthetic
cggcgaccgggccccggccc

SEQ ID NO: 14595 - RNA, 20 nt, Artificial Sequence
  Synthetic
gcccgacuccgcgccggccc

SEQ ID NO: 14596 - RNA, 20 nt, Artificial Sequence
  Synthetic
gggccucccguucgcggccc

SEQ ID NO: 14597 - RNA, 20 nt, Artificial Sequence
  Synthetic
cgccgccggcgaccgggccc

SEQ ID NO: 14598 - RNA, 20 nt, Artificial Sequence
  Synthetic
ccggccccgggggcgggccc

SEQ ID NO: 14599 - RNA, 20 nt, Artificial Sequence
  Synthetic
ucgcggcgagacggcguccc

SEQ ID NO: 14600 - RNA, 20 nt, Artificial Sequence
  Synthetic
ugcgaucccgaucccgagcc

SEQ ID NO: 14601 - RNA, 20 nt, Artificial Sequence
  Synthetic
ccgacgccggcgaggacgcc

SEQ ID NO: 14602 - RNA, 20 nt, Artificial Sequence
  Synthetic
gagacccgccccccgccgcc

SEQ ID NO: 14603 - RNA, 20 nt, Artificial Sequence
  Synthetic
cccaagggggcggggccgcc

SEQ ID NO: 14604 - RNA, 20 nt, Artificial Sequence
  Synthetic
cugcgggcgucggucgcgcc

SEQ ID NO: 14605 - RNA, 20 nt, Artificial Sequence
  Synthetic
cuccggcgcacauaaaggcc

SEQ ID NO: 14606 - RNA, 20 nt, Artificial Sequence
  Synthetic
ccggcgaccgggccccggcc

SEQ ID NO: 14607 - RNA, 20 nt, Artificial Sequence
  Synthetic
cccguucgcggccccgggcc

SEQ ID NO: 14608 - RNA, 20 nt, Artificial Sequence
  Synthetic
gccggccccgggggcgggcc

SEQ ID NO: 14609 - RNA, 20 nt, Artificial Sequence
  Synthetic
cgcggccccgggccggggcc

SEQ ID NO: 14610 - RNA, 20 nt, Artificial Sequence
  Synthetic
caucgaccucgucggacucc

SEQ ID NO: 14611 - RNA, 20 nt, Artificial Sequence
  Synthetic
cccucugcgacucccgcucc

SEQ ID NO: 14612 - RNA, 20 nt, Artificial Sequence
  Synthetic
ggcucgaaaggcgggggucc

SEQ ID NO: 14613 - RNA, 20 nt, Artificial Sequence
  Synthetic
cgccgucucgccgcgacagc

SEQ ID NO: 14614 - RNA, 20 nt, Artificial Sequence
  Synthetic
augcgaucccgaucccgagc

SEQ ID NO: 14615 - RNA, 20 nt, Artificial Sequence
  Synthetic
ggagcacgcggaccgggagc

SEQ ID NO: 14616 - RNA, 20 nt, Artificial Sequence
  Synthetic
ccggauacgcgccgcguagc

SEQ ID NO: 14617 - RNA, 20 nt, Artificial Sequence
  Synthetic
accgacgccggcgaggacgc

SEQ ID NO: 14618 - RNA, 20 nt, Artificial Sequence
  Synthetic
ggaaagggacacgcggacgc

SEQ ID NO: 14619 - RNA, 20 nt, Artificial Sequence
  Synthetic
ggcggaggagggggggacgc

SEQ ID NO: 14620 - RNA, 20 nt, Artificial Sequence
  Synthetic
ccgccugucgccgcgcccgc

SEQ ID NO: 14621 - RNA, 20 nt, Artificial Sequence
  Synthetic
gacgacgcagccgacgccgc

SEQ ID NO: 14622 - RNA, 20 nt, Artificial Sequence
  Synthetic
guccggggcggcgaggccgc

SEQ ID NO: 14623 - RNA, 20 nt, Artificial Sequence
  Synthetic
cgccgugcccgacuccgcgc

SEQ ID NO: 14624 - RNA, 20 nt, Artificial Sequence
  Synthetic
ucugcgggcgucggucgcgc

SEQ ID NO: 14625 - RNA, 20 nt, Artificial Sequence
  Synthetic
cgaccacgcacgcgaggcgc

SEQ ID NO: 14626 - RNA, 20 nt, Artificial Sequence
  Synthetic
ccgacgcccgcagacggcgc

SEQ ID NO: 14627 - RNA, 20 nt, Artificial Sequence
  Synthetic
ggguccgucgagcgcggcgc

SEQ ID NO: 14628 - RNA, 20 nt, Artificial Sequence
  Synthetic
cgccgggccuuuaugugcgc

SEQ ID NO: 14629 - RNA, 20 nt, Artificial Sequence
  Synthetic
ggcguccccggcguccucgc

SEQ ID NO: 14630 - RNA, 20 nt, Artificial Sequence
  Synthetic
ccgggccggggcccggucgc

SEQ ID NO: 14631 - RNA, 20 nt, Artificial Sequence
  Synthetic
ucgucgucggcucgaaaggc

SEQ ID NO: 14632 - RNA, 20 nt, Artificial Sequence
  Synthetic
cgcggagacgucgucacggc

SEQ ID NO: 14633 - RNA, 20 nt, Artificial Sequence
  Synthetic
uccgcggcggcugggccggc

SEQ ID NO: 14634 - RNA, 20 nt, Artificial Sequence
  Synthetic
gacgacgucuccgcggcggc

SEQ ID NO: 14635 - RNA, 20 nt, Artificial Sequence
  Synthetic
cgggggcgggcccgggcggc

SEQ ID NO: 14636 - RNA, 20 nt, Artificial Sequence
  Synthetic
ucccguucgcggccccgggc

SEQ ID NO: 14637 - RNA, 20 nt, Artificial Sequence
  Synthetic
cgaggcgcgggccgucgggc

SEQ ID NO: 14638 - RNA, 20 nt, Artificial Sequence
  Synthetic
cccgggcccgcccccggggc

SEQ ID NO: 14639 - RNA, 20 nt, Artificial Sequence
  Synthetic
uccgcgccggccccgggggc

SEQ ID NO: 14640 - RNA, 20 nt, Artificial Sequence
  Synthetic
gggcccgggcggcggggggc

SEQ ID NO: 14641 - RNA, 20 nt, Artificial Sequence
  Synthetic
cgucuccgcggcggcugggc

SEQ ID NO: 14642 - RNA, 20 nt, Artificial Sequence
  Synthetic
guuucguggguggggugggc

SEQ ID NO: 14643 - RNA, 20 nt, Artificial Sequence
  Synthetic
ccgcucccgucguucguggc

SEQ ID NO: 14644 - RNA, 20 nt, Artificial Sequence
  Synthetic
gccgcgacagcuggcucugc

SEQ ID NO: 14645 - RNA, 20 nt, Artificial Sequence
  Synthetic
ucguggccggcgccgucugc

SEQ ID NO: 14646 - RNA, 20 nt, Artificial Sequence
  Synthetic
cgacgccccggcucgggauc

SEQ ID NO: 14647 - RNA, 20 nt, Artificial Sequence
  Synthetic
cccgcuacgcggcgcguauc

SEQ ID NO: 14648 - RNA, 20 nt, Artificial Sequence
  Synthetic
ucaucgaccucgucggacuc

SEQ ID NO: 14649 - RNA, 20 nt, Artificial Sequence
  Synthetic
gcaucgcgacgccccggcuc

SEQ ID NO: 14650 - RNA, 20 nt, Artificial Sequence
  Synthetic
cggcggggggcgggucucuc

SEQ ID NO: 14651 - RNA, 20 nt, Artificial Sequence
  Synthetic
cccggggccggcgcggaguc

SEQ ID NO: 14652 - RNA, 20 nt, Artificial Sequence
  Synthetic
ccaugguagaggaggccguc

SEQ ID NO: 14653 - RNA, 20 nt, Artificial Sequence
  Synthetic
cacgcgaggcgcgggccguc

SEQ ID NO: 14654 - RNA, 20 nt, Artificial Sequence
  Synthetic
aggccgcggggucgggcguc

SEQ ID NO: 14655 - RNA, 20 nt, Artificial Sequence
  Synthetic
ggucgggcgucgggaucguc

SEQ ID NO: 14656 - RNA, 20 nt, Artificial Sequence
  Synthetic
ggcggcgaggccgcgggguc

SEQ ID NO: 14657 - RNA, 20 nt, Artificial Sequence
  Synthetic
cggcucgaaaggcggggguc

SEQ ID NO: 14658 - RNA, 20 nt, Artificial Sequence
  Synthetic
gacaggcgguccgugggguc

SEQ ID NO: 14659 - RNA, 20 nt, Artificial Sequence
  Synthetic
gucggacgacgaggacgaag

SEQ ID NO: 14660 - RNA, 20 nt, Artificial Sequence
  Synthetic
accccacccacgaaacacag

SEQ ID NO: 14661 - RNA, 20 nt, Artificial Sequence
  Synthetic
accgggagcgggagucgcag

SEQ ID NO: 14662 - RNA, 20 nt, Artificial Sequence
  Synthetic
gggacgcgggggcggaggag

SEQ ID NO: 14663 - RNA, 20 nt, Artificial Sequence
  Synthetic
accuugggugggcggaggag

SEQ ID NO: 14664 - RNA, 20 nt, Artificial Sequence
  Synthetic
gucgcagagggccgucggag

SEQ ID NO: 14665 - RNA, 20 nt, Artificial Sequence
  Synthetic
ccggccacgaacgacgggag

SEQ ID NO: 14666 - RNA, 20 nt, Artificial Sequence
  Synthetic
cggagcacgcggaccgggag

SEQ ID NO: 14667 - RNA, 20 nt, Artificial Sequence
  Synthetic
uccggauacgcgccgcguag

SEQ ID NO: 14668 - RNA, 20 nt, Artificial Sequence
  Synthetic
ucugcuggccuccaugguag

SEQ ID NO: 14669 - RNA, 20 nt, Artificial Sequence
  Synthetic
ucgcaucggaaagggacacg

SEQ ID NO: 14670 - RNA, 20 nt, Artificial Sequence
  Synthetic
gggagcggcugcggagcacg

SEQ ID NO: 14671 - RNA, 20 nt, Artificial Sequence
  Synthetic
ggacgacgacggcaacgacg

SEQ ID NO: 14672 - RNA, 20 nt, Artificial Sequence
  Synthetic
cgaagaggaugcggacgacg

SEQ ID NO: 14673 - RNA, 20 nt, Artificial Sequence
  Synthetic
cucguccucgucggacgacg

SEQ ID NO: 14674 - RNA, 20 nt, Artificial Sequence
  Synthetic
cgaggacccggaguccgacg

SEQ ID NO: 14675 - RNA, 20 nt, Artificial Sequence
  Synthetic
uucguccucgucguccgacg

SEQ ID NO: 14676 - RNA, 20 nt, Artificial Sequence
  Synthetic
ggaugcggacgacgaggacg

SEQ ID NO: 14677 - RNA, 20 nt, Artificial Sequence
  Synthetic
cucgucguccgacgaggacg

SEQ ID NO: 14678 - RNA, 20 nt, Artificial Sequence
  Synthetic
cggaaagggacacgcggacg

SEQ ID NO: 14679 - RNA, 20 nt, Artificial Sequence
  Synthetic
gggcggaggagggggggacg

SEQ ID NO: 14680 - RNA, 20 nt, Artificial Sequence
  Synthetic
ucgagccgacgacgaugacg

SEQ ID NO: 14681 - RNA, 20 nt, Artificial Sequence
  Synthetic
gaacgggaggccccgcuacg

SEQ ID NO: 14682 - RNA, 20 nt, Artificial Sequence
  Synthetic
aacacaggggacgcaccccg

SEQ ID NO: 14683 - RNA, 20 nt, Artificial Sequence
  Synthetic
gaucccgacgcccgaccccg

SEQ ID NO: 14684 - RNA, 20 nt, Artificial Sequence
  Synthetic
gccgcccgggcccgcccccg

SEQ ID NO: 14685 - RNA, 20 nt, Artificial Sequence
  Synthetic
ucugucgucggaggcccccg

SEQ ID NO: 14686 - RNA, 20 nt, Artificial Sequence
  Synthetic
ccgacuccgcgccggccccg

SEQ ID NO: 14687 - RNA, 20 nt, Artificial Sequence
  Synthetic
ggcgaccgggccccggcccg

SEQ ID NO: 14688 - RNA, 20 nt, Artificial Sequence
  Synthetic
gcgaucccgaucccgagccg

SEQ ID NO: 14689 - RNA, 20 nt, Artificial Sequence
  Synthetic
cgacgccggcgaggacgccg

SEQ ID NO: 14690 - RNA, 20 nt, Artificial Sequence
  Synthetic
gcccgccggcccagccgccg

SEQ ID NO: 14691 - RNA, 20 nt, Artificial Sequence
  Synthetic
gguccggggcggcgaggccg

SEQ ID NO: 14692 - RNA, 20 nt, Artificial Sequence
  Synthetic
ccguucgcggccccgggccg

SEQ ID NO: 14693 - RNA, 20 nt, Artificial Sequence
  Synthetic
cggccgugacgacgucuccg

SEQ ID NO: 14694 - RNA, 20 nt, Artificial Sequence
  Synthetic
gcgcggcgacaggcgguccg

SEQ ID NO: 14695 - RNA, 20 nt, Artificial Sequence
  Synthetic
gcucgaaaggcggggguccg

SEQ ID NO: 14696 - RNA, 20 nt, Artificial Sequence
  Synthetic
cgggcgggguccgucgagcg

SEQ ID NO: 14697 - RNA, 20 nt, Artificial Sequence
  Synthetic
cggauacgcgccgcguagcg

SEQ ID NO: 14698 - RNA, 20 nt, Artificial Sequence
  Synthetic
cgcggccgaccacgcacgcg

SEQ ID NO: 14699 - RNA, 20 nt, Artificial Sequence
  Synthetic
gaaagggacacgcggacgcg

SEQ ID NO: 14700 - RNA, 20 nt, Artificial Sequence
  Synthetic
gcggaggagggggggacgcg

SEQ ID NO: 14701 - RNA, 20 nt, Artificial Sequence
  Synthetic
uccggggcggcgaggccgcg

SEQ ID NO: 14702 - RNA, 20 nt, Artificial Sequence
  Synthetic
cgucgucggcucgaaaggcg

SEQ ID NO: 14703 - RNA, 20 nt, Artificial Sequence
  Synthetic
ccgaccacgcacgcgaggcg

SEQ ID NO: 14704 - RNA, 20 nt, Artificial Sequence
  Synthetic
gcccgcccccggggccggcg

SEQ ID NO: 14705 - RNA, 20 nt, Artificial Sequence
  Synthetic
gggggcgggcccgggcggcg

SEQ ID NO: 14706 - RNA, 20 nt, Artificial Sequence
  Synthetic
ggcggggguccggggcggcg

SEQ ID NO: 14707 - RNA, 20 nt, Artificial Sequence
  Synthetic
ggcggcugggccggcgggcg

SEQ ID NO: 14708 - RNA, 20 nt, Artificial Sequence
  Synthetic
gaggcgcgggccgucgggcg

SEQ ID NO: 14709 - RNA, 20 nt, Artificial Sequence
  Synthetic
cggcccgcgccucgcgugcg

SEQ ID NO: 14710 - RNA, 20 nt, Artificial Sequence
  Synthetic
gccagcagagccagcugucg

SEQ ID NO: 14711 - RNA, 20 nt, Artificial Sequence
  Synthetic
guagcggggccucccguucg

SEQ ID NO: 14712 - RNA, 20 nt, Artificial Sequence
  Synthetic
gcagccgcucccgucguucg

SEQ ID NO: 14713 - RNA, 20 nt, Artificial Sequence
  Synthetic
ggugcguccccuguguuucg

SEQ ID NO: 14714 - RNA, 20 nt, Artificial Sequence
  Synthetic
gcuuacccgugcaaaaaagg

SEQ ID NO: 14715 - RNA, 20 nt, Artificial Sequence
  Synthetic
aucgucgucggcucgaaagg

SEQ ID NO: 14716 - RNA, 20 nt, Artificial Sequence
  Synthetic
ccggcgggcgcggcgacagg

SEQ ID NO: 14717 - RNA, 20 nt, Artificial Sequence
  Synthetic
gcuggccuccaugguagagg

SEQ ID NO: 14718 - RNA, 20 nt, Artificial Sequence
  Synthetic
ggacgcgggggcggaggagg

SEQ ID NO: 14719 - RNA, 20 nt, Artificial Sequence
  Synthetic
ccuugggugggcggaggagg

SEQ ID NO: 14720 - RNA, 20 nt, Artificial Sequence
  Synthetic
gggggacgcgggggcggagg

SEQ ID NO: 14721 - RNA, 20 nt, Artificial Sequence
  Synthetic
gcaccuugggugggcggagg

SEQ ID NO: 14722 - RNA, 20 nt, Artificial Sequence
  Synthetic
gugcaaaaaaggcggaccgg

SEQ ID NO: 14723 - RNA, 20 nt, Artificial Sequence
  Synthetic
uucucacuucuuuuacccgg

SEQ ID NO: 14724 - RNA, 20 nt, Artificial Sequence
  Synthetic
acacaggggacgcaccccgg

SEQ ID NO: 14725 - RNA, 20 nt, Artificial Sequence
  Synthetic
cgacuccgcgccggccccgg

SEQ ID NO: 14726 - RNA, 20 nt, Artificial Sequence
  Synthetic
ggccggggcccggucgccgg

SEQ ID NO: 14727 - RNA, 20 nt, Artificial Sequence
  Synthetic
ggagacgucgucacggccgg

SEQ ID NO: 14728 - RNA, 20 nt, Artificial Sequence
  Synthetic
cuccgcggcggcugggccgg

SEQ ID NO: 14729 - RNA, 20 nt, Artificial Sequence
  Synthetic
aaagggacacgcggacgcgg

SEQ ID NO: 14730 - RNA, 20 nt, Artificial Sequence
  Synthetic
cggaggagggggggacgcgg

SEQ ID NO: 14731 - RNA, 20 nt, Artificial Sequence
  Synthetic
ccgugacgacgucuccgcgg

SEQ ID NO: 14732 - RNA, 20 nt, Artificial Sequence
  Synthetic
gucgucggcucgaaaggcgg

SEQ ID NO: 14733 - RNA, 20 nt, Artificial Sequence
  Synthetic
ggggcgggcccgggcggcgg

SEQ ID NO: 14734 - RNA, 20 nt, Artificial Sequence
  Synthetic
ccgggggcgggcccgggcgg

SEQ ID NO: 14735 - RNA, 20 nt, Artificial Sequence
  Synthetic
agggggggacgcgggggcgg

SEQ ID NO: 14736 - RNA, 20 nt, Artificial Sequence
  Synthetic
uaagcaccuugggugggcgg

SEQ ID NO: 14737 - RNA, 20 nt, Artificial Sequence
  Synthetic
cgguggguuucugucgucgg

SEQ ID NO: 14738 - RNA, 20 nt, Artificial Sequence
  Synthetic
gacgcgggggcggaggaggg

SEQ ID NO: 14739 - RNA, 20 nt, Artificial Sequence
  Synthetic
cuugggugggcggaggaggg

SEQ ID NO: 14740 - RNA, 20 nt, Artificial Sequence
  Synthetic
ggcccggggccgcgaacggg

SEQ ID NO: 14741 - RNA, 20 nt, Artificial Sequence
  Synthetic
gccccgggggcgggcccggg

SEQ ID NO: 14742 - RNA, 20 nt, Artificial Sequence
  Synthetic
aagggacacgcggacgcggg

SEQ ID NO: 14743 - RNA, 20 nt, Artificial Sequence
  Synthetic
gggcgggcccgggcggcggg

SEQ ID NO: 14744 - RNA, 20 nt, Artificial Sequence
  Synthetic
gcgaggcgcgggccgucggg

SEQ ID NO: 14745 - RNA, 20 nt, Artificial Sequence
  Synthetic
uugggugggcggaggagggg

SEQ ID NO: 14746 - RNA, 20 nt, Artificial Sequence
  Synthetic
cgaaaggcggggguccgggg

SEQ ID NO: 14747 - RNA, 20 nt, Artificial Sequence
  Synthetic
agggacacgcggacgcgggg

SEQ ID NO: 14748 - RNA, 20 nt, Artificial Sequence
  Synthetic
cuccgcgccggccccggggg

SEQ ID NO: 14749 - RNA, 20 nt, Artificial Sequence
  Synthetic
aggagggggggacgcggggg

SEQ ID NO: 14750 - RNA, 20 nt, Artificial Sequence
  Synthetic
cgggcccgggcggcgggggg

SEQ ID NO: 14751 - RNA, 20 nt, Artificial Sequence
  Synthetic
ccuguguuucgugggugggg

SEQ ID NO: 14752 - RNA, 20 nt, Artificial Sequence
  Synthetic
cguccccuguguuucguggg

SEQ ID NO: 14753 - RNA, 20 nt, Artificial Sequence
  Synthetic
uguuucgugggugggguggg

SEQ ID NO: 14754 - RNA, 20 nt, Artificial Sequence
  Synthetic
ggguaagcaccuuggguggg

SEQ ID NO: 14755 - RNA, 20 nt, Artificial Sequence
  Synthetic
gcacggguaagcaccuuggg

SEQ ID NO: 14756 - RNA, 20 nt, Artificial Sequence
  Synthetic
gacggccuccucuaccaugg

SEQ ID NO: 14757 - RNA, 20 nt, Artificial Sequence
  Synthetic
gacgucgucacggccggugg

SEQ ID NO: 14758 - RNA, 20 nt, Artificial Sequence
  Synthetic
cgacgaggacgaagaggaug

SEQ ID NO: 14759 - RNA, 20 nt, Artificial Sequence
  Synthetic
acgaacgacgggagcggcug

SEQ ID NO: 14760 - RNA, 20 nt, Artificial Sequence
  Synthetic
uucguggccggcgccgucug

SEQ ID NO: 14761 - RNA, 20 nt, Artificial Sequence
  Synthetic
gcggcgacaggcgguccgug

SEQ ID NO: 14762 - RNA, 20 nt, Artificial Sequence
  Synthetic
uccccuguguuucgugggug

SEQ ID NO: 14763 - RNA, 20 nt, Artificial Sequence
  Synthetic
ucacggccgguggcggccau

SEQ ID NO: 14764 - RNA, 20 nt, Artificial Sequence
  Synthetic
gcucgggaucgggaucgcau

SEQ ID NO: 14765 - RNA, 20 nt, Artificial Sequence
  Synthetic
gcgacgccccggcucgggau

SEQ ID NO: 14766 - RNA, 20 nt, Artificial Sequence
  Synthetic
cccuaauaauauauauauau

SEQ ID NO: 14767 - RNA, 20 nt, Artificial Sequence
  Synthetic
uuuugcacggguaagcaccu

SEQ ID NO: 14768 - RNA, 20 nt, Artificial Sequence
  Synthetic
acccggcggccccgcccccu

SEQ ID NO: 14769 - RNA, 20 nt, Artificial Sequence
  Synthetic
ggcaucgcgacgccccggcu

SEQ ID NO: 14770 - RNA, 20 nt, Artificial Sequence
  Synthetic
acgacgucuccgcggcggcu

SEQ ID NO: 14771 - RNA, 20 nt, Artificial Sequence
  Synthetic
ccccggggccggcgcggagu

SEQ ID NO: 14772 - RNA, 20 nt, Artificial Sequence
  Synthetic
cgggagucgcagagggccgu

SEQ ID NO: 14773 - RNA, 20 nt, Artificial Sequence
  Synthetic
gcacgcgaggcgcgggccgu

SEQ ID NO: 14774 - RNA, 20 nt, Artificial Sequence
  Synthetic
cgcggcgacaggcgguccgu

SEQ ID NO: 14775 - RNA, 20 nt, Artificial Sequence
  Synthetic
gccgucggagcggacggcgu

SEQ ID NO: 14776 - RNA, 20 nt, Artificial Sequence
  Synthetic
cccggcguccucgccggcgu

SEQ ID NO: 14777 - RNA, 20 nt, Artificial Sequence
  Synthetic
ggcccggucgccggcggcgu

SEQ ID NO: 14778 - RNA, 20 nt, Artificial Sequence
  Synthetic
ccggcgccgucugcgggcgu

SEQ ID NO: 14779 - RNA, 20 nt, Artificial Sequence
  Synthetic
gaggccgcggggucgggcgu

SEQ ID NO: 14780 - RNA, 20 nt, Artificial Sequence
  Synthetic
aucggcgucaucgaccucgu

SEQ ID NO: 14781 - RNA, 20 nt, Artificial Sequence
  Synthetic
gucgucguccucguccucgu

SEQ ID NO: 14782 - RNA, 20 nt, Artificial Sequence
  Synthetic
cucguccccgucaucgucgu

SEQ ID NO: 14783 - RNA, 20 nt, Artificial Sequence
  Synthetic
gaccgguggguuucugucgu

SEQ ID NO: 14784 - RNA, 20 nt, Artificial Sequence
  Synthetic
gugcguccccuguguuucgu

SEQ ID NO: 14785 - RNA, 20 nt, Artificial Sequence
  Synthetic
ugcaaaaaaggcggaccggu

SEQ ID NO: 14786 - RNA, 20 nt, Artificial Sequence
  Synthetic
gggcggcgaggccgcggggu

SEQ ID NO: 14787 - RNA, 20 nt, Artificial Sequence
  Synthetic
cuguguuucguggguggggu

SEQ ID NO: 14788 - RNA, 20 nt, Artificial Sequence
  Synthetic
guccccuguguuucgugggu

SEQ ID NO: 14789 - RNA, 20 nt, Artificial Sequence
  Synthetic
cacggguaagcaccuugggu

SEQ ID NO: 14790 - RNA, 20 nt, Artificial Sequence
  Synthetic
ccgcgccucgcgugcguggu

SEQ ID NO: 14791 - RNA, 20 nt, Artificial Sequence
  Synthetic
ccuaauaauauauauauauu

SEQ ID NO: 14792 - RNA, 20 nt, Artificial Sequence
  Synthetic
cccaauauauauauauuauu

SEQ ID NO: 14793 - RNA, 20 nt, Artificial Sequence
  Synthetic
uuugcacggguaagcaccuu

SEQ ID NO: 14794 - RNA, 20 nt, Artificial Sequence
  Synthetic
cccggcggccccgcccccuu

SEQ ID NO: 14795 - RNA, 18 nt, Artificial Sequence
  Synthetic
gaugcggggcgauccucc

SEQ ID NO: 14796 - RNA, 21 nt, Artificial Sequence
  Synthetic
gccgaugcggggcgauccucc

SEQ ID NO: 14797 - RNA, 18 nt, Artificial Sequence
  Synthetic
gcgcggaccggucgaugc

SEQ ID NO: 14798 - RNA, 24 nt, Artificial Sequence
  Synthetic
gaacuagcgcggaccggucgaugc

SEQ ID NO: 14799 - RNA, 18 nt, Artificial Sequence
  Synthetic
gcggucccgcgucggguc

SEQ ID NO: 14800 - RNA, 19 nt, Artificial Sequence
  Synthetic
ggcggucccgcgucggguc

SEQ ID NO: 14801 - RNA, 18 nt, Artificial Sequence
  Synthetic
gucucuggcggucccgcg

SEQ ID NO: 14802 - RNA, 22 nt, Artificial Sequence
  Synthetic
gucugucucuggcggucccgcg

SEQ ID NO: 14803 - RNA, 23 nt, Artificial Sequence
  Synthetic
ggucugucucuggcggucccgcg

SEQ ID NO: 14804 - RNA, 24 nt, Artificial Sequence
  Synthetic
gccaugggcggggcgcgagggcgg

SEQ ID NO: 14805 - RNA, 18 nt, Artificial Sequence
  Synthetic
gggcgucgucgaggucgu

SEQ ID NO: 14806 - RNA, 21 nt, Artificial Sequence
  Synthetic
gccgggcgucgucgaggucgu

SEQ ID NO: 14807 - RNA, 18 nt, Artificial Sequence
  Synthetic
gguggucggggucguggu

SEQ ID NO: 14808 - RNA, 19 nt, Artificial Sequence
  Synthetic
ggguggucggggucguggu

SEQ ID NO: 14809 - RNA, 20 nt, Artificial Sequence
  Synthetic
gggguggucggggucguggu

SEQ ID NO: 14810 - RNA, 21 nt, Artificial Sequence
  Synthetic
ggggguggucggggucguggu

SEQ ID NO: 14811 - RNA, 23 nt, Artificial Sequence
  Synthetic
guggggguggucggggucguggu

SEQ ID NO: 14812 - RNA, 23 nt, Artificial Sequence
  Synthetic
gucgucgaggucguggggguggu

SEQ ID NO: 14813 - RNA, 18 nt, Artificial Sequence
  Synthetic
gggcggggucgugcauaa

SEQ ID NO: 14814 - RNA, 19 nt, Artificial Sequence
  Synthetic
ggggcggggucgugcauaa

SEQ ID NO: 14815 - RNA, 22 nt, Artificial Sequence
  Synthetic
gucggggcggggucgugcauaa

SEQ ID NO: 14816 - RNA, 24 nt, Artificial Sequence
  Synthetic
gcgucggggcggggucgugcauaa

SEQ ID NO: 14817 - RNA, 22 nt, Artificial Sequence
  Synthetic
gaccgcgacgagcggggggccc

SEQ ID NO: 14818 - RNA, 22 nt, Artificial Sequence
  Synthetic
gauggcgcggaugggcggggcc

SEQ ID NO: 14819 - RNA, 23 nt, Artificial Sequence
  Synthetic
gacggcgggggucgucggggucc

SEQ ID NO: 14820 - RNA, 20 nt, Artificial Sequence
  Synthetic
gcuaguuccgcgucgacggc

SEQ ID NO: 14821 - RNA, 22 nt, Artificial Sequence
  Synthetic
gcgcuaguuccgcgucgacggc

SEQ ID NO: 14822 - RNA, 21 nt, Artificial Sequence
  Synthetic
gccccgcccauggcagauggc

SEQ ID NO: 14823 - RNA, 23 nt, Artificial Sequence
  Synthetic
gcgccccgcccauggcagauggc

SEQ ID NO: 14824 - RNA, 21 nt, Artificial Sequence
  Synthetic
gucucgcccccuccccccauc

SEQ ID NO: 14825 - RNA, 22 nt, Artificial Sequence
  Synthetic
ggucucgcccccuccccccauc

SEQ ID NO: 14826 - RNA, 23 nt, Artificial Sequence
  Synthetic
gggucucgcccccuccccccauc

SEQ ID NO: 14827 - RNA, 18 nt, Artificial Sequence
  Synthetic
gcggacgaagcgcgggag

SEQ ID NO: 14828 - RNA, 23 nt, Artificial Sequence
  Synthetic
gauacgcggacgaagcgcgggag

SEQ ID NO: 14829 - RNA, 18 nt, Artificial Sequence
  Synthetic
gaacggaagcggaaaccg

SEQ ID NO: 14830 - RNA, 19 nt, Artificial Sequence
  Synthetic
ggaacggaagcggaaaccg

SEQ ID NO: 14831 - RNA, 21 nt, Artificial Sequence
  Synthetic
gcggaacggaagcggaaaccg

SEQ ID NO: 14832 - RNA, 18 nt, Artificial Sequence
  Synthetic
gucgcagccguauccccg

SEQ ID NO: 14833 - RNA, 21 nt, Artificial Sequence
  Synthetic
gccgucgcagccguauccccg

SEQ ID NO: 14834 - RNA, 18 nt, Artificial Sequence
  Synthetic
ggcgugccggcgucgggg

SEQ ID NO: 14835 - RNA, 24 nt, Artificial Sequence
  Synthetic
gcccccggcgugccggcgucgggg

SEQ ID NO: 14836 - RNA, 18 nt, Artificial Sequence
  Synthetic
gucgacggcgggggucgu

SEQ ID NO: 14837 - RNA, 20 nt, Artificial Sequence
  Synthetic
gcgucgacggcgggggucgu

SEQ ID NO: 14838 - RNA, 18 nt, Artificial Sequence
  Synthetic
gcauaauggaauuccguu

SEQ ID NO: 14839 - RNA, 20 nt, Artificial Sequence
  Synthetic
gugcauaauggaauuccguu

SEQ ID NO: 14840 - RNA, 23 nt, Artificial Sequence
  Synthetic
gucgugcauaauggaauuccguu

SEQ ID NO: 14841 - RNA, 24 nt, Artificial Sequence
  Synthetic
ggucgugcauaauggaauuccguu

SEQ ID NO: 14842 - RNA, 18 nt, Artificial Sequence
  Synthetic
cggcgggcccaccccgaa

SEQ ID NO: 14843 - RNA, 19 nt, Artificial Sequence
  Synthetic
ccggcgggcccaccccgaa

SEQ ID NO: 14844 - RNA, 20 nt, Artificial Sequence
  Synthetic
cccggcgggcccaccccgaa

SEQ ID NO: 14845 - RNA, 21 nt, Artificial Sequence
  Synthetic
ccccggcgggcccaccccgaa

SEQ ID NO: 14846 - RNA, 22 nt, Artificial Sequence
  Synthetic
cccccggcgggcccaccccgaa

SEQ ID NO: 14847 - RNA, 23 nt, Artificial Sequence
  Synthetic
ccccccggcgggcccaccccgaa

SEQ ID NO: 14848 - RNA, 24 nt, Artificial Sequence
  Synthetic
cccccccggcgggcccaccccgaa

SEQ ID NO: 14849 - RNA, 19 nt, Artificial Sequence
  Synthetic
cgaugcggggcgauccucc

SEQ ID NO: 14850 - RNA, 20 nt, Artificial Sequence
  Synthetic
ccgaugcggggcgauccucc

SEQ ID NO: 14851 - RNA, 22 nt, Artificial Sequence
  Synthetic
cgccgaugcggggcgauccucc

SEQ ID NO: 14852 - RNA, 23 nt, Artificial Sequence
  Synthetic
ucgccgaugcggggcgauccucc

SEQ ID NO: 14853 - RNA, 24 nt, Artificial Sequence
  Synthetic
aucgccgaugcggggcgauccucc

SEQ ID NO: 14854 - RNA, 19 nt, Artificial Sequence
  Synthetic
agcgcggaccggucgaugc

SEQ ID NO: 14855 - RNA, 20 nt, Artificial Sequence
  Synthetic
uagcgcggaccggucgaugc

SEQ ID NO: 14856 - RNA, 21 nt, Artificial Sequence
  Synthetic
cuagcgcggaccggucgaugc

SEQ ID NO: 14857 - RNA, 22 nt, Artificial Sequence
  Synthetic
acuagcgcggaccggucgaugc

SEQ ID NO: 14858 - RNA, 23 nt, Artificial Sequence
  Synthetic
aacuagcgcggaccggucgaugc

SEQ ID NO: 14859 - RNA, 20 nt, Artificial Sequence
  Synthetic
uggcggucccgcgucggguc

SEQ ID NO: 14860 - RNA, 21 nt, Artificial Sequence
  Synthetic
cuggcggucccgcgucggguc

SEQ ID NO: 14861 - RNA, 22 nt, Artificial Sequence
  Synthetic
ucuggcggucccgcgucggguc

SEQ ID NO: 14862 - RNA, 23 nt, Artificial Sequence
  Synthetic
cucuggcggucccgcgucggguc

SEQ ID NO: 14863 - RNA, 24 nt, Artificial Sequence
  Synthetic
ucucuggcggucccgcgucggguc

SEQ ID NO: 14864 - RNA, 19 nt, Artificial Sequence
  Synthetic
ugucucuggcggucccgcg

SEQ ID NO: 14865 - RNA, 20 nt, Artificial Sequence
  Synthetic
cugucucuggcggucccgcg

SEQ ID NO: 14866 - RNA, 21 nt, Artificial Sequence
  Synthetic
ucugucucuggcggucccgcg

SEQ ID NO: 14867 - RNA, 24 nt, Artificial Sequence
  Synthetic
cggucugucucuggcggucccgcg

SEQ ID NO: 14868 - RNA, 21 nt, Artificial Sequence
  Synthetic
ugccaugggcggggcgcgagg

SEQ ID NO: 14869 - RNA, 22 nt, Artificial Sequence
  Synthetic
cugccaugggcggggcgcgagg

SEQ ID NO: 14870 - RNA, 23 nt, Artificial Sequence
  Synthetic
ucugccaugggcggggcgcgagg

SEQ ID NO: 14871 - RNA, 24 nt, Artificial Sequence
  Synthetic
aucugccaugggcggggcgcgagg

SEQ ID NO: 14872 - RNA, 21 nt, Artificial Sequence
  Synthetic
augggcggggcgcgagggcgg

SEQ ID NO: 14873 - RNA, 22 nt, Artificial Sequence
  Synthetic
caugggcggggcgcgagggcgg

SEQ ID NO: 14874 - RNA, 23 nt, Artificial Sequence
  Synthetic
ccaugggcggggcgcgagggcgg

SEQ ID NO: 14875 - RNA, 21 nt, Artificial Sequence
  Synthetic
ccgcucgucgcggucugggcu

SEQ ID NO: 14876 - RNA, 22 nt, Artificial Sequence
  Synthetic
cccgcucgucgcggucugggcu

SEQ ID NO: 14877 - RNA, 23 nt, Artificial Sequence
  Synthetic
ccccgcucgucgcggucugggcu

SEQ ID NO: 14878 - RNA, 24 nt, Artificial Sequence
  Synthetic
cccccgcucgucgcggucugggcu

SEQ ID NO: 14879 - RNA, 19 nt, Artificial Sequence
  Synthetic
cgggcgucgucgaggucgu

SEQ ID NO: 14880 - RNA, 20 nt, Artificial Sequence
  Synthetic
ccgggcgucgucgaggucgu

SEQ ID NO: 14881 - RNA, 22 nt, Artificial Sequence
  Synthetic
cgccgggcgucgucgaggucgu

SEQ ID NO: 14882 - RNA, 23 nt, Artificial Sequence
  Synthetic
ccgccgggcgucgucgaggucgu

SEQ ID NO: 14883 - RNA, 24 nt, Artificial Sequence
  Synthetic
cccgccgggcgucgucgaggucgu

SEQ ID NO: 14884 - RNA, 22 nt, Artificial Sequence
  Synthetic
uggggguggucggggucguggu

SEQ ID NO: 14885 - RNA, 24 nt, Artificial Sequence
  Synthetic
cguggggguggucggggucguggu

SEQ ID NO: 14886 - RNA, 21 nt, Artificial Sequence
  Synthetic
cgucgaggucguggggguggu

SEQ ID NO: 14887 - RNA, 22 nt, Artificial Sequence
  Synthetic
ucgucgaggucguggggguggu

SEQ ID NO: 14888 - RNA, 24 nt, Artificial Sequence
  Synthetic
cgucgucgaggucguggggguggu

SEQ ID NO: 14889 - RNA, 20 nt, Artificial Sequence
  Synthetic
cggggcggggucgugcauaa

SEQ ID NO: 14890 - RNA, 21 nt, Artificial Sequence
  Synthetic
ucggggcggggucgugcauaa

SEQ ID NO: 14891 - RNA, 23 nt, Artificial Sequence
  Synthetic
cgucggggcggggucgugcauaa

SEQ ID NO: 14892 - RNA, 18 nt, Artificial Sequence
  Synthetic
cggagcgcggcugccgac

SEQ ID NO: 14893 - RNA, 19 nt, Artificial Sequence
  Synthetic
acggagcgcggcugccgac

SEQ ID NO: 14894 - RNA, 20 nt, Artificial Sequence
  Synthetic
cacggagcgcggcugccgac

SEQ ID NO: 14895 - RNA, 21 nt, Artificial Sequence
  Synthetic
accgcgacgagcggggggccc

SEQ ID NO: 14896 - RNA, 23 nt, Artificial Sequence
  Synthetic
agaccgcgacgagcggggggccc

SEQ ID NO: 14897 - RNA, 24 nt, Artificial Sequence
  Synthetic
cagaccgcgacgagcggggggccc

SEQ ID NO: 14898 - RNA, 21 nt, Artificial Sequence
  Synthetic
auggcgcggaugggcggggcc

SEQ ID NO: 14899 - RNA, 23 nt, Artificial Sequence
  Synthetic
agauggcgcggaugggcggggcc

SEQ ID NO: 14900 - RNA, 24 nt, Artificial Sequence
  Synthetic
cagauggcgcggaugggcggggcc

SEQ ID NO: 14901 - RNA, 21 nt, Artificial Sequence
  Synthetic
cggcgggggucgucggggucc

SEQ ID NO: 14902 - RNA, 22 nt, Artificial Sequence
  Synthetic
acggcgggggucgucggggucc

SEQ ID NO: 14903 - RNA, 24 nt, Artificial Sequence
  Synthetic
cgacggcgggggucgucggggucc

SEQ ID NO: 14904 - RNA, 18 nt, Artificial Sequence
  Synthetic
uaguuccgcgucgacggc

SEQ ID NO: 14905 - RNA, 19 nt, Artificial Sequence
  Synthetic
cuaguuccgcgucgacggc

SEQ ID NO: 14906 - RNA, 21 nt, Artificial Sequence
  Synthetic
cgcuaguuccgcgucgacggc

SEQ ID NO: 14907 - RNA, 23 nt, Artificial Sequence
  Synthetic
cgcgcuaguuccgcgucgacggc

SEQ ID NO: 14908 - RNA, 24 nt, Artificial Sequence
  Synthetic
ccgcgcuaguuccgcgucgacggc

SEQ ID NO: 14909 - RNA, 22 nt, Artificial Sequence
  Synthetic
cgccccgcccauggcagauggc

SEQ ID NO: 14910 - RNA, 24 nt, Artificial Sequence
  Synthetic
cgcgccccgcccauggcagauggc

SEQ ID NO: 14911 - RNA, 24 nt, Artificial Sequence
  Synthetic
ugggucucgcccccuccccccauc

SEQ ID NO: 14912 - RNA, 19 nt, Artificial Sequence
  Synthetic
cgcggacgaagcgcgggag

SEQ ID NO: 14913 - RNA, 20 nt, Artificial Sequence
  Synthetic
acgcggacgaagcgcgggag

SEQ ID NO: 14914 - RNA, 21 nt, Artificial Sequence
  Synthetic
uacgcggacgaagcgcgggag

SEQ ID NO: 14915 - RNA, 22 nt, Artificial Sequence
  Synthetic
auacgcggacgaagcgcgggag

SEQ ID NO: 14916 - RNA, 24 nt, Artificial Sequence
  Synthetic
cgauacgcggacgaagcgcgggag

SEQ ID NO: 14917 - RNA, 20 nt, Artificial Sequence
  Synthetic
cggaacggaagcggaaaccg

SEQ ID NO: 14918 - RNA, 22 nt, Artificial Sequence
  Synthetic
ugcggaacggaagcggaaaccg

SEQ ID NO: 14919 - RNA, 23 nt, Artificial Sequence
  Synthetic
augcggaacggaagcggaaaccg

SEQ ID NO: 14920 - RNA, 24 nt, Artificial Sequence
  Synthetic
caugcggaacggaagcggaaaccg

SEQ ID NO: 14921 - RNA, 19 nt, Artificial Sequence
  Synthetic
cgucgcagccguauccccg

SEQ ID NO: 14922 - RNA, 20 nt, Artificial Sequence
  Synthetic
ccgucgcagccguauccccg

SEQ ID NO: 14923 - RNA, 22 nt, Artificial Sequence
  Synthetic
cgccgucgcagccguauccccg

SEQ ID NO: 14924 - RNA, 23 nt, Artificial Sequence
  Synthetic
ccgccgucgcagccguauccccg

SEQ ID NO: 14925 - RNA, 24 nt, Artificial Sequence
  Synthetic
uccgccgucgcagccguauccccg

SEQ ID NO: 14926 - RNA, 19 nt, Artificial Sequence
  Synthetic
cggcgugccggcgucgggg

SEQ ID NO: 14927 - RNA, 20 nt, Artificial Sequence
  Synthetic
ccggcgugccggcgucgggg

SEQ ID NO: 14928 - RNA, 21 nt, Artificial Sequence
  Synthetic
cccggcgugccggcgucgggg

SEQ ID NO: 14929 - RNA, 22 nt, Artificial Sequence
  Synthetic
ccccggcgugccggcgucgggg

SEQ ID NO: 14930 - RNA, 23 nt, Artificial Sequence
  Synthetic
cccccggcgugccggcgucgggg

SEQ ID NO: 14931 - RNA, 19 nt, Artificial Sequence
  Synthetic
cgucgacggcgggggucgu

SEQ ID NO: 14932 - RNA, 21 nt, Artificial Sequence
  Synthetic
cgcgucgacggcgggggucgu

SEQ ID NO: 14933 - RNA, 22 nt, Artificial Sequence
  Synthetic
ccgcgucgacggcgggggucgu

SEQ ID NO: 14934 - RNA, 23 nt, Artificial Sequence
  Synthetic
uccgcgucgacggcgggggucgu

SEQ ID NO: 14935 - RNA, 24 nt, Artificial Sequence
  Synthetic
uuccgcgucgacggcgggggucgu

SEQ ID NO: 14936 - RNA, 19 nt, Artificial Sequence
  Synthetic
ugcauaauggaauuccguu

SEQ ID NO: 14937 - RNA, 21 nt, Artificial Sequence
  Synthetic
cgugcauaauggaauuccguu

SEQ ID NO: 14938 - RNA, 22 nt, Artificial Sequence
  Synthetic
ucgugcauaauggaauuccguu

SEQ ID NO: 14939 - RNA, 18 nt, Artificial Sequence
  Synthetic
caugggcggggcgcgagg

SEQ ID NO: 14940 - RNA, 19 nt, Artificial Sequence
  Synthetic
ccaugggcggggcgcgagg

SEQ ID NO: 14941 - RNA, 20 nt, Artificial Sequence
  Synthetic
gccaugggcggggcgcgagg

SEQ ID NO: 14942 - RNA, 18 nt, Artificial Sequence
  Synthetic
ggcggggcgcgagggcgg

SEQ ID NO: 14943 - RNA, 19 nt, Artificial Sequence
  Synthetic
gggcggggcgcgagggcgg

SEQ ID NO: 14944 - RNA, 20 nt, Artificial Sequence
  Synthetic
ugggcggggcgcgagggcgg

SEQ ID NO: 14945 - RNA, 18 nt, Artificial Sequence
  Synthetic
cucgucgcggucugggcu

SEQ ID NO: 14946 - RNA, 19 nt, Artificial Sequence
  Synthetic
gcucgucgcggucugggcu

SEQ ID NO: 14947 - RNA, 20 nt, Artificial Sequence
  Synthetic
cgcucgucgcggucugggcu

SEQ ID NO: 14948 - RNA, 18 nt, Artificial Sequence
  Synthetic
cgaggucguggggguggu

SEQ ID NO: 14949 - RNA, 19 nt, Artificial Sequence
  Synthetic
ucgaggucguggggguggu

SEQ ID NO: 14950 - RNA, 20 nt, Artificial Sequence
  Synthetic
gucgaggucguggggguggu

SEQ ID NO: 14951 - RNA, 18 nt, Artificial Sequence
  Synthetic
gcgacgagcggggggccc

SEQ ID NO: 14952 - RNA, 19 nt, Artificial Sequence
  Synthetic
cgcgacgagcggggggccc

SEQ ID NO: 14953 - RNA, 20 nt, Artificial Sequence
  Synthetic
ccgcgacgagcggggggccc

SEQ ID NO: 14954 - RNA, 18 nt, Artificial Sequence
  Synthetic
gcgcggaugggcggggcc

SEQ ID NO: 14955 - RNA, 19 nt, Artificial Sequence
  Synthetic
ggcgcggaugggcggggcc

SEQ ID NO: 14956 - RNA, 20 nt, Artificial Sequence
  Synthetic
uggcgcggaugggcggggcc

SEQ ID NO: 14957 - RNA, 18 nt, Artificial Sequence
  Synthetic
cgggggucgucggggucc

SEQ ID NO: 14958 - RNA, 19 nt, Artificial Sequence
  Synthetic
gcgggggucgucggggucc

SEQ ID NO: 14959 - RNA, 20 nt, Artificial Sequence
  Synthetic
ggcgggggucgucggggucc

SEQ ID NO: 14960 - RNA, 18 nt, Artificial Sequence
  Synthetic
ccgcccauggcagauggc

SEQ ID NO: 14961 - RNA, 19 nt, Artificial Sequence
  Synthetic
cccgcccauggcagauggc

SEQ ID NO: 14962 - RNA, 20 nt, Artificial Sequence
  Synthetic
ccccgcccauggcagauggc

SEQ ID NO: 14963 - RNA, 18 nt, Artificial Sequence
  Synthetic
ucgcccccuccccccauc

SEQ ID NO: 14964 - RNA, 19 nt, Artificial Sequence
  Synthetic
cucgcccccuccccccauc

SEQ ID NO: 14965 - RNA, 20 nt, Artificial Sequence
  Synthetic
ucucgcccccuccccccauc

SEQ ID NO: 14966 - RNA, 18 nt, Artificial Sequence
  Synthetic
cgaugcuugggugggaaa

SEQ ID NO: 14967 - RNA, 19 nt, Artificial Sequence
  Synthetic
ucgaugcuugggugggaaa

SEQ ID NO: 14968 - RNA, 20 nt, Artificial Sequence
  Synthetic
gucgaugcuugggugggaaa

SEQ ID NO: 14969 - RNA, 21 nt, Artificial Sequence
  Synthetic
ggucgaugcuugggugggaaa

SEQ ID NO: 14970 - RNA, 22 nt, Artificial Sequence
  Synthetic
cggucgaugcuugggugggaaa

SEQ ID NO: 14971 - RNA, 23 nt, Artificial Sequence
  Synthetic
ccggucgaugcuugggugggaaa

SEQ ID NO: 14972 - RNA, 24 nt, Artificial Sequence
  Synthetic
accggucgaugcuugggugggaaa

SEQ ID NO: 14973 - RNA, 18 nt, Artificial Sequence
  Synthetic
gccggacgccgggaccaa

SEQ ID NO: 14974 - RNA, 19 nt, Artificial Sequence
  Synthetic
cgccggacgccgggaccaa

SEQ ID NO: 14975 - RNA, 20 nt, Artificial Sequence
  Synthetic
ccgccggacgccgggaccaa

SEQ ID NO: 14976 - RNA, 21 nt, Artificial Sequence
  Synthetic
cccgccggacgccgggaccaa

SEQ ID NO: 14977 - RNA, 22 nt, Artificial Sequence
  Synthetic
gcccgccggacgccgggaccaa

SEQ ID NO: 14978 - RNA, 23 nt, Artificial Sequence
  Synthetic
cgcccgccggacgccgggaccaa

SEQ ID NO: 14979 - RNA, 24 nt, Artificial Sequence
  Synthetic
ccgcccgccggacgccgggaccaa

SEQ ID NO: 14980 - RNA, 18 nt, Artificial Sequence
  Synthetic
cgccggacgccgggacca

SEQ ID NO: 14981 - RNA, 19 nt, Artificial Sequence
  Synthetic
ccgccggacgccgggacca

SEQ ID NO: 14982 - RNA, 20 nt, Artificial Sequence
  Synthetic
cccgccggacgccgggacca

SEQ ID NO: 14983 - RNA, 21 nt, Artificial Sequence
  Synthetic
gcccgccggacgccgggacca

SEQ ID NO: 14984 - RNA, 22 nt, Artificial Sequence
  Synthetic
cgcccgccggacgccgggacca

SEQ ID NO: 14985 - RNA, 23 nt, Artificial Sequence
  Synthetic
ccgcccgccggacgccgggacca

SEQ ID NO: 14986 - RNA, 24 nt, Artificial Sequence
  Synthetic
cccgcccgccggacgccgggacca

SEQ ID NO: 14987 - RNA, 18 nt, Artificial Sequence
  Synthetic
cggcgggaaggaggagca

SEQ ID NO: 14988 - RNA, 19 nt, Artificial Sequence
  Synthetic
ccggcgggaaggaggagca

SEQ ID NO: 14989 - RNA, 20 nt, Artificial Sequence
  Synthetic
gccggcgggaaggaggagca

SEQ ID NO: 14990 - RNA, 21 nt, Artificial Sequence
  Synthetic
ggccggcgggaaggaggagca

SEQ ID NO: 14991 - RNA, 22 nt, Artificial Sequence
  Synthetic
gggccggcgggaaggaggagca

SEQ ID NO: 14992 - RNA, 23 nt, Artificial Sequence
  Synthetic
ggggccggcgggaaggaggagca

SEQ ID NO: 14993 - RNA, 24 nt, Artificial Sequence
  Synthetic
aggggccggcgggaaggaggagca

SEQ ID NO: 14994 - RNA, 18 nt, Artificial Sequence
  Synthetic
gcuaacgaggaacgggca

SEQ ID NO: 14995 - RNA, 19 nt, Artificial Sequence
  Synthetic
ugcuaacgaggaacgggca

SEQ ID NO: 14996 - RNA, 20 nt, Artificial Sequence
  Synthetic
augcuaacgaggaacgggca

SEQ ID NO: 14997 - RNA, 21 nt, Artificial Sequence
  Synthetic
caugcuaacgaggaacgggca

SEQ ID NO: 14998 - RNA, 22 nt, Artificial Sequence
  Synthetic
gcaugcuaacgaggaacgggca

SEQ ID NO: 14999 - RNA, 23 nt, Artificial Sequence
  Synthetic
cgcaugcuaacgaggaacgggca

SEQ ID NO: 15000 - RNA, 24 nt, Artificial Sequence
  Synthetic
ccgcaugcuaacgaggaacgggca

SEQ ID NO: 15001 - RNA, 18 nt, Artificial Sequence
  Synthetic
ccggcgggcccaccccga

SEQ ID NO: 15002 - RNA, 19 nt, Artificial Sequence
  Synthetic
cccggcgggcccaccccga

SEQ ID NO: 15003 - RNA, 20 nt, Artificial Sequence
  Synthetic
ccccggcgggcccaccccga

SEQ ID NO: 15004 - RNA, 21 nt, Artificial Sequence
  Synthetic
cccccggcgggcccaccccga

SEQ ID NO: 15005 - RNA, 22 nt, Artificial Sequence
  Synthetic
ccccccggcgggcccaccccga

SEQ ID NO: 15006 - RNA, 23 nt, Artificial Sequence
  Synthetic
cccccccggcgggcccaccccga

SEQ ID NO: 15007 - RNA, 24 nt, Artificial Sequence
  Synthetic
gcccccccggcgggcccaccccga

SEQ ID NO: 15008 - RNA, 18 nt, Artificial Sequence
  Synthetic
ucaccuacggacucucga

SEQ ID NO: 15009 - RNA, 19 nt, Artificial Sequence
  Synthetic
gucaccuacggacucucga

SEQ ID NO: 15010 - RNA, 20 nt, Artificial Sequence
  Synthetic
ggucaccuacggacucucga

SEQ ID NO: 15011 - RNA, 21 nt, Artificial Sequence
  Synthetic
aggucaccuacggacucucga

SEQ ID NO: 15012 - RNA, 22 nt, Artificial Sequence
  Synthetic
uaggucaccuacggacucucga

SEQ ID NO: 15013 - RNA, 23 nt, Artificial Sequence
  Synthetic
guaggucaccuacggacucucga

SEQ ID NO: 15014 - RNA, 24 nt, Artificial Sequence
  Synthetic
gguaggucaccuacggacucucga

SEQ ID NO: 15015 - RNA, 18 nt, Artificial Sequence
  Synthetic
cuugggugggaaaaagga

SEQ ID NO: 15016 - RNA, 19 nt, Artificial Sequence
  Synthetic
gcuugggugggaaaaagga

SEQ ID NO: 15017 - RNA, 20 nt, Artificial Sequence
  Synthetic
ugcuugggugggaaaaagga

SEQ ID NO: 15018 - RNA, 21 nt, Artificial Sequence
  Synthetic
augcuugggugggaaaaagga

SEQ ID NO: 15019 - RNA, 22 nt, Artificial Sequence
  Synthetic
gaugcuugggugggaaaaagga

SEQ ID NO: 15020 - RNA, 23 nt, Artificial Sequence
  Synthetic
cgaugcuugggugggaaaaagga

SEQ ID NO: 15021 - RNA, 24 nt, Artificial Sequence
  Synthetic
ucgaugcuugggugggaaaaagga

SEQ ID NO: 15022 - RNA, 18 nt, Artificial Sequence
  Synthetic
uccgcaugcuaacgagga

SEQ ID NO: 15023 - RNA, 19 nt, Artificial Sequence
  Synthetic
uuccgcaugcuaacgagga

SEQ ID NO: 15024 - RNA, 20 nt, Artificial Sequence
  Synthetic
guuccgcaugcuaacgagga

SEQ ID NO: 15025 - RNA, 21 nt, Artificial Sequence
  Synthetic
cguuccgcaugcuaacgagga

SEQ ID NO: 15026 - RNA, 22 nt, Artificial Sequence
  Synthetic
ccguuccgcaugcuaacgagga

SEQ ID NO: 15027 - RNA, 23 nt, Artificial Sequence
  Synthetic
uccguuccgcaugcuaacgagga

SEQ ID NO: 15028 - RNA, 24 nt, Artificial Sequence
  Synthetic
uuccguuccgcaugcuaacgagga

SEQ ID NO: 15029 - RNA, 18 nt, Artificial Sequence
  Synthetic
ucccaggggccggcggga

SEQ ID NO: 15030 - RNA, 19 nt, Artificial Sequence
  Synthetic
gucccaggggccggcggga

SEQ ID NO: 15031 - RNA, 20 nt, Artificial Sequence
  Synthetic
agucccaggggccggcggga

SEQ ID NO: 15032 - RNA, 21 nt, Artificial Sequence
  Synthetic
uagucccaggggccggcggga

SEQ ID NO: 15033 - RNA, 22 nt, Artificial Sequence
  Synthetic
auagucccaggggccggcggga

SEQ ID NO: 15034 - RNA, 23 nt, Artificial Sequence
  Synthetic
uauagucccaggggccggcggga

SEQ ID NO: 15035 - RNA, 24 nt, Artificial Sequence
  Synthetic
auauagucccaggggccggcggga

SEQ ID NO: 15036 - RNA, 18 nt, Artificial Sequence
  Synthetic
ggacucucgaugggggga

SEQ ID NO: 15037 - RNA, 19 nt, Artificial Sequence
  Synthetic
cggacucucgaugggggga

SEQ ID NO: 15038 - RNA, 20 nt, Artificial Sequence
  Synthetic
acggacucucgaugggggga

SEQ ID NO: 15039 - RNA, 21 nt, Artificial Sequence
  Synthetic
uacggacucucgaugggggga

SEQ ID NO: 15040 - RNA, 22 nt, Artificial Sequence
  Synthetic
cuacggacucucgaugggggga

SEQ ID NO: 15041 - RNA, 23 nt, Artificial Sequence
  Synthetic
ccuacggacucucgaugggggga

SEQ ID NO: 15042 - RNA, 24 nt, Artificial Sequence
  Synthetic
accuacggacucucgaugggggga

SEQ ID NO: 15043 - RNA, 18 nt, Artificial Sequence
  Synthetic
cuuccguuccgcaugcua

SEQ ID NO: 15044 - RNA, 19 nt, Artificial Sequence
  Synthetic
gcuuccguuccgcaugcua

SEQ ID NO: 15045 - RNA, 20 nt, Artificial Sequence
  Synthetic
cgcuuccguuccgcaugcua

SEQ ID NO: 15046 - RNA, 21 nt, Artificial Sequence
  Synthetic
ccgcuuccguuccgcaugcua

SEQ ID NO: 15047 - RNA, 22 nt, Artificial Sequence
  Synthetic
uccgcuuccguuccgcaugcua

SEQ ID NO: 15048 - RNA, 23 nt, Artificial Sequence
  Synthetic
uuccgcuuccguuccgcaugcua

SEQ ID NO: 15049 - RNA, 24 nt, Artificial Sequence
  Synthetic
uuuccgcuuccguuccgcaugcua

SEQ ID NO: 15050 - RNA, 18 nt, Artificial Sequence
  Synthetic
cuucccgguucggcggua

SEQ ID NO: 15051 - RNA, 19 nt, Artificial Sequence
  Synthetic
acuucccgguucggcggua

SEQ ID NO: 15052 - RNA, 20 nt, Artificial Sequence
  Synthetic
gacuucccgguucggcggua

SEQ ID NO: 15053 - RNA, 21 nt, Artificial Sequence
  Synthetic
cgacuucccgguucggcggua

SEQ ID NO: 15054 - RNA, 22 nt, Artificial Sequence
  Synthetic
ccgacuucccgguucggcggua

SEQ ID NO: 15055 - RNA, 23 nt, Artificial Sequence
  Synthetic
cccgacuucccgguucggcggua

SEQ ID NO: 15056 - RNA, 24 nt, Artificial Sequence
  Synthetic
ccccgacuucccgguucggcggua

SEQ ID NO: 15057 - RNA, 18 nt, Artificial Sequence
  Synthetic
uccguuccgcaugcuaac

SEQ ID NO: 15058 - RNA, 19 nt, Artificial Sequence
  Synthetic
uuccguuccgcaugcuaac

SEQ ID NO: 15059 - RNA, 20 nt, Artificial Sequence
  Synthetic
cuuccguuccgcaugcuaac

SEQ ID NO: 15060 - RNA, 21 nt, Artificial Sequence
  Synthetic
gcuuccguuccgcaugcuaac

SEQ ID NO: 15061 - RNA, 22 nt, Artificial Sequence
  Synthetic
cgcuuccguuccgcaugcuaac

SEQ ID NO: 15062 - RNA, 23 nt, Artificial Sequence
  Synthetic
ccgcuuccguuccgcaugcuaac

SEQ ID NO: 15063 - RNA, 24 nt, Artificial Sequence
  Synthetic
uccgcuuccguuccgcaugcuaac

SEQ ID NO: 15064 - RNA, 18 nt, Artificial Sequence
  Synthetic
uccgucuccgcgccccac

SEQ ID NO: 15065 - RNA, 19 nt, Artificial Sequence
  Synthetic
cuccgucuccgcgccccac

SEQ ID NO: 15066 - RNA, 20 nt, Artificial Sequence
  Synthetic
ccuccgucuccgcgccccac

SEQ ID NO: 15067 - RNA, 21 nt, Artificial Sequence
  Synthetic
uccuccgucuccgcgccccac

SEQ ID NO: 15068 - RNA, 22 nt, Artificial Sequence
  Synthetic
cuccuccgucuccgcgccccac

SEQ ID NO: 15069 - RNA, 23 nt, Artificial Sequence
  Synthetic
ccuccuccgucuccgcgccccac

SEQ ID NO: 15070 - RNA, 24 nt, Artificial Sequence
  Synthetic
cccuccuccgucuccgcgccccac

SEQ ID NO: 15071 - RNA, 18 nt, Artificial Sequence
  Synthetic
acgacccccgccgucgac

SEQ ID NO: 15072 - RNA, 19 nt, Artificial Sequence
  Synthetic
gacgacccccgccgucgac

SEQ ID NO: 15073 - RNA, 20 nt, Artificial Sequence
  Synthetic
cgacgacccccgccgucgac

SEQ ID NO: 15074 - RNA, 21 nt, Artificial Sequence
  Synthetic
ccgacgacccccgccgucgac

SEQ ID NO: 15075 - RNA, 22 nt, Artificial Sequence
  Synthetic
cccgacgacccccgccgucgac

SEQ ID NO: 15076 - RNA, 23 nt, Artificial Sequence
  Synthetic
ccccgacgacccccgccgucgac

SEQ ID NO: 15077 - RNA, 24 nt, Artificial Sequence
  Synthetic
accccgacgacccccgccgucgac

SEQ ID NO: 15078 - RNA, 18 nt, Artificial Sequence
  Synthetic
uugggugggaaaaaggac

SEQ ID NO: 15079 - RNA, 19 nt, Artificial Sequence
  Synthetic
cuugggugggaaaaaggac

SEQ ID NO: 15080 - RNA, 20 nt, Artificial Sequence
  Synthetic
gcuugggugggaaaaaggac

SEQ ID NO: 15081 - RNA, 21 nt, Artificial Sequence
  Synthetic
ugcuugggugggaaaaaggac

SEQ ID NO: 15082 - RNA, 22 nt, Artificial Sequence
  Synthetic
augcuugggugggaaaaaggac

SEQ ID NO: 15083 - RNA, 23 nt, Artificial Sequence
  Synthetic
gaugcuugggugggaaaaaggac

SEQ ID NO: 15084 - RNA, 24 nt, Artificial Sequence
  Synthetic
cgaugcuugggugggaaaaaggac

SEQ ID NO: 15085 - RNA, 18 nt, Artificial Sequence
  Synthetic
ccccccggcgggcccacc

SEQ ID NO: 15086 - RNA, 19 nt, Artificial Sequence
  Synthetic
cccccccggcgggcccacc

SEQ ID NO: 15087 - RNA, 20 nt, Artificial Sequence
  Synthetic
gcccccccggcgggcccacc

SEQ ID NO: 15088 - RNA, 21 nt, Artificial Sequence
  Synthetic
cgcccccccggcgggcccacc

SEQ ID NO: 15089 - RNA, 22 nt, Artificial Sequence
  Synthetic
ccgcccccccggcgggcccacc

SEQ ID NO: 15090 - RNA, 23 nt, Artificial Sequence
  Synthetic
cccgcccccccggcgggcccacc

SEQ ID NO: 15091 - RNA, 24 nt, Artificial Sequence
  Synthetic
ccccgcccccccggcgggcccacc

SEQ ID NO: 15092 - RNA, 18 nt, Artificial Sequence
  Synthetic
cgucuccgcgccccaccc

SEQ ID NO: 15093 - RNA, 19 nt, Artificial Sequence
  Synthetic
ccgucuccgcgccccaccc

SEQ ID NO: 15094 - RNA, 20 nt, Artificial Sequence
  Synthetic
uccgucuccgcgccccaccc

SEQ ID NO: 15095 - RNA, 21 nt, Artificial Sequence
  Synthetic
cuccgucuccgcgccccaccc

SEQ ID NO: 15096 - RNA, 22 nt, Artificial Sequence
  Synthetic
ccuccgucuccgcgccccaccc

SEQ ID NO: 15097 - RNA, 23 nt, Artificial Sequence
  Synthetic
uccuccgucuccgcgccccaccc

SEQ ID NO: 15098 - RNA, 24 nt, Artificial Sequence
  Synthetic
cuccuccgucuccgcgccccaccc

SEQ ID NO: 15099 - RNA, 18 nt, Artificial Sequence
  Synthetic
ggggagggggcgagaccc

SEQ ID NO: 15100 - RNA, 19 nt, Artificial Sequence
  Synthetic
gggggagggggcgagaccc

SEQ ID NO: 15101 - RNA, 20 nt, Artificial Sequence
  Synthetic
ggggggagggggcgagaccc

SEQ ID NO: 15102 - RNA, 21 nt, Artificial Sequence
  Synthetic
uggggggagggggcgagaccc

SEQ ID NO: 15103 - RNA, 22 nt, Artificial Sequence
  Synthetic
auggggggagggggcgagaccc

SEQ ID NO: 15104 - RNA, 23 nt, Artificial Sequence
  Synthetic
gauggggggagggggcgagaccc

SEQ ID NO: 15105 - RNA, 24 nt, Artificial Sequence
  Synthetic
cgauggggggagggggcgagaccc

SEQ ID NO: 15106 - RNA, 18 nt, Artificial Sequence
  Synthetic
cgggacggcgggcggccc

SEQ ID NO: 15107 - RNA, 19 nt, Artificial Sequence
  Synthetic
acgggacggcgggcggccc

SEQ ID NO: 15108 - RNA, 20 nt, Artificial Sequence
  Synthetic
aacgggacggcgggcggccc

SEQ ID NO: 15109 - RNA, 21 nt, Artificial Sequence
  Synthetic
caacgggacggcgggcggccc

SEQ ID NO: 15110 - RNA, 22 nt, Artificial Sequence
  Synthetic
ccaacgggacggcgggcggccc

SEQ ID NO: 15111 - RNA, 23 nt, Artificial Sequence
  Synthetic
accaacgggacggcgggcggccc

SEQ ID NO: 15112 - RNA, 24 nt, Artificial Sequence
  Synthetic
gaccaacgggacggcgggcggccc

SEQ ID NO: 15113 - RNA, 18 nt, Artificial Sequence
  Synthetic
ggcccgucgguggggccc

SEQ ID NO: 15114 - RNA, 19 nt, Artificial Sequence
  Synthetic
cggcccgucgguggggccc

SEQ ID NO: 15115 - RNA, 20 nt, Artificial Sequence
  Synthetic
gcggcccgucgguggggccc

SEQ ID NO: 15116 - RNA, 21 nt, Artificial Sequence
  Synthetic
ggcggcccgucgguggggccc

SEQ ID NO: 15117 - RNA, 22 nt, Artificial Sequence
  Synthetic
cggcggcccgucgguggggccc

SEQ ID NO: 15118 - RNA, 23 nt, Artificial Sequence
  Synthetic
gcggcggcccgucgguggggccc

SEQ ID NO: 15119 - RNA, 24 nt, Artificial Sequence
  Synthetic
ggcggcggcccgucgguggggccc

SEQ ID NO: 15120 - RNA, 18 nt, Artificial Sequence
  Synthetic
ucgggcucauauaguccc

SEQ ID NO: 15121 - RNA, 19 nt, Artificial Sequence
  Synthetic
cucgggcucauauaguccc

SEQ ID NO: 15122 - RNA, 20 nt, Artificial Sequence
  Synthetic
ccucgggcucauauaguccc

SEQ ID NO: 15123 - RNA, 21 nt, Artificial Sequence
  Synthetic
uccucgggcucauauaguccc

SEQ ID NO: 15124 - RNA, 22 nt, Artificial Sequence
  Synthetic
guccucgggcucauauaguccc

SEQ ID NO: 15125 - RNA, 23 nt, Artificial Sequence
  Synthetic
cguccucgggcucauauaguccc

SEQ ID NO: 15126 - RNA, 24 nt, Artificial Sequence
  Synthetic
gcguccucgggcucauauaguccc

SEQ ID NO: 15127 - RNA, 18 nt, Artificial Sequence
  Synthetic
ccccgacgccggcacgcc

SEQ ID NO: 15128 - RNA, 19 nt, Artificial Sequence
  Synthetic
gccccgacgccggcacgcc

SEQ ID NO: 15129 - RNA, 20 nt, Artificial Sequence
  Synthetic
cgccccgacgccggcacgcc

SEQ ID NO: 15130 - RNA, 21 nt, Artificial Sequence
  Synthetic
ccgccccgacgccggcacgcc

SEQ ID NO: 15131 - RNA, 22 nt, Artificial Sequence
  Synthetic
cccgccccgacgccggcacgcc

SEQ ID NO: 15132 - RNA, 23 nt, Artificial Sequence
  Synthetic
ccccgccccgacgccggcacgcc

SEQ ID NO: 15133 - RNA, 24 nt, Artificial Sequence
  Synthetic
accccgccccgacgccggcacgcc

SEQ ID NO: 15134 - RNA, 18 nt, Artificial Sequence
  Synthetic
cggcccgucgguggggcc

SEQ ID NO: 15135 - RNA, 19 nt, Artificial Sequence
  Synthetic
gcggcccgucgguggggcc

SEQ ID NO: 15136 - RNA, 20 nt, Artificial Sequence
  Synthetic
ggcggcccgucgguggggcc

SEQ ID NO: 15137 - RNA, 21 nt, Artificial Sequence
  Synthetic
cggcggcccgucgguggggcc

SEQ ID NO: 15138 - RNA, 22 nt, Artificial Sequence
  Synthetic
gcggcggcccgucgguggggcc

SEQ ID NO: 15139 - RNA, 23 nt, Artificial Sequence
  Synthetic
ggcggcggcccgucgguggggcc

SEQ ID NO: 15140 - RNA, 24 nt, Artificial Sequence
  Synthetic
gggcggcggcccgucgguggggcc

SEQ ID NO: 15141 - RNA, 18 nt, Artificial Sequence
  Synthetic
ccauccgcgccaucugcc

SEQ ID NO: 15142 - RNA, 19 nt, Artificial Sequence
  Synthetic
cccauccgcgccaucugcc

SEQ ID NO: 15143 - RNA, 20 nt, Artificial Sequence
  Synthetic
gcccauccgcgccaucugcc

SEQ ID NO: 15144 - RNA, 21 nt, Artificial Sequence
  Synthetic
cgcccauccgcgccaucugcc

SEQ ID NO: 15145 - RNA, 22 nt, Artificial Sequence
  Synthetic
ccgcccauccgcgccaucugcc

SEQ ID NO: 15146 - RNA, 23 nt, Artificial Sequence
  Synthetic
cccgcccauccgcgccaucugcc

SEQ ID NO: 15147 - RNA, 24 nt, Artificial Sequence
  Synthetic
ccccgcccauccgcgccaucugcc

SEQ ID NO: 15148 - RNA, 18 nt, Artificial Sequence
  Synthetic
cucgggcucauauagucc

SEQ ID NO: 15149 - RNA, 19 nt, Artificial Sequence
  Synthetic
ccucgggcucauauagucc

SEQ ID NO: 15150 - RNA, 20 nt, Artificial Sequence
  Synthetic
uccucgggcucauauagucc

SEQ ID NO: 15151 - RNA, 21 nt, Artificial Sequence
  Synthetic
guccucgggcucauauagucc

SEQ ID NO: 15152 - RNA, 22 nt, Artificial Sequence
  Synthetic
cguccucgggcucauauagucc

SEQ ID NO: 15153 - RNA, 23 nt, Artificial Sequence
  Synthetic
gcguccucgggcucauauagucc

SEQ ID NO: 15154 - RNA, 24 nt, Artificial Sequence
  Synthetic
ggcguccucgggcucauauagucc

SEQ ID NO: 15155 - RNA, 18 nt, Artificial Sequence
  Synthetic
cgcgcccguuggccgucc

SEQ ID NO: 15156 - RNA, 19 nt, Artificial Sequence
  Synthetic
gcgcgcccguuggccgucc

SEQ ID NO: 15157 - RNA, 20 nt, Artificial Sequence
  Synthetic
cgcgcgcccguuggccgucc

SEQ ID NO: 15158 - RNA, 21 nt, Artificial Sequence
  Synthetic
ccgcgcgcccguuggccgucc

SEQ ID NO: 15159 - RNA, 22 nt, Artificial Sequence
  Synthetic
cccgcgcgcccguuggccgucc

SEQ ID NO: 15160 - RNA, 23 nt, Artificial Sequence
  Synthetic
ccccgcgcgcccguuggccgucc

SEQ ID NO: 15161 - RNA, 24 nt, Artificial Sequence
  Synthetic
gccccgcgcgcccguuggccgucc

SEQ ID NO: 15162 - RNA, 18 nt, Artificial Sequence
  Synthetic
cgguggggcccggggagc

SEQ ID NO: 15163 - RNA, 19 nt, Artificial Sequence
  Synthetic
ucgguggggcccggggagc

SEQ ID NO: 15164 - RNA, 20 nt, Artificial Sequence
  Synthetic
gucgguggggcccggggagc

SEQ ID NO: 15165 - RNA, 21 nt, Artificial Sequence
  Synthetic
cgucgguggggcccggggagc

SEQ ID NO: 15166 - RNA, 22 nt, Artificial Sequence
  Synthetic
ccgucgguggggcccggggagc

SEQ ID NO: 15167 - RNA, 23 nt, Artificial Sequence
  Synthetic
cccgucgguggggcccggggagc

SEQ ID NO: 15168 - RNA, 24 nt, Artificial Sequence
  Synthetic
gcccgucgguggggcccggggagc

SEQ ID NO: 15169 - RNA, 18 nt, Artificial Sequence
  Synthetic
cgucgacgcggaacuagc

SEQ ID NO: 15170 - RNA, 19 nt, Artificial Sequence
  Synthetic
ccgucgacgcggaacuagc

SEQ ID NO: 15171 - RNA, 20 nt, Artificial Sequence
  Synthetic
gccgucgacgcggaacuagc

SEQ ID NO: 15172 - RNA, 21 nt, Artificial Sequence
  Synthetic
cgccgucgacgcggaacuagc

SEQ ID NO: 15173 - RNA, 22 nt, Artificial Sequence
  Synthetic
ccgccgucgacgcggaacuagc

SEQ ID NO: 15174 - RNA, 23 nt, Artificial Sequence
  Synthetic
cccgccgucgacgcggaacuagc

SEQ ID NO: 15175 - RNA, 24 nt, Artificial Sequence
  Synthetic
ccccgccgucgacgcggaacuagc

SEQ ID NO: 15176 - RNA, 18 nt, Artificial Sequence
  Synthetic
gccccgacgccggcacgc

SEQ ID NO: 15177 - RNA, 19 nt, Artificial Sequence
  Synthetic
cgccccgacgccggcacgc

SEQ ID NO: 15178 - RNA, 20 nt, Artificial Sequence
  Synthetic
ccgccccgacgccggcacgc

SEQ ID NO: 15179 - RNA, 21 nt, Artificial Sequence
  Synthetic
cccgccccgacgccggcacgc

SEQ ID NO: 15180 - RNA, 22 nt, Artificial Sequence
  Synthetic
ccccgccccgacgccggcacgc

SEQ ID NO: 15181 - RNA, 23 nt, Artificial Sequence
  Synthetic
accccgccccgacgccggcacgc

SEQ ID NO: 15182 - RNA, 24 nt, Artificial Sequence
  Synthetic
gaccccgccccgacgccggcacgc

SEQ ID NO: 15183 - RNA, 18 nt, Artificial Sequence
  Synthetic
gucccgcccgccggacgc

SEQ ID NO: 15184 - RNA, 19 nt, Artificial Sequence
  Synthetic
ggucccgcccgccggacgc

SEQ ID NO: 15185 - RNA, 20 nt, Artificial Sequence
  Synthetic
cggucccgcccgccggacgc

SEQ ID NO: 15186 - RNA, 21 nt, Artificial Sequence
  Synthetic
ccggucccgcccgccggacgc

SEQ ID NO: 15187 - RNA, 22 nt, Artificial Sequence
  Synthetic
cccggucccgcccgccggacgc

SEQ ID NO: 15188 - RNA, 23 nt, Artificial Sequence
  Synthetic
ccccggucccgcccgccggacgc

SEQ ID NO: 15189 - RNA, 24 nt, Artificial Sequence
  Synthetic
cccccggucccgcccgccggacgc

SEQ ID NO: 15190 - RNA, 18 nt, Artificial Sequence
  Synthetic
cugccaugggcggggcgc

SEQ ID NO: 15191 - RNA, 19 nt, Artificial Sequence
  Synthetic
ucugccaugggcggggcgc

SEQ ID NO: 15192 - RNA, 20 nt, Artificial Sequence
  Synthetic
aucugccaugggcggggcgc

SEQ ID NO: 15193 - RNA, 21 nt, Artificial Sequence
  Synthetic
caucugccaugggcggggcgc

SEQ ID NO: 15194 - RNA, 22 nt, Artificial Sequence
  Synthetic
ccaucugccaugggcggggcgc

SEQ ID NO: 15195 - RNA, 23 nt, Artificial Sequence
  Synthetic
gccaucugccaugggcggggcgc

SEQ ID NO: 15196 - RNA, 24 nt, Artificial Sequence
  Synthetic
cgccaucugccaugggcggggcgc

SEQ ID NO: 15197 - RNA, 18 nt, Artificial Sequence
  Synthetic
auagucccaggggccggc

SEQ ID NO: 15198 - RNA, 19 nt, Artificial Sequence
  Synthetic
uauagucccaggggccggc

SEQ ID NO: 15199 - RNA, 20 nt, Artificial Sequence
  Synthetic
auauagucccaggggccggc

SEQ ID NO: 15200 - RNA, 21 nt, Artificial Sequence
  Synthetic
cauauagucccaggggccggc

SEQ ID NO: 15201 - RNA, 22 nt, Artificial Sequence
  Synthetic
ucauauagucccaggggccggc

SEQ ID NO: 15202 - RNA, 23 nt, Artificial Sequence
  Synthetic
cucauauagucccaggggccggc

SEQ ID NO: 15203 - RNA, 24 nt, Artificial Sequence
  Synthetic
gcucauauagucccaggggccggc

SEQ ID NO: 15204 - RNA, 18 nt, Artificial Sequence
  Synthetic
ugcuaacgaggaacgggc

SEQ ID NO: 15205 - RNA, 19 nt, Artificial Sequence
  Synthetic
augcuaacgaggaacgggc

SEQ ID NO: 15206 - RNA, 20 nt, Artificial Sequence
  Synthetic
caugcuaacgaggaacgggc

SEQ ID NO: 15207 - RNA, 21 nt, Artificial Sequence
  Synthetic
gcaugcuaacgaggaacgggc

SEQ ID NO: 15208 - RNA, 22 nt, Artificial Sequence
  Synthetic
cgcaugcuaacgaggaacgggc

SEQ ID NO: 15209 - RNA, 23 nt, Artificial Sequence
  Synthetic
ccgcaugcuaacgaggaacgggc

SEQ ID NO: 15210 - RNA, 24 nt, Artificial Sequence
  Synthetic
uccgcaugcuaacgaggaacgggc

SEQ ID NO: 15211 - RNA, 18 nt, Artificial Sequence
  Synthetic
acgggcagggggcggggc

SEQ ID NO: 15212 - RNA, 19 nt, Artificial Sequence
  Synthetic
aacgggcagggggcggggc

SEQ ID NO: 15213 - RNA, 20 nt, Artificial Sequence
  Synthetic
gaacgggcagggggcggggc

SEQ ID NO: 15214 - RNA, 21 nt, Artificial Sequence
  Synthetic
ggaacgggcagggggcggggc

SEQ ID NO: 15215 - RNA, 22 nt, Artificial Sequence
  Synthetic
aggaacgggcagggggcggggc

SEQ ID NO: 15216 - RNA, 23 nt, Artificial Sequence
  Synthetic
gaggaacgggcagggggcggggc

SEQ ID NO: 15217 - RNA, 24 nt, Artificial Sequence
  Synthetic
cgaggaacgggcagggggcggggc

SEQ ID NO: 15218 - RNA, 18 nt, Artificial Sequence
  Synthetic
aucugccaugggcggggc

SEQ ID NO: 15219 - RNA, 19 nt, Artificial Sequence
  Synthetic
caucugccaugggcggggc

SEQ ID NO: 15220 - RNA, 20 nt, Artificial Sequence
  Synthetic
ccaucugccaugggcggggc

SEQ ID NO: 15221 - RNA, 21 nt, Artificial Sequence
  Synthetic
gccaucugccaugggcggggc

SEQ ID NO: 15222 - RNA, 22 nt, Artificial Sequence
  Synthetic
cgccaucugccaugggcggggc

SEQ ID NO: 15223 - RNA, 23 nt, Artificial Sequence
  Synthetic
gcgccaucugccaugggcggggc

SEQ ID NO: 15224 - RNA, 24 nt, Artificial Sequence
  Synthetic
cgcgccaucugccaugggcggggc

SEQ ID NO: 15225 - RNA, 18 nt, Artificial Sequence
  Synthetic
gcggcccgucgguggggc

SEQ ID NO: 15226 - RNA, 19 nt, Artificial Sequence
  Synthetic
ggcggcccgucgguggggc

SEQ ID NO: 15227 - RNA, 20 nt, Artificial Sequence
  Synthetic
cggcggcccgucgguggggc

SEQ ID NO: 15228 - RNA, 21 nt, Artificial Sequence
  Synthetic
gcggcggcccgucgguggggc

SEQ ID NO: 15229 - RNA, 22 nt, Artificial Sequence
  Synthetic
ggcggcggcccgucgguggggc

SEQ ID NO: 15230 - RNA, 23 nt, Artificial Sequence
  Synthetic
gggcggcggcccgucgguggggc

SEQ ID NO: 15231 - RNA, 24 nt, Artificial Sequence
  Synthetic
ugggcggcggcccgucgguggggc

SEQ ID NO: 15232 - RNA, 18 nt, Artificial Sequence
  Synthetic
gcucgucgcggucugggc

SEQ ID NO: 15233 - RNA, 19 nt, Artificial Sequence
  Synthetic
cgcucgucgcggucugggc

SEQ ID NO: 15234 - RNA, 20 nt, Artificial Sequence
  Synthetic
ccgcucgucgcggucugggc

SEQ ID NO: 15235 - RNA, 21 nt, Artificial Sequence
  Synthetic
cccgcucgucgcggucugggc

SEQ ID NO: 15236 - RNA, 22 nt, Artificial Sequence
  Synthetic
ccccgcucgucgcggucugggc

SEQ ID NO: 15237 - RNA, 23 nt, Artificial Sequence
  Synthetic
cccccgcucgucgcggucugggc

SEQ ID NO: 15238 - RNA, 24 nt, Artificial Sequence
  Synthetic
ccccccgcucgucgcggucugggc

SEQ ID NO: 15239 - RNA, 18 nt, Artificial Sequence
  Synthetic
cgaugcggggcgauccuc

SEQ ID NO: 15240 - RNA, 19 nt, Artificial Sequence
  Synthetic
ccgaugcggggcgauccuc

SEQ ID NO: 15241 - RNA, 20 nt, Artificial Sequence
  Synthetic
gccgaugcggggcgauccuc

SEQ ID NO: 15242 - RNA, 21 nt, Artificial Sequence
  Synthetic
cgccgaugcggggcgauccuc

SEQ ID NO: 15243 - RNA, 22 nt, Artificial Sequence
  Synthetic
ucgccgaugcggggcgauccuc

SEQ ID NO: 15244 - RNA, 23 nt, Artificial Sequence
  Synthetic
aucgccgaugcggggcgauccuc

SEQ ID NO: 15245 - RNA, 24 nt, Artificial Sequence
  Synthetic
caucgccgaugcggggcgauccuc

SEQ ID NO: 15246 - RNA, 18 nt, Artificial Sequence
  Synthetic
ccgggcgucgucgagguc

SEQ ID NO: 15247 - RNA, 19 nt, Artificial Sequence
  Synthetic
gccgggcgucgucgagguc

SEQ ID NO: 15248 - RNA, 20 nt, Artificial Sequence
  Synthetic
cgccgggcgucgucgagguc

SEQ ID NO: 15249 - RNA, 21 nt, Artificial Sequence
  Synthetic
ccgccgggcgucgucgagguc

SEQ ID NO: 15250 - RNA, 22 nt, Artificial Sequence
  Synthetic
cccgccgggcgucgucgagguc

SEQ ID NO: 15251 - RNA, 23 nt, Artificial Sequence
  Synthetic
ucccgccgggcgucgucgagguc

SEQ ID NO: 15252 - RNA, 24 nt, Artificial Sequence
  Synthetic
gucccgccgggcgucgucgagguc

SEQ ID NO: 15253 - RNA, 18 nt, Artificial Sequence
  Synthetic
ccaggggccggcgggaag

SEQ ID NO: 15254 - RNA, 19 nt, Artificial Sequence
  Synthetic
cccaggggccggcgggaag

SEQ ID NO: 15255 - RNA, 20 nt, Artificial Sequence
  Synthetic
ucccaggggccggcgggaag

SEQ ID NO: 15256 - RNA, 21 nt, Artificial Sequence
  Synthetic
gucccaggggccggcgggaag

SEQ ID NO: 15257 - RNA, 22 nt, Artificial Sequence
  Synthetic
agucccaggggccggcgggaag

SEQ ID NO: 15258 - RNA, 23 nt, Artificial Sequence
  Synthetic
uagucccaggggccggcgggaag

SEQ ID NO: 15259 - RNA, 24 nt, Artificial Sequence
  Synthetic
auagucccaggggccggcgggaag

SEQ ID NO: 15260 - RNA, 18 nt, Artificial Sequence
  Synthetic
ggcgggaaggaggagcag

SEQ ID NO: 15261 - RNA, 19 nt, Artificial Sequence
  Synthetic
cggcgggaaggaggagcag

SEQ ID NO: 15262 - RNA, 20 nt, Artificial Sequence
  Synthetic
ccggcgggaaggaggagcag

SEQ ID NO: 15263 - RNA, 21 nt, Artificial Sequence
  Synthetic
gccggcgggaaggaggagcag

SEQ ID NO: 15264 - RNA, 22 nt, Artificial Sequence
  Synthetic
ggccggcgggaaggaggagcag

SEQ ID NO: 15265 - RNA, 23 nt, Artificial Sequence
  Synthetic
gggccggcgggaaggaggagcag

SEQ ID NO: 15266 - RNA, 24 nt, Artificial Sequence
  Synthetic
ggggccggcgggaaggaggagcag

SEQ ID NO: 15267 - RNA, 18 nt, Artificial Sequence
  Synthetic
ucgguggggcccggggag

SEQ ID NO: 15268 - RNA, 19 nt, Artificial Sequence
  Synthetic
gucgguggggcccggggag

SEQ ID NO: 15269 - RNA, 20 nt, Artificial Sequence
  Synthetic
cgucgguggggcccggggag

SEQ ID NO: 15270 - RNA, 21 nt, Artificial Sequence
  Synthetic
ccgucgguggggcccggggag

SEQ ID NO: 15271 - RNA, 22 nt, Artificial Sequence
  Synthetic
cccgucgguggggcccggggag

SEQ ID NO: 15272 - RNA, 23 nt, Artificial Sequence
  Synthetic
gcccgucgguggggcccggggag

SEQ ID NO: 15273 - RNA, 24 nt, Artificial Sequence
  Synthetic
ggcccgucgguggggcccggggag

SEQ ID NO: 15274 - RNA, 18 nt, Artificial Sequence
  Synthetic
ccguuccgcaugcuaacg

SEQ ID NO: 15275 - RNA, 19 nt, Artificial Sequence
  Synthetic
uccguuccgcaugcuaacg

SEQ ID NO: 15276 - RNA, 20 nt, Artificial Sequence
  Synthetic
uuccguuccgcaugcuaacg

SEQ ID NO: 15277 - RNA, 21 nt, Artificial Sequence
  Synthetic
cuuccguuccgcaugcuaacg

SEQ ID NO: 15278 - RNA, 22 nt, Artificial Sequence
  Synthetic
gcuuccguuccgcaugcuaacg

SEQ ID NO: 15279 - RNA, 23 nt, Artificial Sequence
  Synthetic
cgcuuccguuccgcaugcuaacg

SEQ ID NO: 15280 - RNA, 24 nt, Artificial Sequence
  Synthetic
ccgcuuccguuccgcaugcuaacg

SEQ ID NO: 15281 - RNA, 18 nt, Artificial Sequence
  Synthetic
cgccccgacgccggcacg

SEQ ID NO: 15282 - RNA, 19 nt, Artificial Sequence
  Synthetic
ccgccccgacgccggcacg

SEQ ID NO: 15283 - RNA, 20 nt, Artificial Sequence
  Synthetic
cccgccccgacgccggcacg

SEQ ID NO: 15284 - RNA, 21 nt, Artificial Sequence
  Synthetic
ccccgccccgacgccggcacg

SEQ ID NO: 15285 - RNA, 22 nt, Artificial Sequence
  Synthetic
accccgccccgacgccggcacg

SEQ ID NO: 15286 - RNA, 23 nt, Artificial Sequence
  Synthetic
gaccccgccccgacgccggcacg

SEQ ID NO: 15287 - RNA, 24 nt, Artificial Sequence
  Synthetic
cgaccccgccccgacgccggcacg

SEQ ID NO: 15288 - RNA, 18 nt, Artificial Sequence
  Synthetic
ggggauacggcugcgacg

SEQ ID NO: 15289 - RNA, 19 nt, Artificial Sequence
  Synthetic
cggggauacggcugcgacg

SEQ ID NO: 15290 - RNA, 20 nt, Artificial Sequence
  Synthetic
ccggggauacggcugcgacg

SEQ ID NO: 15291 - RNA, 21 nt, Artificial Sequence
  Synthetic
uccggggauacggcugcgacg

SEQ ID NO: 15292 - RNA, 22 nt, Artificial Sequence
  Synthetic
cuccggggauacggcugcgacg

SEQ ID NO: 15293 - RNA, 23 nt, Artificial Sequence
  Synthetic
ccuccggggauacggcugcgacg

SEQ ID NO: 15294 - RNA, 24 nt, Artificial Sequence
  Synthetic
uccuccggggauacggcugcgacg

SEQ ID NO: 15295 - RNA, 18 nt, Artificial Sequence
  Synthetic
cgacccccgccgucgacg

SEQ ID NO: 15296 - RNA, 19 nt, Artificial Sequence
  Synthetic
acgacccccgccgucgacg

SEQ ID NO: 15297 - RNA, 20 nt, Artificial Sequence
  Synthetic
gacgacccccgccgucgacg

SEQ ID NO: 15298 - RNA, 21 nt, Artificial Sequence
  Synthetic
cgacgacccccgccgucgacg

SEQ ID NO: 15299 - RNA, 22 nt, Artificial Sequence
  Synthetic
ccgacgacccccgccgucgacg

SEQ ID NO: 15300 - RNA, 23 nt, Artificial Sequence
  Synthetic
cccgacgacccccgccgucgacg

SEQ ID NO: 15301 - RNA, 24 nt, Artificial Sequence
  Synthetic
ccccgacgacccccgccgucgacg

SEQ ID NO: 15302 - RNA, 18 nt, Artificial Sequence
  Synthetic
ggucccgcccgccggacg

SEQ ID NO: 15303 - RNA, 19 nt, Artificial Sequence
  Synthetic
cggucccgcccgccggacg

SEQ ID NO: 15304 - RNA, 20 nt, Artificial Sequence
  Synthetic
ccggucccgcccgccggacg

SEQ ID NO: 15305 - RNA, 21 nt, Artificial Sequence
  Synthetic
cccggucccgcccgccggacg

SEQ ID NO: 15306 - RNA, 22 nt, Artificial Sequence
  Synthetic
ccccggucccgcccgccggacg

SEQ ID NO: 15307 - RNA, 23 nt, Artificial Sequence
  Synthetic
cccccggucccgcccgccggacg

SEQ ID NO: 15308 - RNA, 24 nt, Artificial Sequence
  Synthetic
ccccccggucccgcccgccggacg

SEQ ID NO: 15309 - RNA, 18 nt, Artificial Sequence
  Synthetic
gccgggaccaacgggacg

SEQ ID NO: 15310 - RNA, 19 nt, Artificial Sequence
  Synthetic
cgccgggaccaacgggacg

SEQ ID NO: 15311 - RNA, 20 nt, Artificial Sequence
  Synthetic
acgccgggaccaacgggacg

SEQ ID NO: 15312 - RNA, 21 nt, Artificial Sequence
  Synthetic
gacgccgggaccaacgggacg

SEQ ID NO: 15313 - RNA, 22 nt, Artificial Sequence
  Synthetic
ggacgccgggaccaacgggacg

SEQ ID NO: 15314 - RNA, 23 nt, Artificial Sequence
  Synthetic
cggacgccgggaccaacgggacg

SEQ ID NO: 15315 - RNA, 24 nt, Artificial Sequence
  Synthetic
ccggacgccgggaccaacgggacg

SEQ ID NO: 15316 - RNA, 18 nt, Artificial Sequence
  Synthetic
cggccccccgcccccccg

SEQ ID NO: 15317 - RNA, 19 nt, Artificial Sequence
  Synthetic
ccggccccccgcccccccg

SEQ ID NO: 15318 - RNA, 20 nt, Artificial Sequence
  Synthetic
gccggccccccgcccccccg

SEQ ID NO: 15319 - RNA, 21 nt, Artificial Sequence
  Synthetic
cgccggccccccgcccccccg

SEQ ID NO: 15320 - RNA, 22 nt, Artificial Sequence
  Synthetic
ccgccggccccccgcccccccg

SEQ ID NO: 15321 - RNA, 23 nt, Artificial Sequence
  Synthetic
gccgccggccccccgcccccccg

SEQ ID NO: 15322 - RNA, 24 nt, Artificial Sequence
  Synthetic
ggccgccggccccccgcccccccg

SEQ ID NO: 15323 - RNA, 18 nt, Artificial Sequence
  Synthetic
gccccccggucccgcccg

SEQ ID NO: 15324 - RNA, 19 nt, Artificial Sequence
  Synthetic
ggccccccggucccgcccg

SEQ ID NO: 15325 - RNA, 20 nt, Artificial Sequence
  Synthetic
gggccccccggucccgcccg

SEQ ID NO: 15326 - RNA, 21 nt, Artificial Sequence
  Synthetic
cgggccccccggucccgcccg

SEQ ID NO: 15327 - RNA, 22 nt, Artificial Sequence
  Synthetic
ccgggccccccggucccgcccg

SEQ ID NO: 15328 - RNA, 23 nt, Artificial Sequence
  Synthetic
cccgggccccccggucccgcccg

SEQ ID NO: 15329 - RNA, 24 nt, Artificial Sequence
  Synthetic
ccccgggccccccggucccgcccg

SEQ ID NO: 15330 - RNA, 18 nt, Artificial Sequence
  Synthetic
gcccgucgguggggcccg

SEQ ID NO: 15331 - RNA, 19 nt, Artificial Sequence
  Synthetic
ggcccgucgguggggcccg

SEQ ID NO: 15332 - RNA, 20 nt, Artificial Sequence
  Synthetic
cggcccgucgguggggcccg

SEQ ID NO: 15333 - RNA, 21 nt, Artificial Sequence
  Synthetic
gcggcccgucgguggggcccg

SEQ ID NO: 15334 - RNA, 22 nt, Artificial Sequence
  Synthetic
ggcggcccgucgguggggcccg

SEQ ID NO: 15335 - RNA, 23 nt, Artificial Sequence
  Synthetic
cggcggcccgucgguggggcccg

SEQ ID NO: 15336 - RNA, 24 nt, Artificial Sequence
  Synthetic
gcggcggcccgucgguggggcccg

SEQ ID NO: 15337 - RNA, 18 nt, Artificial Sequence
  Synthetic
gggggcccucccgucccg

SEQ ID NO: 15338 - RNA, 19 nt, Artificial Sequence
  Synthetic
cgggggcccucccgucccg

SEQ ID NO: 15339 - RNA, 20 nt, Artificial Sequence
  Synthetic
gcgggggcccucccgucccg

SEQ ID NO: 15340 - RNA, 18 nt, Artificial Sequence
  Synthetic
auauagucccaggggccg

SEQ ID NO: 15341 - RNA, 19 nt, Artificial Sequence
  Synthetic
cauauagucccaggggccg

SEQ ID NO: 15342 - RNA, 20 nt, Artificial Sequence
  Synthetic
ucauauagucccaggggccg

SEQ ID NO: 15343 - RNA, 21 nt, Artificial Sequence
  Synthetic
cucauauagucccaggggccg

SEQ ID NO: 15344 - RNA, 22 nt, Artificial Sequence
  Synthetic
gcucauauagucccaggggccg

SEQ ID NO: 15345 - RNA, 23 nt, Artificial Sequence
  Synthetic
ggcucauauagucccaggggccg

SEQ ID NO: 15346 - RNA, 24 nt, Artificial Sequence
  Synthetic
gggcucauauagucccaggggccg

SEQ ID NO: 15347 - RNA, 18 nt, Artificial Sequence
  Synthetic
ccgcccccccauuggccg

SEQ ID NO: 15348 - RNA, 19 nt, Artificial Sequence
  Synthetic
gccgcccccccauuggccg

SEQ ID NO: 15349 - RNA, 20 nt, Artificial Sequence
  Synthetic
ugccgcccccccauuggccg

SEQ ID NO: 15350 - RNA, 21 nt, Artificial Sequence
  Synthetic
uugccgcccccccauuggccg

SEQ ID NO: 15351 - RNA, 22 nt, Artificial Sequence
  Synthetic
cuugccgcccccccauuggccg

SEQ ID NO: 15352 - RNA, 23 nt, Artificial Sequence
  Synthetic
ccuugccgcccccccauuggccg

SEQ ID NO: 15353 - RNA, 24 nt, Artificial Sequence
  Synthetic
gccuugccgcccccccauuggccg

SEQ ID NO: 15354 - RNA, 18 nt, Artificial Sequence
  Synthetic
uaucggcgucccggcgcg

SEQ ID NO: 15355 - RNA, 19 nt, Artificial Sequence
  Synthetic
guaucggcgucccggcgcg

SEQ ID NO: 15356 - RNA, 20 nt, Artificial Sequence
  Synthetic
cguaucggcgucccggcgcg

SEQ ID NO: 15357 - RNA, 21 nt, Artificial Sequence
  Synthetic
gcguaucggcgucccggcgcg

SEQ ID NO: 15358 - RNA, 22 nt, Artificial Sequence
  Synthetic
cgcguaucggcgucccggcgcg

SEQ ID NO: 15359 - RNA, 23 nt, Artificial Sequence
  Synthetic
ccgcguaucggcgucccggcgcg

SEQ ID NO: 15360 - RNA, 24 nt, Artificial Sequence
  Synthetic
uccgcguaucggcgucccggcgcg

SEQ ID NO: 15361 - RNA, 18 nt, Artificial Sequence
  Synthetic
gucaccuacggacucucg

SEQ ID NO: 15362 - RNA, 19 nt, Artificial Sequence
  Synthetic
ggucaccuacggacucucg

SEQ ID NO: 15363 - RNA, 20 nt, Artificial Sequence
  Synthetic
aggucaccuacggacucucg

SEQ ID NO: 15364 - RNA, 21 nt, Artificial Sequence
  Synthetic
uaggucaccuacggacucucg

SEQ ID NO: 15365 - RNA, 22 nt, Artificial Sequence
  Synthetic
guaggucaccuacggacucucg

SEQ ID NO: 15366 - RNA, 23 nt, Artificial Sequence
  Synthetic
gguaggucaccuacggacucucg

SEQ ID NO: 15367 - RNA, 24 nt, Artificial Sequence
  Synthetic
cgguaggucaccuacggacucucg

SEQ ID NO: 15368 - RNA, 18 nt, Artificial Sequence
  Synthetic
gugggcggcggcccgucg

SEQ ID NO: 15369 - RNA, 19 nt, Artificial Sequence
  Synthetic
ggugggcggcggcccgucg

SEQ ID NO: 15370 - RNA, 20 nt, Artificial Sequence
  Synthetic
gggugggcggcggcccgucg

SEQ ID NO: 15371 - RNA, 21 nt, Artificial Sequence
  Synthetic
ggggugggcggcggcccgucg

SEQ ID NO: 15372 - RNA, 22 nt, Artificial Sequence
  Synthetic
cggggugggcggcggcccgucg

SEQ ID NO: 15373 - RNA, 23 nt, Artificial Sequence
  Synthetic
ucggggugggcggcggcccgucg

SEQ ID NO: 15374 - RNA, 24 nt, Artificial Sequence
  Synthetic
cucggggugggcggcggcccgucg

SEQ ID NO: 15375 - RNA, 18 nt, Artificial Sequence
  Synthetic
ccgucccgccgggcgucg

SEQ ID NO: 15376 - RNA, 19 nt, Artificial Sequence
  Synthetic
cccgucccgccgggcgucg

SEQ ID NO: 15377 - RNA, 20 nt, Artificial Sequence
  Synthetic
ucccgucccgccgggcgucg

SEQ ID NO: 15378 - RNA, 21 nt, Artificial Sequence
  Synthetic
cucccgucccgccgggcgucg

SEQ ID NO: 15379 - RNA, 22 nt, Artificial Sequence
  Synthetic
ccucccgucccgccgggcgucg

SEQ ID NO: 15380 - RNA, 23 nt, Artificial Sequence
  Synthetic
cccucccgucccgccgggcgucg

SEQ ID NO: 15381 - RNA, 24 nt, Artificial Sequence
  Synthetic
gcccucccgucccgccgggcgucg

SEQ ID NO: 15382 - RNA, 18 nt, Artificial Sequence
  Synthetic
cgggcgucgucgaggucg

SEQ ID NO: 15383 - RNA, 19 nt, Artificial Sequence
  Synthetic
ccgggcgucgucgaggucg

SEQ ID NO: 15384 - RNA, 20 nt, Artificial Sequence
  Synthetic
gccgggcgucgucgaggucg

SEQ ID NO: 15385 - RNA, 21 nt, Artificial Sequence
  Synthetic
cgccgggcgucgucgaggucg

SEQ ID NO: 15386 - RNA, 22 nt, Artificial Sequence
  Synthetic
ccgccgggcgucgucgaggucg

SEQ ID NO: 15387 - RNA, 23 nt, Artificial Sequence
  Synthetic
cccgccgggcgucgucgaggucg

SEQ ID NO: 15388 - RNA, 24 nt, Artificial Sequence
  Synthetic
ucccgccgggcgucgucgaggucg

SEQ ID NO: 15389 - RNA, 18 nt, Artificial Sequence
  Synthetic
caggggccggcgggaagg

SEQ ID NO: 15390 - RNA, 19 nt, Artificial Sequence
  Synthetic
ccaggggccggcgggaagg

SEQ ID NO: 15391 - RNA, 20 nt, Artificial Sequence
  Synthetic
cccaggggccggcgggaagg

SEQ ID NO: 15392 - RNA, 21 nt, Artificial Sequence
  Synthetic
ucccaggggccggcgggaagg

SEQ ID NO: 15393 - RNA, 22 nt, Artificial Sequence
  Synthetic
gucccaggggccggcgggaagg

SEQ ID NO: 15394 - RNA, 23 nt, Artificial Sequence
  Synthetic
agucccaggggccggcgggaagg

SEQ ID NO: 15395 - RNA, 24 nt, Artificial Sequence
  Synthetic
uagucccaggggccggcgggaagg

SEQ ID NO: 15396 - RNA, 18 nt, Artificial Sequence
  Synthetic
uauagucccaggggccgg

SEQ ID NO: 15397 - RNA, 19 nt, Artificial Sequence
  Synthetic
auauagucccaggggccgg

SEQ ID NO: 15398 - RNA, 20 nt, Artificial Sequence
  Synthetic
cauauagucccaggggccgg

SEQ ID NO: 15399 - RNA, 21 nt, Artificial Sequence
  Synthetic
ucauauagucccaggggccgg

SEQ ID NO: 15400 - RNA, 22 nt, Artificial Sequence
  Synthetic
cucauauagucccaggggccgg

SEQ ID NO: 15401 - RNA, 23 nt, Artificial Sequence
  Synthetic
gcucauauagucccaggggccgg

SEQ ID NO: 15402 - RNA, 24 nt, Artificial Sequence
  Synthetic
ggcucauauagucccaggggccgg

SEQ ID NO: 15403 - RNA, 18 nt, Artificial Sequence
  Synthetic
ccccccauuggccggcgg

SEQ ID NO: 15404 - RNA, 19 nt, Artificial Sequence
  Synthetic
cccccccauuggccggcgg

SEQ ID NO: 15405 - RNA, 20 nt, Artificial Sequence
  Synthetic
gcccccccauuggccggcgg

SEQ ID NO: 15406 - RNA, 21 nt, Artificial Sequence
  Synthetic
cgcccccccauuggccggcgg

SEQ ID NO: 15407 - RNA, 22 nt, Artificial Sequence
  Synthetic
ccgcccccccauuggccggcgg

SEQ ID NO: 15408 - RNA, 23 nt, Artificial Sequence
  Synthetic
gccgcccccccauuggccggcgg

SEQ ID NO: 15409 - RNA, 24 nt, Artificial Sequence
  Synthetic
ugccgcccccccauuggccggcgg

SEQ ID NO: 15410 - RNA, 18 nt, Artificial Sequence
  Synthetic
ugggcggcggcccgucgg

SEQ ID NO: 15411 - RNA, 19 nt, Artificial Sequence
  Synthetic
gugggcggcggcccgucgg

SEQ ID NO: 15412 - RNA, 20 nt, Artificial Sequence
  Synthetic
ggugggcggcggcccgucgg

SEQ ID NO: 15413 - RNA, 21 nt, Artificial Sequence
  Synthetic
gggugggcggcggcccgucgg

SEQ ID NO: 15414 - RNA, 22 nt, Artificial Sequence
  Synthetic
ggggugggcggcggcccgucgg

SEQ ID NO: 15415 - RNA, 23 nt, Artificial Sequence
  Synthetic
cggggugggcggcggcccgucgg

SEQ ID NO: 15416 - RNA, 24 nt, Artificial Sequence
  Synthetic
ucggggugggcggcggcccgucgg

SEQ ID NO: 15417 - RNA, 18 nt, Artificial Sequence
  Synthetic
augcuaacgaggaacggg

SEQ ID NO: 15418 - RNA, 19 nt, Artificial Sequence
  Synthetic
caugcuaacgaggaacggg

SEQ ID NO: 15419 - RNA, 20 nt, Artificial Sequence
  Synthetic
gcaugcuaacgaggaacggg

SEQ ID NO: 15420 - RNA, 21 nt, Artificial Sequence
  Synthetic
cgcaugcuaacgaggaacggg

SEQ ID NO: 15421 - RNA, 22 nt, Artificial Sequence
  Synthetic
ccgcaugcuaacgaggaacggg

SEQ ID NO: 15422 - RNA, 23 nt, Artificial Sequence
  Synthetic
uccgcaugcuaacgaggaacggg

SEQ ID NO: 15423 - RNA, 24 nt, Artificial Sequence
  Synthetic
uuccgcaugcuaacgaggaacggg

SEQ ID NO: 15424 - RNA, 18 nt, Artificial Sequence
  Synthetic
gucccaggggccggcggg

SEQ ID NO: 15425 - RNA, 19 nt, Artificial Sequence
  Synthetic
agucccaggggccggcggg

SEQ ID NO: 15426 - RNA, 20 nt, Artificial Sequence
  Synthetic
uagucccaggggccggcggg

SEQ ID NO: 15427 - RNA, 21 nt, Artificial Sequence
  Synthetic
auagucccaggggccggcggg

SEQ ID NO: 15428 - RNA, 22 nt, Artificial Sequence
  Synthetic
uauagucccaggggccggcggg

SEQ ID NO: 15429 - RNA, 23 nt, Artificial Sequence
  Synthetic
auauagucccaggggccggcggg

SEQ ID NO: 15430 - RNA, 24 nt, Artificial Sequence
  Synthetic
cauauagucccaggggccggcggg

SEQ ID NO: 15431 - RNA, 18 nt, Artificial Sequence
  Synthetic
cccccauuggccggcggg

SEQ ID NO: 15432 - RNA, 19 nt, Artificial Sequence
  Synthetic
ccccccauuggccggcggg

SEQ ID NO: 15433 - RNA, 20 nt, Artificial Sequence
  Synthetic
cccccccauuggccggcggg

SEQ ID NO: 15434 - RNA, 21 nt, Artificial Sequence
  Synthetic
gcccccccauuggccggcggg

SEQ ID NO: 15435 - RNA, 22 nt, Artificial Sequence
  Synthetic
cgcccccccauuggccggcggg

SEQ ID NO: 15436 - RNA, 23 nt, Artificial Sequence
  Synthetic
ccgcccccccauuggccggcggg

SEQ ID NO: 15437 - RNA, 24 nt, Artificial Sequence
  Synthetic
gccgcccccccauuggccggcggg

SEQ ID NO: 15438 - RNA, 18 nt, Artificial Sequence
  Synthetic
ucgcggucugggcucggg

SEQ ID NO: 15439 - RNA, 19 nt, Artificial Sequence
  Synthetic
gucgcggucugggcucggg

SEQ ID NO: 15440 - RNA, 20 nt, Artificial Sequence
  Synthetic
cgucgcggucugggcucggg

SEQ ID NO: 15441 - RNA, 21 nt, Artificial Sequence
  Synthetic
ucgucgcggucugggcucggg

SEQ ID NO: 15442 - RNA, 22 nt, Artificial Sequence
  Synthetic
cucgucgcggucugggcucggg

SEQ ID NO: 15443 - RNA, 23 nt, Artificial Sequence
  Synthetic
gcucgucgcggucugggcucggg

SEQ ID NO: 15444 - RNA, 24 nt, Artificial Sequence
  Synthetic
cgcucgucgcggucugggcucggg

SEQ ID NO: 15445 - RNA, 18 nt, Artificial Sequence
  Synthetic
acgaggaacgggcagggg

SEQ ID NO: 15446 - RNA, 19 nt, Artificial Sequence
  Synthetic
aacgaggaacgggcagggg

SEQ ID NO: 15447 - RNA, 20 nt, Artificial Sequence
  Synthetic
uaacgaggaacgggcagggg

SEQ ID NO: 15448 - RNA, 21 nt, Artificial Sequence
  Synthetic
cuaacgaggaacgggcagggg

SEQ ID NO: 15449 - RNA, 22 nt, Artificial Sequence
  Synthetic
gcuaacgaggaacgggcagggg

SEQ ID NO: 15450 - RNA, 23 nt, Artificial Sequence
  Synthetic
ugcuaacgaggaacgggcagggg

SEQ ID NO: 15451 - RNA, 24 nt, Artificial Sequence
  Synthetic
augcuaacgaggaacgggcagggg

SEQ ID NO: 15452 - RNA, 18 nt, Artificial Sequence
  Synthetic
ucucgauggggggagggg

SEQ ID NO: 15453 - RNA, 19 nt, Artificial Sequence
  Synthetic
cucucgauggggggagggg

SEQ ID NO: 15454 - RNA, 20 nt, Artificial Sequence
  Synthetic
acucucgauggggggagggg

SEQ ID NO: 15455 - RNA, 21 nt, Artificial Sequence
  Synthetic
gacucucgauggggggagggg

SEQ ID NO: 15456 - RNA, 22 nt, Artificial Sequence
  Synthetic
ggacucucgauggggggagggg

SEQ ID NO: 15457 - RNA, 23 nt, Artificial Sequence
  Synthetic
cggacucucgauggggggagggg

SEQ ID NO: 15458 - RNA, 24 nt, Artificial Sequence
  Synthetic
acggacucucgauggggggagggg

SEQ ID NO: 15459 - RNA, 18 nt, Artificial Sequence
  Synthetic
cgaggaacgggcaggggg

SEQ ID NO: 15460 - RNA, 19 nt, Artificial Sequence
  Synthetic
acgaggaacgggcaggggg

SEQ ID NO: 15461 - RNA, 20 nt, Artificial Sequence
  Synthetic
aacgaggaacgggcaggggg

SEQ ID NO: 15462 - RNA, 21 nt, Artificial Sequence
  Synthetic
uaacgaggaacgggcaggggg

SEQ ID NO: 15463 - RNA, 22 nt, Artificial Sequence
  Synthetic
cuaacgaggaacgggcaggggg

SEQ ID NO: 15464 - RNA, 23 nt, Artificial Sequence
  Synthetic
gcuaacgaggaacgggcaggggg

SEQ ID NO: 15465 - RNA, 24 nt, Artificial Sequence
  Synthetic
ugcuaacgaggaacgggcaggggg

SEQ ID NO: 15466 - RNA, 18 nt, Artificial Sequence
  Synthetic
cggacucucgaugggggg

SEQ ID NO: 15467 - RNA, 19 nt, Artificial Sequence
  Synthetic
acggacucucgaugggggg

SEQ ID NO: 15468 - RNA, 20 nt, Artificial Sequence
  Synthetic
uacggacucucgaugggggg

SEQ ID NO: 15469 - RNA, 21 nt, Artificial Sequence
  Synthetic
cuacggacucucgaugggggg

SEQ ID NO: 15470 - RNA, 22 nt, Artificial Sequence
  Synthetic
ccuacggacucucgaugggggg

SEQ ID NO: 15471 - RNA, 23 nt, Artificial Sequence
  Synthetic
accuacggacucucgaugggggg

SEQ ID NO: 15472 - RNA, 24 nt, Artificial Sequence
  Synthetic
caccuacggacucucgaugggggg

SEQ ID NO: 15473 - RNA, 18 nt, Artificial Sequence
  Synthetic
acggacucucgauggggg

SEQ ID NO: 15474 - RNA, 19 nt, Artificial Sequence
  Synthetic
uacggacucucgauggggg

SEQ ID NO: 15475 - RNA, 20 nt, Artificial Sequence
  Synthetic
cuacggacucucgauggggg

SEQ ID NO: 15476 - RNA, 21 nt, Artificial Sequence
  Synthetic
ccuacggacucucgauggggg

SEQ ID NO: 15477 - RNA, 22 nt, Artificial Sequence
  Synthetic
accuacggacucucgauggggg

SEQ ID NO: 15478 - RNA, 23 nt, Artificial Sequence
  Synthetic
caccuacggacucucgauggggg

SEQ ID NO: 15479 - RNA, 24 nt, Artificial Sequence
  Synthetic
ucaccuacggacucucgauggggg

SEQ ID NO: 15480 - RNA, 18 nt, Artificial Sequence
  Synthetic
cgcgccaucugccauggg

SEQ ID NO: 15481 - RNA, 19 nt, Artificial Sequence
  Synthetic
ccgcgccaucugccauggg

SEQ ID NO: 15482 - RNA, 20 nt, Artificial Sequence
  Synthetic
uccgcgccaucugccauggg

SEQ ID NO: 15483 - RNA, 21 nt, Artificial Sequence
  Synthetic
auccgcgccaucugccauggg

SEQ ID NO: 15484 - RNA, 22 nt, Artificial Sequence
  Synthetic
cauccgcgccaucugccauggg

SEQ ID NO: 15485 - RNA, 23 nt, Artificial Sequence
  Synthetic
ccauccgcgccaucugccauggg

SEQ ID NO: 15486 - RNA, 24 nt, Artificial Sequence
  Synthetic
cccauccgcgccaucugccauggg

SEQ ID NO: 15487 - RNA, 18 nt, Artificial Sequence
  Synthetic
cuacggacucucgauggg

SEQ ID NO: 15488 - RNA, 19 nt, Artificial Sequence
  Synthetic
ccuacggacucucgauggg

SEQ ID NO: 15489 - RNA, 20 nt, Artificial Sequence
  Synthetic
accuacggacucucgauggg

SEQ ID NO: 15490 - RNA, 21 nt, Artificial Sequence
  Synthetic
caccuacggacucucgauggg

SEQ ID NO: 15491 - RNA, 22 nt, Artificial Sequence
  Synthetic
ucaccuacggacucucgauggg

SEQ ID NO: 15492 - RNA, 23 nt, Artificial Sequence
  Synthetic
gucaccuacggacucucgauggg

SEQ ID NO: 15493 - RNA, 24 nt, Artificial Sequence
  Synthetic
ggucaccuacggacucucgauggg

SEQ ID NO: 15494 - RNA, 18 nt, Artificial Sequence
  Synthetic
gaccggucgaugcuuggg

SEQ ID NO: 15495 - RNA, 19 nt, Artificial Sequence
  Synthetic
ggaccggucgaugcuuggg

SEQ ID NO: 15496 - RNA, 20 nt, Artificial Sequence
  Synthetic
cggaccggucgaugcuuggg

SEQ ID NO: 15497 - RNA, 21 nt, Artificial Sequence
  Synthetic
gcggaccggucgaugcuuggg

SEQ ID NO: 15498 - RNA, 22 nt, Artificial Sequence
  Synthetic
cgcggaccggucgaugcuuggg

SEQ ID NO: 15499 - RNA, 23 nt, Artificial Sequence
  Synthetic
gcgcggaccggucgaugcuuggg

SEQ ID NO: 15500 - RNA, 24 nt, Artificial Sequence
  Synthetic
agcgcggaccggucgaugcuuggg

SEQ ID NO: 15501 - RNA, 18 nt, Artificial Sequence
  Synthetic
ccgcgccaucugccaugg

SEQ ID NO: 15502 - RNA, 19 nt, Artificial Sequence
  Synthetic
uccgcgccaucugccaugg

SEQ ID NO: 15503 - RNA, 20 nt, Artificial Sequence
  Synthetic
auccgcgccaucugccaugg

SEQ ID NO: 15504 - RNA, 21 nt, Artificial Sequence
  Synthetic
cauccgcgccaucugccaugg

SEQ ID NO: 15505 - RNA, 22 nt, Artificial Sequence
  Synthetic
ccauccgcgccaucugccaugg

SEQ ID NO: 15506 - RNA, 23 nt, Artificial Sequence
  Synthetic
cccauccgcgccaucugccaugg

SEQ ID NO: 15507 - RNA, 24 nt, Artificial Sequence
  Synthetic
gcccauccgcgccaucugccaugg

SEQ ID NO: 15508 - RNA, 18 nt, Artificial Sequence
  Synthetic
ccuacggacucucgaugg

SEQ ID NO: 15509 - RNA, 19 nt, Artificial Sequence
  Synthetic
accuacggacucucgaugg

SEQ ID NO: 15510 - RNA, 20 nt, Artificial Sequence
  Synthetic
caccuacggacucucgaugg

SEQ ID NO: 15511 - RNA, 21 nt, Artificial Sequence
  Synthetic
ucaccuacggacucucgaugg

SEQ ID NO: 15512 - RNA, 22 nt, Artificial Sequence
  Synthetic
gucaccuacggacucucgaugg

SEQ ID NO: 15513 - RNA, 23 nt, Artificial Sequence
  Synthetic
ggucaccuacggacucucgaugg

SEQ ID NO: 15514 - RNA, 24 nt, Artificial Sequence
  Synthetic
aggucaccuacggacucucgaugg

SEQ ID NO: 15515 - RNA, 18 nt, Artificial Sequence
  Synthetic
ggguggucggggucgugg

SEQ ID NO: 15516 - RNA, 19 nt, Artificial Sequence
  Synthetic
gggguggucggggucgugg

SEQ ID NO: 15517 - RNA, 20 nt, Artificial Sequence
  Synthetic
ggggguggucggggucgugg

SEQ ID NO: 15518 - RNA, 21 nt, Artificial Sequence
  Synthetic
uggggguggucggggucgugg

SEQ ID NO: 15519 - RNA, 22 nt, Artificial Sequence
  Synthetic
guggggguggucggggucgugg

SEQ ID NO: 15520 - RNA, 23 nt, Artificial Sequence
  Synthetic
cguggggguggucggggucgugg

SEQ ID NO: 15521 - RNA, 24 nt, Artificial Sequence
  Synthetic
ucguggggguggucggggucgugg

SEQ ID NO: 15522 - RNA, 18 nt, Artificial Sequence
  Synthetic
ucgaggucgugggggugg

SEQ ID NO: 15523 - RNA, 19 nt, Artificial Sequence
  Synthetic
gucgaggucgugggggugg

SEQ ID NO: 15524 - RNA, 20 nt, Artificial Sequence
  Synthetic
cgucgaggucgugggggugg

SEQ ID NO: 15525 - RNA, 21 nt, Artificial Sequence
  Synthetic
ucgucgaggucgugggggugg

SEQ ID NO: 15526 - RNA, 22 nt, Artificial Sequence
  Synthetic
gucgucgaggucgugggggugg

SEQ ID NO: 15527 - RNA, 23 nt, Artificial Sequence
  Synthetic
cgucgucgaggucgugggggugg

SEQ ID NO: 15528 - RNA, 24 nt, Artificial Sequence
  Synthetic
gcgucgucgaggucgugggggugg

SEQ ID NO: 15529 - RNA, 18 nt, Artificial Sequence
  Synthetic
ggaccggucgaugcuugg

SEQ ID NO: 15530 - RNA, 19 nt, Artificial Sequence
  Synthetic
cggaccggucgaugcuugg

SEQ ID NO: 15531 - RNA, 20 nt, Artificial Sequence
  Synthetic
gcggaccggucgaugcuugg

SEQ ID NO: 15532 - RNA, 21 nt, Artificial Sequence
  Synthetic
cgcggaccggucgaugcuugg

SEQ ID NO: 15533 - RNA, 22 nt, Artificial Sequence
  Synthetic
gcgcggaccggucgaugcuugg

SEQ ID NO: 15534 - RNA, 23 nt, Artificial Sequence
  Synthetic
agcgcggaccggucgaugcuugg

SEQ ID NO: 15535 - RNA, 24 nt, Artificial Sequence
  Synthetic
uagcgcggaccggucgaugcuugg

SEQ ID NO: 15536 - RNA, 18 nt, Artificial Sequence
  Synthetic
guggccgcggcccguugg

SEQ ID NO: 15537 - RNA, 19 nt, Artificial Sequence
  Synthetic
cguggccgcggcccguugg

SEQ ID NO: 15538 - RNA, 20 nt, Artificial Sequence
  Synthetic
ccguggccgcggcccguugg

SEQ ID NO: 15539 - RNA, 21 nt, Artificial Sequence
  Synthetic
cccguggccgcggcccguugg

SEQ ID NO: 15540 - RNA, 22 nt, Artificial Sequence
  Synthetic
gcccguggccgcggcccguugg

SEQ ID NO: 15541 - RNA, 23 nt, Artificial Sequence
  Synthetic
ggcccguggccgcggcccguugg

SEQ ID NO: 15542 - RNA, 24 nt, Artificial Sequence
  Synthetic
gggcccguggccgcggcccguugg

SEQ ID NO: 15543 - RNA, 18 nt, Artificial Sequence
  Synthetic
ccgacgccaucgccgaug

SEQ ID NO: 15544 - RNA, 19 nt, Artificial Sequence
  Synthetic
uccgacgccaucgccgaug

SEQ ID NO: 15545 - RNA, 20 nt, Artificial Sequence
  Synthetic
cuccgacgccaucgccgaug

SEQ ID NO: 15546 - RNA, 21 nt, Artificial Sequence
  Synthetic
ucuccgacgccaucgccgaug

SEQ ID NO: 15547 - RNA, 22 nt, Artificial Sequence
  Synthetic
uucuccgacgccaucgccgaug

SEQ ID NO: 15548 - RNA, 23 nt, Artificial Sequence
  Synthetic
guucuccgacgccaucgccgaug

SEQ ID NO: 15549 - RNA, 24 nt, Artificial Sequence
  Synthetic
uguucuccgacgccaucgccgaug

SEQ ID NO: 15550 - RNA, 18 nt, Artificial Sequence
  Synthetic
accuacggacucucgaug

SEQ ID NO: 15551 - RNA, 19 nt, Artificial Sequence
  Synthetic
caccuacggacucucgaug

SEQ ID NO: 15552 - RNA, 20 nt, Artificial Sequence
  Synthetic
ucaccuacggacucucgaug

SEQ ID NO: 15553 - RNA, 21 nt, Artificial Sequence
  Synthetic
gucaccuacggacucucgaug

SEQ ID NO: 15554 - RNA, 22 nt, Artificial Sequence
  Synthetic
ggucaccuacggacucucgaug

SEQ ID NO: 15555 - RNA, 23 nt, Artificial Sequence
  Synthetic
aggucaccuacggacucucgaug

SEQ ID NO: 15556 - RNA, 24 nt, Artificial Sequence
  Synthetic
uaggucaccuacggacucucgaug

SEQ ID NO: 15557 - RNA, 18 nt, Artificial Sequence
  Synthetic
guucggcgguaaugagau

SEQ ID NO: 15558 - RNA, 19 nt, Artificial Sequence
  Synthetic
gguucggcgguaaugagau

SEQ ID NO: 15559 - RNA, 20 nt, Artificial Sequence
  Synthetic
cgguucggcgguaaugagau

SEQ ID NO: 15560 - RNA, 21 nt, Artificial Sequence
  Synthetic
ccgguucggcgguaaugagau

SEQ ID NO: 15561 - RNA, 22 nt, Artificial Sequence
  Synthetic
cccgguucggcgguaaugagau

SEQ ID NO: 15562 - RNA, 23 nt, Artificial Sequence
  Synthetic
ucccgguucggcgguaaugagau

SEQ ID NO: 15563 - RNA, 24 nt, Artificial Sequence
  Synthetic
uucccgguucggcgguaaugagau

SEQ ID NO: 15564 - RNA, 18 nt, Artificial Sequence
  Synthetic
uccgacgccaucgccgau

SEQ ID NO: 15565 - RNA, 19 nt, Artificial Sequence
  Synthetic
cuccgacgccaucgccgau

SEQ ID NO: 15566 - RNA, 20 nt, Artificial Sequence
  Synthetic
ucuccgacgccaucgccgau

SEQ ID NO: 15567 - RNA, 21 nt, Artificial Sequence
  Synthetic
uucuccgacgccaucgccgau

SEQ ID NO: 15568 - RNA, 22 nt, Artificial Sequence
  Synthetic
guucuccgacgccaucgccgau

SEQ ID NO: 15569 - RNA, 23 nt, Artificial Sequence
  Synthetic
uguucuccgacgccaucgccgau

SEQ ID NO: 15570 - RNA, 24 nt, Artificial Sequence
  Synthetic
uuguucuccgacgccaucgccgau

SEQ ID NO: 15571 - RNA, 18 nt, Artificial Sequence
  Synthetic
caccuacggacucucgau

SEQ ID NO: 15572 - RNA, 19 nt, Artificial Sequence
  Synthetic
ucaccuacggacucucgau

SEQ ID NO: 15573 - RNA, 20 nt, Artificial Sequence
  Synthetic
gucaccuacggacucucgau

SEQ ID NO: 15574 - RNA, 21 nt, Artificial Sequence
  Synthetic
ggucaccuacggacucucgau

SEQ ID NO: 15575 - RNA, 22 nt, Artificial Sequence
  Synthetic
aggucaccuacggacucucgau

SEQ ID NO: 15576 - RNA, 23 nt, Artificial Sequence
  Synthetic
uaggucaccuacggacucucgau

SEQ ID NO: 15577 - RNA, 24 nt, Artificial Sequence
  Synthetic
guaggucaccuacggacucucgau

SEQ ID NO: 15578 - RNA, 18 nt, Artificial Sequence
  Synthetic
uagcacgguaggucaccu

SEQ ID NO: 15579 - RNA, 19 nt, Artificial Sequence
  Synthetic
guagcacgguaggucaccu

SEQ ID NO: 15580 - RNA, 20 nt, Artificial Sequence
  Synthetic
cguagcacgguaggucaccu

SEQ ID NO: 15581 - RNA, 21 nt, Artificial Sequence
  Synthetic
acguagcacgguaggucaccu

SEQ ID NO: 15582 - RNA, 22 nt, Artificial Sequence
  Synthetic
gacguagcacgguaggucaccu

SEQ ID NO: 15583 - RNA, 23 nt, Artificial Sequence
  Synthetic
ggacguagcacgguaggucaccu

SEQ ID NO: 15584 - RNA, 24 nt, Artificial Sequence
  Synthetic
cggacguagcacgguaggucaccu

SEQ ID NO: 15585 - RNA, 18 nt, Artificial Sequence
  Synthetic
ccgaugcggggcgauccu

SEQ ID NO: 15586 - RNA, 19 nt, Artificial Sequence
  Synthetic
gccgaugcggggcgauccu

SEQ ID NO: 15587 - RNA, 20 nt, Artificial Sequence
  Synthetic
cgccgaugcggggcgauccu

SEQ ID NO: 15588 - RNA, 21 nt, Artificial Sequence
  Synthetic
ucgccgaugcggggcgauccu

SEQ ID NO: 15589 - RNA, 22 nt, Artificial Sequence
  Synthetic
aucgccgaugcggggcgauccu

SEQ ID NO: 15590 - RNA, 23 nt, Artificial Sequence
  Synthetic
caucgccgaugcggggcgauccu

SEQ ID NO: 15591 - RNA, 24 nt, Artificial Sequence
  Synthetic
ccaucgccgaugcggggcgauccu

SEQ ID NO: 15592 - RNA, 18 nt, Artificial Sequence
  Synthetic
ccccccgcucgucgcggu

SEQ ID NO: 15593 - RNA, 19 nt, Artificial Sequence
  Synthetic
gccccccgcucgucgcggu

SEQ ID NO: 15594 - RNA, 20 nt, Artificial Sequence
  Synthetic
ggccccccgcucgucgcggu

SEQ ID NO: 15595 - RNA, 21 nt, Artificial Sequence
  Synthetic
gggccccccgcucgucgcggu

SEQ ID NO: 15596 - RNA, 22 nt, Artificial Sequence
  Synthetic
agggccccccgcucgucgcggu

SEQ ID NO: 15597 - RNA, 23 nt, Artificial Sequence
  Synthetic
gagggccccccgcucgucgcggu

SEQ ID NO: 15598 - RNA, 24 nt, Artificial Sequence
  Synthetic
cgagggccccccgcucgucgcggu

SEQ ID NO: 15599 - RNA, 18 nt, Artificial Sequence
  Synthetic
accggucgaugcuugggu

SEQ ID NO: 15600 - RNA, 19 nt, Artificial Sequence
  Synthetic
gaccggucgaugcuugggu

SEQ ID NO: 15601 - RNA, 20 nt, Artificial Sequence
  Synthetic
ggaccggucgaugcuugggu

SEQ ID NO: 15602 - RNA, 21 nt, Artificial Sequence
  Synthetic
cggaccggucgaugcuugggu

SEQ ID NO: 15603 - RNA, 22 nt, Artificial Sequence
  Synthetic
gcggaccggucgaugcuugggu

SEQ ID NO: 15604 - RNA, 23 nt, Artificial Sequence
  Synthetic
cgcggaccggucgaugcuugggu

SEQ ID NO: 15605 - RNA, 24 nt, Artificial Sequence
  Synthetic
gcgcggaccggucgaugcuugggu

SEQ ID NO: 15606 - RNA, 18 nt, Artificial Sequence
  Synthetic
gucccgcccgccggccaa

SEQ ID NO: 15607 - RNA, 19 nt, Artificial Sequence
  Synthetic
ggucccgcccgccggccaa

SEQ ID NO: 15608 - RNA, 20 nt, Artificial Sequence
  Synthetic
cggucccgcccgccggccaa

SEQ ID NO: 15609 - RNA, 18 nt, Artificial Sequence
  Synthetic
uaucucauuaccgccgaa

SEQ ID NO: 15610 - RNA, 19 nt, Artificial Sequence
  Synthetic
guaucucauuaccgccgaa

SEQ ID NO: 15611 - RNA, 20 nt, Artificial Sequence
  Synthetic
cguaucucauuaccgccgaa

SEQ ID NO: 15612 - RNA, 21 nt, Artificial Sequence
  Synthetic
ucguaucucauuaccgccgaa

SEQ ID NO: 15613 - RNA, 22 nt, Artificial Sequence
  Synthetic
cucguaucucauuaccgccgaa

SEQ ID NO: 15614 - RNA, 23 nt, Artificial Sequence
  Synthetic
gcucguaucucauuaccgccgaa

SEQ ID NO: 15615 - RNA, 24 nt, Artificial Sequence
  Synthetic
ggcucguaucucauuaccgccgaa

SEQ ID NO: 15616 - RNA, 18 nt, Artificial Sequence
  Synthetic
uuagcaugcggaacggaa

SEQ ID NO: 15617 - RNA, 19 nt, Artificial Sequence
  Synthetic
guuagcaugcggaacggaa

SEQ ID NO: 15618 - RNA, 20 nt, Artificial Sequence
  Synthetic
cguuagcaugcggaacggaa

SEQ ID NO: 15619 - RNA, 21 nt, Artificial Sequence
  Synthetic
ucguuagcaugcggaacggaa

SEQ ID NO: 15620 - RNA, 22 nt, Artificial Sequence
  Synthetic
cucguuagcaugcggaacggaa

SEQ ID NO: 15621 - RNA, 23 nt, Artificial Sequence
  Synthetic
ccucguuagcaugcggaacggaa

SEQ ID NO: 15622 - RNA, 24 nt, Artificial Sequence
  Synthetic
uccucguuagcaugcggaacggaa

SEQ ID NO: 15623 - RNA, 18 nt, Artificial Sequence
  Synthetic
ccucguuagcaugcggaa

SEQ ID NO: 15624 - RNA, 19 nt, Artificial Sequence
  Synthetic
uccucguuagcaugcggaa

SEQ ID NO: 15625 - RNA, 20 nt, Artificial Sequence
  Synthetic
uuccucguuagcaugcggaa

SEQ ID NO: 15626 - RNA, 21 nt, Artificial Sequence
  Synthetic
guuccucguuagcaugcggaa

SEQ ID NO: 15627 - RNA, 22 nt, Artificial Sequence
  Synthetic
cguuccucguuagcaugcggaa

SEQ ID NO: 15628 - RNA, 23 nt, Artificial Sequence
  Synthetic
ccguuccucguuagcaugcggaa

SEQ ID NO: 15629 - RNA, 24 nt, Artificial Sequence
  Synthetic
cccguuccucguuagcaugcggaa

SEQ ID NO: 15630 - RNA, 18 nt, Artificial Sequence
  Synthetic
gggccggggguucgacca

SEQ ID NO: 15631 - RNA, 19 nt, Artificial Sequence
  Synthetic
ggggccggggguucgacca

SEQ ID NO: 15632 - RNA, 20 nt, Artificial Sequence
  Synthetic
cggggccggggguucgacca

SEQ ID NO: 15633 - RNA, 21 nt, Artificial Sequence
  Synthetic
gcggggccggggguucgacca

SEQ ID NO: 15634 - RNA, 22 nt, Artificial Sequence
  Synthetic
ggcggggccggggguucgacca

SEQ ID NO: 15635 - RNA, 23 nt, Artificial Sequence
  Synthetic
gggcggggccggggguucgacca

SEQ ID NO: 15636 - RNA, 24 nt, Artificial Sequence
  Synthetic
ugggcggggccggggguucgacca

SEQ ID NO: 15637 - RNA, 18 nt, Artificial Sequence
  Synthetic
ucucgcccccucccccca

SEQ ID NO: 15638 - RNA, 19 nt, Artificial Sequence
  Synthetic
gucucgcccccucccccca

SEQ ID NO: 15639 - RNA, 20 nt, Artificial Sequence
  Synthetic
ggucucgcccccucccccca

SEQ ID NO: 15640 - RNA, 21 nt, Artificial Sequence
  Synthetic
gggucucgcccccucccccca

SEQ ID NO: 15641 - RNA, 22 nt, Artificial Sequence
  Synthetic
ugggucucgcccccucccccca

SEQ ID NO: 15642 - RNA, 23 nt, Artificial Sequence
  Synthetic
gugggucucgcccccucccccca

SEQ ID NO: 15643 - RNA, 24 nt, Artificial Sequence
  Synthetic
cgugggucucgcccccucccccca

SEQ ID NO: 15644 - RNA, 18 nt, Artificial Sequence
  Synthetic
ggggcccggggacggcca

SEQ ID NO: 15645 - RNA, 19 nt, Artificial Sequence
  Synthetic
gggggcccggggacggcca

SEQ ID NO: 15646 - RNA, 20 nt, Artificial Sequence
  Synthetic
ggggggcccggggacggcca

SEQ ID NO: 15647 - RNA, 21 nt, Artificial Sequence
  Synthetic
cggggggcccggggacggcca

SEQ ID NO: 15648 - RNA, 22 nt, Artificial Sequence
  Synthetic
ccggggggcccggggacggcca

SEQ ID NO: 15649 - RNA, 23 nt, Artificial Sequence
  Synthetic
accggggggcccggggacggcca

SEQ ID NO: 15650 - RNA, 24 nt, Artificial Sequence
  Synthetic
gaccggggggcccggggacggcca

SEQ ID NO: 15651 - RNA, 18 nt, Artificial Sequence
  Synthetic
ggucccgcccgccggcca

SEQ ID NO: 15652 - RNA, 19 nt, Artificial Sequence
  Synthetic
cggucccgcccgccggcca

SEQ ID NO: 15653 - RNA, 20 nt, Artificial Sequence
  Synthetic
gcggucccgcccgccggcca

SEQ ID NO: 15654 - RNA, 18 nt, Artificial Sequence
  Synthetic
ucggguggggcgcggaga

SEQ ID NO: 15655 - RNA, 19 nt, Artificial Sequence
  Synthetic
cucggguggggcgcggaga

SEQ ID NO: 15656 - RNA, 20 nt, Artificial Sequence
  Synthetic
ccucggguggggcgcggaga

SEQ ID NO: 15657 - RNA, 21 nt, Artificial Sequence
  Synthetic
cccucggguggggcgcggaga

SEQ ID NO: 15658 - RNA, 22 nt, Artificial Sequence
  Synthetic
gcccucggguggggcgcggaga

SEQ ID NO: 15659 - RNA, 23 nt, Artificial Sequence
  Synthetic
ggcccucggguggggcgcggaga

SEQ ID NO: 15660 - RNA, 24 nt, Artificial Sequence
  Synthetic
gggcccucggguggggcgcggaga

SEQ ID NO: 15661 - RNA, 18 nt, Artificial Sequence
  Synthetic
gagcccagaccgcgacga

SEQ ID NO: 15662 - RNA, 19 nt, Artificial Sequence
  Synthetic
cgagcccagaccgcgacga

SEQ ID NO: 15663 - RNA, 20 nt, Artificial Sequence
  Synthetic
ccgagcccagaccgcgacga

SEQ ID NO: 15664 - RNA, 21 nt, Artificial Sequence
  Synthetic
cccgagcccagaccgcgacga

SEQ ID NO: 15665 - RNA, 22 nt, Artificial Sequence
  Synthetic
ccccgagcccagaccgcgacga

SEQ ID NO: 15666 - RNA, 23 nt, Artificial Sequence
  Synthetic
accccgagcccagaccgcgacga

SEQ ID NO: 15667 - RNA, 24 nt, Artificial Sequence
  Synthetic
caccccgagcccagaccgcgacga

SEQ ID NO: 15668 - RNA, 18 nt, Artificial Sequence
  Synthetic
gaagcggaaaccgccgga

SEQ ID NO: 15669 - RNA, 19 nt, Artificial Sequence
  Synthetic
ggaagcggaaaccgccgga

SEQ ID NO: 15670 - RNA, 20 nt, Artificial Sequence
  Synthetic
cggaagcggaaaccgccgga

SEQ ID NO: 15671 - RNA, 21 nt, Artificial Sequence
  Synthetic
acggaagcggaaaccgccgga

SEQ ID NO: 15672 - RNA, 22 nt, Artificial Sequence
  Synthetic
aacggaagcggaaaccgccgga

SEQ ID NO: 15673 - RNA, 23 nt, Artificial Sequence
  Synthetic
gaacggaagcggaaaccgccgga

SEQ ID NO: 15674 - RNA, 24 nt, Artificial Sequence
  Synthetic
ggaacggaagcggaaaccgccgga

SEQ ID NO: 15675 - RNA, 18 nt, Artificial Sequence
  Synthetic
uccucguuagcaugcgga

SEQ ID NO: 15676 - RNA, 19 nt, Artificial Sequence
  Synthetic
uuccucguuagcaugcgga

SEQ ID NO: 15677 - RNA, 20 nt, Artificial Sequence
  Synthetic
guuccucguuagcaugcgga

SEQ ID NO: 15678 - RNA, 21 nt, Artificial Sequence
  Synthetic
cguuccucguuagcaugcgga

SEQ ID NO: 15679 - RNA, 22 nt, Artificial Sequence
  Synthetic
ccguuccucguuagcaugcgga

SEQ ID NO: 15680 - RNA, 23 nt, Artificial Sequence
  Synthetic
cccguuccucguuagcaugcgga

SEQ ID NO: 15681 - RNA, 24 nt, Artificial Sequence
  Synthetic
gcccguuccucguuagcaugcgga

SEQ ID NO: 15682 - RNA, 18 nt, Artificial Sequence
  Synthetic
cgcggacgaagcgcggga

SEQ ID NO: 15683 - RNA, 19 nt, Artificial Sequence
  Synthetic
acgcggacgaagcgcggga

SEQ ID NO: 15684 - RNA, 20 nt, Artificial Sequence
  Synthetic
uacgcggacgaagcgcggga

SEQ ID NO: 15685 - RNA, 21 nt, Artificial Sequence
  Synthetic
auacgcggacgaagcgcggga

SEQ ID NO: 15686 - RNA, 22 nt, Artificial Sequence
  Synthetic
gauacgcggacgaagcgcggga

SEQ ID NO: 15687 - RNA, 23 nt, Artificial Sequence
  Synthetic
cgauacgcggacgaagcgcggga

SEQ ID NO: 15688 - RNA, 24 nt, Artificial Sequence
  Synthetic
ccgauacgcggacgaagcgcggga

SEQ ID NO: 15689 - RNA, 18 nt, Artificial Sequence
  Synthetic
cgacgacgcccggcggga

SEQ ID NO: 15690 - RNA, 19 nt, Artificial Sequence
  Synthetic
ucgacgacgcccggcggga

SEQ ID NO: 15691 - RNA, 20 nt, Artificial Sequence
  Synthetic
cucgacgacgcccggcggga

SEQ ID NO: 15692 - RNA, 21 nt, Artificial Sequence
  Synthetic
ccucgacgacgcccggcggga

SEQ ID NO: 15693 - RNA, 22 nt, Artificial Sequence
  Synthetic
accucgacgacgcccggcggga

SEQ ID NO: 15694 - RNA, 23 nt, Artificial Sequence
  Synthetic
gaccucgacgacgcccggcggga

SEQ ID NO: 15695 - RNA, 24 nt, Artificial Sequence
  Synthetic
cgaccucgacgacgcccggcggga

SEQ ID NO: 15696 - RNA, 18 nt, Artificial Sequence
  Synthetic
ggcguccggcgggcggga

SEQ ID NO: 15697 - RNA, 19 nt, Artificial Sequence
  Synthetic
cggcguccggcgggcggga

SEQ ID NO: 15698 - RNA, 20 nt, Artificial Sequence
  Synthetic
ccggcguccggcgggcggga

SEQ ID NO: 15699 - RNA, 21 nt, Artificial Sequence
  Synthetic
cccggcguccggcgggcggga

SEQ ID NO: 15700 - RNA, 22 nt, Artificial Sequence
  Synthetic
ucccggcguccggcgggcggga

SEQ ID NO: 15701 - RNA, 23 nt, Artificial Sequence
  Synthetic
gucccggcguccggcgggcggga

SEQ ID NO: 15702 - RNA, 24 nt, Artificial Sequence
  Synthetic
ggucccggcguccggcgggcggga

SEQ ID NO: 15703 - RNA, 18 nt, Artificial Sequence
  Synthetic
ggggcggggucgugcaua

SEQ ID NO: 15704 - RNA, 19 nt, Artificial Sequence
  Synthetic
cggggcggggucgugcaua

SEQ ID NO: 15705 - RNA, 20 nt, Artificial Sequence
  Synthetic
ucggggcggggucgugcaua

SEQ ID NO: 15706 - RNA, 21 nt, Artificial Sequence
  Synthetic
gucggggcggggucgugcaua

SEQ ID NO: 15707 - RNA, 22 nt, Artificial Sequence
  Synthetic
cgucggggcggggucgugcaua

SEQ ID NO: 15708 - RNA, 23 nt, Artificial Sequence
  Synthetic
gcgucggggcggggucgugcaua

SEQ ID NO: 15709 - RNA, 24 nt, Artificial Sequence
  Synthetic
ggcgucggggcggggucgugcaua

SEQ ID NO: 15710 - RNA, 18 nt, Artificial Sequence
  Synthetic
ccgccggaucgggcggua

SEQ ID NO: 15711 - RNA, 19 nt, Artificial Sequence
  Synthetic
accgccggaucgggcggua

SEQ ID NO: 15712 - RNA, 20 nt, Artificial Sequence
  Synthetic
aaccgccggaucgggcggua

SEQ ID NO: 15713 - RNA, 21 nt, Artificial Sequence
  Synthetic
aaaccgccggaucgggcggua

SEQ ID NO: 15714 - RNA, 22 nt, Artificial Sequence
  Synthetic
gaaaccgccggaucgggcggua

SEQ ID NO: 15715 - RNA, 23 nt, Artificial Sequence
  Synthetic
ggaaaccgccggaucgggcggua

SEQ ID NO: 15716 - RNA, 24 nt, Artificial Sequence
  Synthetic
cggaaaccgccggaucgggcggua

SEQ ID NO: 15717 - RNA, 18 nt, Artificial Sequence
  Synthetic
aucucauuaccgccgaac

SEQ ID NO: 15718 - RNA, 19 nt, Artificial Sequence
  Synthetic
uaucucauuaccgccgaac

SEQ ID NO: 15719 - RNA, 20 nt, Artificial Sequence
  Synthetic
guaucucauuaccgccgaac

SEQ ID NO: 15720 - RNA, 21 nt, Artificial Sequence
  Synthetic
cguaucucauuaccgccgaac

SEQ ID NO: 15721 - RNA, 22 nt, Artificial Sequence
  Synthetic
ucguaucucauuaccgccgaac

SEQ ID NO: 15722 - RNA, 23 nt, Artificial Sequence
  Synthetic
cucguaucucauuaccgccgaac

SEQ ID NO: 15723 - RNA, 24 nt, Artificial Sequence
  Synthetic
gcucguaucucauuaccgccgaac

SEQ ID NO: 15724 - RNA, 18 nt, Artificial Sequence
  Synthetic
acggauccacgacccgac

SEQ ID NO: 15725 - RNA, 19 nt, Artificial Sequence
  Synthetic
cacggauccacgacccgac

SEQ ID NO: 15726 - RNA, 20 nt, Artificial Sequence
  Synthetic
acacggauccacgacccgac

SEQ ID NO: 15727 - RNA, 21 nt, Artificial Sequence
  Synthetic
gacacggauccacgacccgac

SEQ ID NO: 15728 - RNA, 22 nt, Artificial Sequence
  Synthetic
cgacacggauccacgacccgac

SEQ ID NO: 15729 - RNA, 23 nt, Artificial Sequence
  Synthetic
ccgacacggauccacgacccgac

SEQ ID NO: 15730 - RNA, 24 nt, Artificial Sequence
  Synthetic
gccgacacggauccacgacccgac

SEQ ID NO: 15731 - RNA, 18 nt, Artificial Sequence
  Synthetic
gacgacgcccggcgggac

SEQ ID NO: 15732 - RNA, 19 nt, Artificial Sequence
  Synthetic
cgacgacgcccggcgggac

SEQ ID NO: 15733 - RNA, 20 nt, Artificial Sequence
  Synthetic
ucgacgacgcccggcgggac

SEQ ID NO: 15734 - RNA, 21 nt, Artificial Sequence
  Synthetic
cucgacgacgcccggcgggac

SEQ ID NO: 15735 - RNA, 22 nt, Artificial Sequence
  Synthetic
ccucgacgacgcccggcgggac

SEQ ID NO: 15736 - RNA, 23 nt, Artificial Sequence
  Synthetic
accucgacgacgcccggcgggac

SEQ ID NO: 15737 - RNA, 24 nt, Artificial Sequence
  Synthetic
gaccucgacgacgcccggcgggac

SEQ ID NO: 15738 - RNA, 18 nt, Artificial Sequence
  Synthetic
gcguccggcgggcgggac

SEQ ID NO: 15739 - RNA, 19 nt, Artificial Sequence
  Synthetic
ggcguccggcgggcgggac

SEQ ID NO: 15740 - RNA, 20 nt, Artificial Sequence
  Synthetic
cggcguccggcgggcgggac

SEQ ID NO: 15741 - RNA, 21 nt, Artificial Sequence
  Synthetic
ccggcguccggcgggcgggac

SEQ ID NO: 15742 - RNA, 22 nt, Artificial Sequence
  Synthetic
cccggcguccggcgggcgggac

SEQ ID NO: 15743 - RNA, 23 nt, Artificial Sequence
  Synthetic
ucccggcguccggcgggcgggac

SEQ ID NO: 15744 - RNA, 24 nt, Artificial Sequence
  Synthetic
gucccggcguccggcgggcgggac

SEQ ID NO: 15745 - RNA, 18 nt, Artificial Sequence
  Synthetic
gcgccgggacgccgauac

SEQ ID NO: 15746 - RNA, 19 nt, Artificial Sequence
  Synthetic
cgcgccgggacgccgauac

SEQ ID NO: 15747 - RNA, 20 nt, Artificial Sequence
  Synthetic
ccgcgccgggacgccgauac

SEQ ID NO: 15748 - RNA, 21 nt, Artificial Sequence
  Synthetic
gccgcgccgggacgccgauac

SEQ ID NO: 15749 - RNA, 22 nt, Artificial Sequence
  Synthetic
cgccgcgccgggacgccgauac

SEQ ID NO: 15750 - RNA, 23 nt, Artificial Sequence
  Synthetic
ucgccgcgccgggacgccgauac

SEQ ID NO: 15751 - RNA, 24 nt, Artificial Sequence
  Synthetic
cucgccgcgccgggacgccgauac

SEQ ID NO: 15752 - RNA, 18 nt, Artificial Sequence
  Synthetic
ucucauuaccgccgaacc

SEQ ID NO: 15753 - RNA, 19 nt, Artificial Sequence
  Synthetic
aucucauuaccgccgaacc

SEQ ID NO: 15754 - RNA, 20 nt, Artificial Sequence
  Synthetic
uaucucauuaccgccgaacc

SEQ ID NO: 15755 - RNA, 21 nt, Artificial Sequence
  Synthetic
guaucucauuaccgccgaacc

SEQ ID NO: 15756 - RNA, 22 nt, Artificial Sequence
  Synthetic
cguaucucauuaccgccgaacc

SEQ ID NO: 15757 - RNA, 23 nt, Artificial Sequence
  Synthetic
ucguaucucauuaccgccgaacc

SEQ ID NO: 15758 - RNA, 24 nt, Artificial Sequence
  Synthetic
cucguaucucauuaccgccgaacc

SEQ ID NO: 15759 - RNA, 18 nt, Artificial Sequence
  Synthetic
gacgggccgccgcccacc

SEQ ID NO: 15760 - RNA, 19 nt, Artificial Sequence
  Synthetic
cgacgggccgccgcccacc

SEQ ID NO: 15761 - RNA, 20 nt, Artificial Sequence
  Synthetic
ccgacgggccgccgcccacc

SEQ ID NO: 15762 - RNA, 21 nt, Artificial Sequence
  Synthetic
accgacgggccgccgcccacc

SEQ ID NO: 15763 - RNA, 22 nt, Artificial Sequence
  Synthetic
caccgacgggccgccgcccacc

SEQ ID NO: 15764 - RNA, 23 nt, Artificial Sequence
  Synthetic
ccaccgacgggccgccgcccacc

SEQ ID NO: 15765 - RNA, 24 nt, Artificial Sequence
  Synthetic
cccaccgacgggccgccgcccacc

SEQ ID NO: 15766 - RNA, 18 nt, Artificial Sequence
  Synthetic
cguccggcgggcgggacc

SEQ ID NO: 15767 - RNA, 19 nt, Artificial Sequence
  Synthetic
gcguccggcgggcgggacc

SEQ ID NO: 15768 - RNA, 20 nt, Artificial Sequence
  Synthetic
ggcguccggcgggcgggacc

SEQ ID NO: 15769 - RNA, 21 nt, Artificial Sequence
  Synthetic
cggcguccggcgggcgggacc

SEQ ID NO: 15770 - RNA, 22 nt, Artificial Sequence
  Synthetic
ccggcguccggcgggcgggacc

SEQ ID NO: 15771 - RNA, 23 nt, Artificial Sequence
  Synthetic
cccggcguccggcgggcgggacc

SEQ ID NO: 15772 - RNA, 24 nt, Artificial Sequence
  Synthetic
ucccggcguccggcgggcgggacc

SEQ ID NO: 15773 - RNA, 18 nt, Artificial Sequence
  Synthetic
cuccuucccgccggcccc

SEQ ID NO: 15774 - RNA, 19 nt, Artificial Sequence
  Synthetic
ccuccuucccgccggcccc

SEQ ID NO: 15775 - RNA, 20 nt, Artificial Sequence
  Synthetic
uccuccuucccgccggcccc

SEQ ID NO: 15776 - RNA, 21 nt, Artificial Sequence
  Synthetic
cuccuccuucccgccggcccc

SEQ ID NO: 15777 - RNA, 22 nt, Artificial Sequence
  Synthetic
gcuccuccuucccgccggcccc

SEQ ID NO: 15778 - RNA, 23 nt, Artificial Sequence
  Synthetic
ugcuccuccuucccgccggcccc

SEQ ID NO: 15779 - RNA, 24 nt, Artificial Sequence
  Synthetic
cugcuccuccuucccgccggcccc

SEQ ID NO: 15780 - RNA, 18 nt, Artificial Sequence
  Synthetic
cugggacuauaugagccc

SEQ ID NO: 15781 - RNA, 19 nt, Artificial Sequence
  Synthetic
ccugggacuauaugagccc

SEQ ID NO: 15782 - RNA, 20 nt, Artificial Sequence
  Synthetic
cccugggacuauaugagccc

SEQ ID NO: 15783 - RNA, 21 nt, Artificial Sequence
  Synthetic
ccccugggacuauaugagccc

SEQ ID NO: 15784 - RNA, 22 nt, Artificial Sequence
  Synthetic
gccccugggacuauaugagccc

SEQ ID NO: 15785 - RNA, 23 nt, Artificial Sequence
  Synthetic
ggccccugggacuauaugagccc

SEQ ID NO: 15786 - RNA, 24 nt, Artificial Sequence
  Synthetic
cggccccugggacuauaugagccc

SEQ ID NO: 15787 - RNA, 18 nt, Artificial Sequence
  Synthetic
ccuccuucccgccggccc

SEQ ID NO: 15788 - RNA, 19 nt, Artificial Sequence
  Synthetic
uccuccuucccgccggccc

SEQ ID NO: 15789 - RNA, 20 nt, Artificial Sequence
  Synthetic
cuccuccuucccgccggccc

SEQ ID NO: 15790 - RNA, 21 nt, Artificial Sequence
  Synthetic
gcuccuccuucccgccggccc

SEQ ID NO: 15791 - RNA, 22 nt, Artificial Sequence
  Synthetic
ugcuccuccuucccgccggccc

SEQ ID NO: 15792 - RNA, 23 nt, Artificial Sequence
  Synthetic
cugcuccuccuucccgccggccc

SEQ ID NO: 15793 - RNA, 24 nt, Artificial Sequence
  Synthetic
gcugcuccuccuucccgccggccc

SEQ ID NO: 15794 - RNA, 18 nt, Artificial Sequence
  Synthetic
cggcaaggcgggcggccc

SEQ ID NO: 15795 - RNA, 19 nt, Artificial Sequence
  Synthetic
gcggcaaggcgggcggccc

SEQ ID NO: 15796 - RNA, 20 nt, Artificial Sequence
  Synthetic
ggcggcaaggcgggcggccc

SEQ ID NO: 15797 - RNA, 21 nt, Artificial Sequence
  Synthetic
gggcggcaaggcgggcggccc

SEQ ID NO: 15798 - RNA, 22 nt, Artificial Sequence
  Synthetic
ggggcggcaaggcgggcggccc

SEQ ID NO: 15799 - RNA, 23 nt, Artificial Sequence
  Synthetic
gggggcggcaaggcgggcggccc

SEQ ID NO: 15800 - RNA, 24 nt, Artificial Sequence
  Synthetic
ggggggcggcaaggcgggcggccc

SEQ ID NO: 15801 - RNA, 18 nt, Artificial Sequence
  Synthetic
ggcgggaccggggggccc

SEQ ID NO: 15802 - RNA, 19 nt, Artificial Sequence
  Synthetic
gggcgggaccggggggccc

SEQ ID NO: 15803 - RNA, 20 nt, Artificial Sequence
  Synthetic
cgggcgggaccggggggccc

SEQ ID NO: 15804 - RNA, 21 nt, Artificial Sequence
  Synthetic
gcgggcgggaccggggggccc

SEQ ID NO: 15805 - RNA, 22 nt, Artificial Sequence
  Synthetic
ggcgggcgggaccggggggccc

SEQ ID NO: 15806 - RNA, 23 nt, Artificial Sequence
  Synthetic
cggcgggcgggaccggggggccc

SEQ ID NO: 15807 - RNA, 24 nt, Artificial Sequence
  Synthetic
ccggcgggcgggaccggggggccc

SEQ ID NO: 15808 - RNA, 18 nt, Artificial Sequence
  Synthetic
ccgucgcagccguauccc

SEQ ID NO: 15809 - RNA, 19 nt, Artificial Sequence
  Synthetic
gccgucgcagccguauccc

SEQ ID NO: 15810 - RNA, 20 nt, Artificial Sequence
  Synthetic
cgccgucgcagccguauccc

SEQ ID NO: 15811 - RNA, 21 nt, Artificial Sequence
  Synthetic
ccgccgucgcagccguauccc

SEQ ID NO: 15812 - RNA, 22 nt, Artificial Sequence
  Synthetic
uccgccgucgcagccguauccc

SEQ ID NO: 15813 - RNA, 23 nt, Artificial Sequence
  Synthetic
guccgccgucgcagccguauccc

SEQ ID NO: 15814 - RNA, 24 nt, Artificial Sequence
  Synthetic
cguccgccgucgcagccguauccc

SEQ ID NO: 15815 - RNA, 18 nt, Artificial Sequence
  Synthetic
guucggggugggcccgcc

SEQ ID NO: 15816 - RNA, 19 nt, Artificial Sequence
  Synthetic
cguucggggugggcccgcc

SEQ ID NO: 15817 - RNA, 20 nt, Artificial Sequence
  Synthetic
ccguucggggugggcccgcc

SEQ ID NO: 15818 - RNA, 21 nt, Artificial Sequence
  Synthetic
uccguucggggugggcccgcc

SEQ ID NO: 15819 - RNA, 22 nt, Artificial Sequence
  Synthetic
uuccguucggggugggcccgcc

SEQ ID NO: 15820 - RNA, 23 nt, Artificial Sequence
  Synthetic
auuccguucggggugggcccgcc

SEQ ID NO: 15821 - RNA, 24 nt, Artificial Sequence
  Synthetic
aauuccguucggggugggcccgcc

SEQ ID NO: 15822 - RNA, 18 nt, Artificial Sequence
  Synthetic
gaccaacgggccgcggcc

SEQ ID NO: 15823 - RNA, 19 nt, Artificial Sequence
  Synthetic
cgaccaacgggccgcggcc

SEQ ID NO: 15824 - RNA, 20 nt, Artificial Sequence
  Synthetic
ucgaccaacgggccgcggcc

SEQ ID NO: 15825 - RNA, 21 nt, Artificial Sequence
  Synthetic
uucgaccaacgggccgcggcc

SEQ ID NO: 15826 - RNA, 22 nt, Artificial Sequence
  Synthetic
guucgaccaacgggccgcggcc

SEQ ID NO: 15827 - RNA, 23 nt, Artificial Sequence
  Synthetic
gguucgaccaacgggccgcggcc

SEQ ID NO: 15828 - RNA, 24 nt, Artificial Sequence
  Synthetic
ggguucgaccaacgggccgcggcc

SEQ ID NO: 15829 - RNA, 18 nt, Artificial Sequence
  Synthetic
gggcgggaccggggggcc

SEQ ID NO: 15830 - RNA, 19 nt, Artificial Sequence
  Synthetic
cgggcgggaccggggggcc

SEQ ID NO: 15831 - RNA, 20 nt, Artificial Sequence
  Synthetic
gcgggcgggaccggggggcc

SEQ ID NO: 15832 - RNA, 21 nt, Artificial Sequence
  Synthetic
ggcgggcgggaccggggggcc

SEQ ID NO: 15833 - RNA, 22 nt, Artificial Sequence
  Synthetic
cggcgggcgggaccggggggcc

SEQ ID NO: 15834 - RNA, 23 nt, Artificial Sequence
  Synthetic
ccggcgggcgggaccggggggcc

SEQ ID NO: 15835 - RNA, 24 nt, Artificial Sequence
  Synthetic
uccggcgggcgggaccggggggcc

SEQ ID NO: 15836 - RNA, 18 nt, Artificial Sequence
  Synthetic
gccgucgcagccguaucc

SEQ ID NO: 15837 - RNA, 19 nt, Artificial Sequence
  Synthetic
cgccgucgcagccguaucc

SEQ ID NO: 15838 - RNA, 20 nt, Artificial Sequence
  Synthetic
ccgccgucgcagccguaucc

SEQ ID NO: 15839 - RNA, 21 nt, Artificial Sequence
  Synthetic
uccgccgucgcagccguaucc

SEQ ID NO: 15840 - RNA, 22 nt, Artificial Sequence
  Synthetic
guccgccgucgcagccguaucc

SEQ ID NO: 15841 - RNA, 23 nt, Artificial Sequence
  Synthetic
cguccgccgucgcagccguaucc

SEQ ID NO: 15842 - RNA, 24 nt, Artificial Sequence
  Synthetic
acguccgccgucgcagccguaucc

SEQ ID NO: 15843 - RNA, 18 nt, Artificial Sequence
  Synthetic
aagcagcgccccggcucc

SEQ ID NO: 15844 - RNA, 19 nt, Artificial Sequence
  Synthetic
caagcagcgccccggcucc

SEQ ID NO: 15845 - RNA, 20 nt, Artificial Sequence
  Synthetic
acaagcagcgccccggcucc

SEQ ID NO: 15846 - RNA, 21 nt, Artificial Sequence
  Synthetic
aacaagcagcgccccggcucc

SEQ ID NO: 15847 - RNA, 22 nt, Artificial Sequence
  Synthetic
gaacaagcagcgccccggcucc

SEQ ID NO: 15848 - RNA, 23 nt, Artificial Sequence
  Synthetic
agaacaagcagcgccccggcucc

SEQ ID NO: 15849 - RNA, 24 nt, Artificial Sequence
  Synthetic
gagaacaagcagcgccccggcucc

SEQ ID NO: 15850 - RNA, 18 nt, Artificial Sequence
  Synthetic
ccgauacgcggacgaagc

SEQ ID NO: 15851 - RNA, 19 nt, Artificial Sequence
  Synthetic
gccgauacgcggacgaagc

SEQ ID NO: 15852 - RNA, 20 nt, Artificial Sequence
  Synthetic
cgccgauacgcggacgaagc

SEQ ID NO: 15853 - RNA, 21 nt, Artificial Sequence
  Synthetic
acgccgauacgcggacgaagc

SEQ ID NO: 15854 - RNA, 22 nt, Artificial Sequence
  Synthetic
gacgccgauacgcggacgaagc

SEQ ID NO: 15855 - RNA, 23 nt, Artificial Sequence
  Synthetic
ggacgccgauacgcggacgaagc

SEQ ID NO: 15856 - RNA, 24 nt, Artificial Sequence
  Synthetic
gggacgccgauacgcggacgaagc

SEQ ID NO: 15857 - RNA, 18 nt, Artificial Sequence
  Synthetic
gcccagaccgcgacgagc

SEQ ID NO: 15858 - RNA, 19 nt, Artificial Sequence
  Synthetic
agcccagaccgcgacgagc

SEQ ID NO: 15859 - RNA, 20 nt, Artificial Sequence
  Synthetic
gagcccagaccgcgacgagc

SEQ ID NO: 15860 - RNA, 21 nt, Artificial Sequence
  Synthetic
cgagcccagaccgcgacgagc

SEQ ID NO: 15861 - RNA, 22 nt, Artificial Sequence
  Synthetic
ccgagcccagaccgcgacgagc

SEQ ID NO: 15862 - RNA, 23 nt, Artificial Sequence
  Synthetic
cccgagcccagaccgcgacgagc

SEQ ID NO: 15863 - RNA, 24 nt, Artificial Sequence
  Synthetic
ccccgagcccagaccgcgacgagc

SEQ ID NO: 15864 - RNA, 18 nt, Artificial Sequence
  Synthetic
cccugggacuauaugagc

SEQ ID NO: 15865 - RNA, 19 nt, Artificial Sequence
  Synthetic
ccccugggacuauaugagc

SEQ ID NO: 15866 - RNA, 20 nt, Artificial Sequence
  Synthetic
gccccugggacuauaugagc

SEQ ID NO: 15867 - RNA, 21 nt, Artificial Sequence
  Synthetic
ggccccugggacuauaugagc

SEQ ID NO: 15868 - RNA, 22 nt, Artificial Sequence
  Synthetic
cggccccugggacuauaugagc

SEQ ID NO: 15869 - RNA, 23 nt, Artificial Sequence
  Synthetic
ccggccccugggacuauaugagc

SEQ ID NO: 15870 - RNA, 24 nt, Artificial Sequence
  Synthetic
gccggccccugggacuauaugagc

SEQ ID NO: 15871 - RNA, 18 nt, Artificial Sequence
  Synthetic
gacccgacgcgggaccgc

SEQ ID NO: 15872 - RNA, 19 nt, Artificial Sequence
  Synthetic
cgacccgacgcgggaccgc

SEQ ID NO: 15873 - RNA, 20 nt, Artificial Sequence
  Synthetic
acgacccgacgcgggaccgc

SEQ ID NO: 15874 - RNA, 21 nt, Artificial Sequence
  Synthetic
cacgacccgacgcgggaccgc

SEQ ID NO: 15875 - RNA, 22 nt, Artificial Sequence
  Synthetic
ccacgacccgacgcgggaccgc

SEQ ID NO: 15876 - RNA, 23 nt, Artificial Sequence
  Synthetic
uccacgacccgacgcgggaccgc

SEQ ID NO: 15877 - RNA, 24 nt, Artificial Sequence
  Synthetic
auccacgacccgacgcgggaccgc

SEQ ID NO: 15878 - RNA, 18 nt, Artificial Sequence
  Synthetic
cguucggggugggcccgc

SEQ ID NO: 15879 - RNA, 19 nt, Artificial Sequence
  Synthetic
ccguucggggugggcccgc

SEQ ID NO: 15880 - RNA, 20 nt, Artificial Sequence
  Synthetic
uccguucggggugggcccgc

SEQ ID NO: 15881 - RNA, 21 nt, Artificial Sequence
  Synthetic
uuccguucggggugggcccgc

SEQ ID NO: 15882 - RNA, 22 nt, Artificial Sequence
  Synthetic
auuccguucggggugggcccgc

SEQ ID NO: 15883 - RNA, 23 nt, Artificial Sequence
  Synthetic
aauuccguucggggugggcccgc

SEQ ID NO: 15884 - RNA, 24 nt, Artificial Sequence
  Synthetic
gaauuccguucggggugggcccgc

SEQ ID NO: 15885 - RNA, 18 nt, Artificial Sequence
  Synthetic
gauacgcggacgaagcgc

SEQ ID NO: 15886 - RNA, 19 nt, Artificial Sequence
  Synthetic
cgauacgcggacgaagcgc

SEQ ID NO: 15887 - RNA, 20 nt, Artificial Sequence
  Synthetic
ccgauacgcggacgaagcgc

SEQ ID NO: 15888 - RNA, 21 nt, Artificial Sequence
  Synthetic
gccgauacgcggacgaagcgc

SEQ ID NO: 15889 - RNA, 22 nt, Artificial Sequence
  Synthetic
cgccgauacgcggacgaagcgc

SEQ ID NO: 15890 - RNA, 23 nt, Artificial Sequence
  Synthetic
acgccgauacgcggacgaagcgc

SEQ ID NO: 15891 - RNA, 24 nt, Artificial Sequence
  Synthetic
gacgccgauacgcggacgaagcgc

SEQ ID NO: 15892 - RNA, 18 nt, Artificial Sequence
  Synthetic
gucagacgcucgccgcgc

SEQ ID NO: 15893 - RNA, 19 nt, Artificial Sequence
  Synthetic
cgucagacgcucgccgcgc

SEQ ID NO: 15894 - RNA, 20 nt, Artificial Sequence
  Synthetic
ccgucagacgcucgccgcgc

SEQ ID NO: 15895 - RNA, 21 nt, Artificial Sequence
  Synthetic
accgucagacgcucgccgcgc

SEQ ID NO: 15896 - RNA, 22 nt, Artificial Sequence
  Synthetic
gaccgucagacgcucgccgcgc

SEQ ID NO: 15897 - RNA, 23 nt, Artificial Sequence
  Synthetic
agaccgucagacgcucgccgcgc

SEQ ID NO: 15898 - RNA, 24 nt, Artificial Sequence
  Synthetic
cagaccgucagacgcucgccgcgc

SEQ ID NO: 15899 - RNA, 18 nt, Artificial Sequence
  Synthetic
gggacggccaacgggcgc

SEQ ID NO: 15900 - RNA, 19 nt, Artificial Sequence
  Synthetic
ggggacggccaacgggcgc

SEQ ID NO: 15901 - RNA, 20 nt, Artificial Sequence
  Synthetic
cggggacggccaacgggcgc

SEQ ID NO: 15902 - RNA, 21 nt, Artificial Sequence
  Synthetic
ccggggacggccaacgggcgc

SEQ ID NO: 15903 - RNA, 22 nt, Artificial Sequence
  Synthetic
cccggggacggccaacgggcgc

SEQ ID NO: 15904 - RNA, 23 nt, Artificial Sequence
  Synthetic
gcccggggacggccaacgggcgc

SEQ ID NO: 15905 - RNA, 24 nt, Artificial Sequence
  Synthetic
ggcccggggacggccaacgggcgc

SEQ ID NO: 15906 - RNA, 18 nt, Artificial Sequence
  Synthetic
gcggagacggaggagggc

SEQ ID NO: 15907 - RNA, 19 nt, Artificial Sequence
  Synthetic
cgcggagacggaggagggc

SEQ ID NO: 15908 - RNA, 20 nt, Artificial Sequence
  Synthetic
gcgcggagacggaggagggc

SEQ ID NO: 15909 - RNA, 21 nt, Artificial Sequence
  Synthetic
ggcgcggagacggaggagggc

SEQ ID NO: 15910 - RNA, 22 nt, Artificial Sequence
  Synthetic
gggcgcggagacggaggagggc

SEQ ID NO: 15911 - RNA, 23 nt, Artificial Sequence
  Synthetic
ggggcgcggagacggaggagggc

SEQ ID NO: 15912 - RNA, 24 nt, Artificial Sequence
  Synthetic
uggggcgcggagacggaggagggc

SEQ ID NO: 15913 - RNA, 18 nt, Artificial Sequence
  Synthetic
ugccaugcggggcggggc

SEQ ID NO: 15914 - RNA, 19 nt, Artificial Sequence
  Synthetic
augccaugcggggcggggc

SEQ ID NO: 15915 - RNA, 20 nt, Artificial Sequence
  Synthetic
gaugccaugcggggcggggc

SEQ ID NO: 15916 - RNA, 21 nt, Artificial Sequence
  Synthetic
agaugccaugcggggcggggc

SEQ ID NO: 15917 - RNA, 22 nt, Artificial Sequence
  Synthetic
gagaugccaugcggggcggggc

SEQ ID NO: 15918 - RNA, 23 nt, Artificial Sequence
  Synthetic
ugagaugccaugcggggcggggc

SEQ ID NO: 15919 - RNA, 24 nt, Artificial Sequence
  Synthetic
augagaugccaugcggggcggggc

SEQ ID NO: 15920 - RNA, 18 nt, Artificial Sequence
  Synthetic
ggcgcggaugggcggggc

SEQ ID NO: 15921 - RNA, 19 nt, Artificial Sequence
  Synthetic
uggcgcggaugggcggggc

SEQ ID NO: 15922 - RNA, 20 nt, Artificial Sequence
  Synthetic
auggcgcggaugggcggggc

SEQ ID NO: 15923 - RNA, 21 nt, Artificial Sequence
  Synthetic
gauggcgcggaugggcggggc

SEQ ID NO: 15924 - RNA, 22 nt, Artificial Sequence
  Synthetic
agauggcgcggaugggcggggc

SEQ ID NO: 15925 - RNA, 23 nt, Artificial Sequence
  Synthetic
cagauggcgcggaugggcggggc

SEQ ID NO: 15926 - RNA, 24 nt, Artificial Sequence
  Synthetic
gcagauggcgcggaugggcggggc

SEQ ID NO: 15927 - RNA, 18 nt, Artificial Sequence
  Synthetic
gaaccgggaagucggggc

SEQ ID NO: 15928 - RNA, 19 nt, Artificial Sequence
  Synthetic
cgaaccgggaagucggggc

SEQ ID NO: 15929 - RNA, 20 nt, Artificial Sequence
  Synthetic
ccgaaccgggaagucggggc

SEQ ID NO: 15930 - RNA, 21 nt, Artificial Sequence
  Synthetic
gccgaaccgggaagucggggc

SEQ ID NO: 15931 - RNA, 22 nt, Artificial Sequence
  Synthetic
cgccgaaccgggaagucggggc

SEQ ID NO: 15932 - RNA, 23 nt, Artificial Sequence
  Synthetic
ccgccgaaccgggaagucggggc

SEQ ID NO: 15933 - RNA, 24 nt, Artificial Sequence
  Synthetic
accgccgaaccgggaagucggggc

SEQ ID NO: 15934 - RNA, 18 nt, Artificial Sequence
  Synthetic
cgggcgggaccggggggc

SEQ ID NO: 15935 - RNA, 19 nt, Artificial Sequence
  Synthetic
gcgggcgggaccggggggc

SEQ ID NO: 15936 - RNA, 20 nt, Artificial Sequence
  Synthetic
ggcgggcgggaccggggggc

SEQ ID NO: 15937 - RNA, 21 nt, Artificial Sequence
  Synthetic
cggcgggcgggaccggggggc

SEQ ID NO: 15938 - RNA, 22 nt, Artificial Sequence
  Synthetic
ccggcgggcgggaccggggggc

SEQ ID NO: 15939 - RNA, 23 nt, Artificial Sequence
  Synthetic
uccggcgggcgggaccggggggc

SEQ ID NO: 15940 - RNA, 24 nt, Artificial Sequence
  Synthetic
guccggcgggcgggaccggggggc

SEQ ID NO: 15941 - RNA, 18 nt, Artificial Sequence
  Synthetic
ugggcccgccgggggggc

SEQ ID NO: 15942 - RNA, 19 nt, Artificial Sequence
  Synthetic
gugggcccgccgggggggc

SEQ ID NO: 15943 - RNA, 20 nt, Artificial Sequence
  Synthetic
ggugggcccgccgggggggc

SEQ ID NO: 15944 - RNA, 21 nt, Artificial Sequence
  Synthetic
gggugggcccgccgggggggc

SEQ ID NO: 15945 - RNA, 22 nt, Artificial Sequence
  Synthetic
ggggugggcccgccgggggggc

SEQ ID NO: 15946 - RNA, 23 nt, Artificial Sequence
  Synthetic
cggggugggcccgccgggggggc

SEQ ID NO: 15947 - RNA, 24 nt, Artificial Sequence
  Synthetic
ucggggugggcccgccgggggggc

SEQ ID NO: 15948 - RNA, 18 nt, Artificial Sequence
  Synthetic
ggggcccucggguggggc

SEQ ID NO: 15949 - RNA, 19 nt, Artificial Sequence
  Synthetic
gggggcccucggguggggc

SEQ ID NO: 15950 - RNA, 20 nt, Artificial Sequence
  Synthetic
ggggggcccucggguggggc

SEQ ID NO: 15951 - RNA, 21 nt, Artificial Sequence
  Synthetic
cggggggcccucggguggggc

SEQ ID NO: 15952 - RNA, 22 nt, Artificial Sequence
  Synthetic
gcggggggcccucggguggggc

SEQ ID NO: 15953 - RNA, 23 nt, Artificial Sequence
  Synthetic
agcggggggcccucggguggggc

SEQ ID NO: 15954 - RNA, 24 nt, Artificial Sequence
  Synthetic
gagcggggggcccucggguggggc

SEQ ID NO: 15955 - RNA, 18 nt, Artificial Sequence
  Synthetic
caaugggggggcggcaag

SEQ ID NO: 15956 - RNA, 19 nt, Artificial Sequence
  Synthetic
ccaaugggggggcggcaag

SEQ ID NO: 15957 - RNA, 20 nt, Artificial Sequence
  Synthetic
gccaaugggggggcggcaag

SEQ ID NO: 15958 - RNA, 21 nt, Artificial Sequence
  Synthetic
ggccaaugggggggcggcaag

SEQ ID NO: 15959 - RNA, 22 nt, Artificial Sequence
  Synthetic
cggccaaugggggggcggcaag

SEQ ID NO: 15960 - RNA, 23 nt, Artificial Sequence
  Synthetic
ccggccaaugggggggcggcaag

SEQ ID NO: 15961 - RNA, 24 nt, Artificial Sequence
  Synthetic
gccggccaaugggggggcggcaag

SEQ ID NO: 15962 - RNA, 18 nt, Artificial Sequence
  Synthetic
uagcaugcggaacggaag

SEQ ID NO: 15963 - RNA, 19 nt, Artificial Sequence
  Synthetic
uuagcaugcggaacggaag

SEQ ID NO: 15964 - RNA, 20 nt, Artificial Sequence
  Synthetic
guuagcaugcggaacggaag

SEQ ID NO: 15965 - RNA, 21 nt, Artificial Sequence
  Synthetic
cguuagcaugcggaacggaag

SEQ ID NO: 15966 - RNA, 22 nt, Artificial Sequence
  Synthetic
ucguuagcaugcggaacggaag

SEQ ID NO: 15967 - RNA, 23 nt, Artificial Sequence
  Synthetic
cucguuagcaugcggaacggaag

SEQ ID NO: 15968 - RNA, 24 nt, Artificial Sequence
  Synthetic
ccucguuagcaugcggaacggaag

SEQ ID NO: 15969 - RNA, 18 nt, Artificial Sequence
  Synthetic
uaccgccgaaccgggaag

SEQ ID NO: 15970 - RNA, 19 nt, Artificial Sequence
  Synthetic
uuaccgccgaaccgggaag

SEQ ID NO: 15971 - RNA, 20 nt, Artificial Sequence
  Synthetic
auuaccgccgaaccgggaag

SEQ ID NO: 15972 - RNA, 21 nt, Artificial Sequence
  Synthetic
cauuaccgccgaaccgggaag

SEQ ID NO: 15973 - RNA, 22 nt, Artificial Sequence
  Synthetic
ucauuaccgccgaaccgggaag

SEQ ID NO: 15974 - RNA, 23 nt, Artificial Sequence
  Synthetic
cucauuaccgccgaaccgggaag

SEQ ID NO: 15975 - RNA, 24 nt, Artificial Sequence
  Synthetic
ucucauuaccgccgaaccgggaag

SEQ ID NO: 15976 - RNA, 18 nt, Artificial Sequence
  Synthetic
agcccagaccgcgacgag

SEQ ID NO: 15977 - RNA, 19 nt, Artificial Sequence
  Synthetic
gagcccagaccgcgacgag

SEQ ID NO: 15978 - RNA, 20 nt, Artificial Sequence
  Synthetic
cgagcccagaccgcgacgag

SEQ ID NO: 15979 - RNA, 21 nt, Artificial Sequence
  Synthetic
ccgagcccagaccgcgacgag

SEQ ID NO: 15980 - RNA, 22 nt, Artificial Sequence
  Synthetic
cccgagcccagaccgcgacgag

SEQ ID NO: 15981 - RNA, 23 nt, Artificial Sequence
  Synthetic
ccccgagcccagaccgcgacgag

SEQ ID NO: 15982 - RNA, 24 nt, Artificial Sequence
  Synthetic
accccgagcccagaccgcgacgag

SEQ ID NO: 15983 - RNA, 18 nt, Artificial Sequence
  Synthetic
uggggcgcggagacggag

SEQ ID NO: 15984 - RNA, 19 nt, Artificial Sequence
  Synthetic
guggggcgcggagacggag

SEQ ID NO: 15985 - RNA, 20 nt, Artificial Sequence
  Synthetic
gguggggcgcggagacggag

SEQ ID NO: 15986 - RNA, 21 nt, Artificial Sequence
  Synthetic
ggguggggcgcggagacggag

SEQ ID NO: 15987 - RNA, 22 nt, Artificial Sequence
  Synthetic
cggguggggcgcggagacggag

SEQ ID NO: 15988 - RNA, 23 nt, Artificial Sequence
  Synthetic
ucggguggggcgcggagacggag

SEQ ID NO: 15989 - RNA, 24 nt, Artificial Sequence
  Synthetic
cucggguggggcgcggagacggag

SEQ ID NO: 15990 - RNA, 18 nt, Artificial Sequence
  Synthetic
cucggguggggcgcggag

SEQ ID NO: 15991 - RNA, 19 nt, Artificial Sequence
  Synthetic
ccucggguggggcgcggag

SEQ ID NO: 15992 - RNA, 20 nt, Artificial Sequence
  Synthetic
cccucggguggggcgcggag

SEQ ID NO: 15993 - RNA, 21 nt, Artificial Sequence
  Synthetic
gcccucggguggggcgcggag

SEQ ID NO: 15994 - RNA, 22 nt, Artificial Sequence
  Synthetic
ggcccucggguggggcgcggag

SEQ ID NO: 15995 - RNA, 23 nt, Artificial Sequence
  Synthetic
gggcccucggguggggcgcggag

SEQ ID NO: 15996 - RNA, 24 nt, Artificial Sequence
  Synthetic
ggggcccucggguggggcgcggag

SEQ ID NO: 15997 - RNA, 18 nt, Artificial Sequence
  Synthetic
ggguggggcgcggagacg

SEQ ID NO: 15998 - RNA, 19 nt, Artificial Sequence
  Synthetic
cggguggggcgcggagacg

SEQ ID NO: 15999 - RNA, 20 nt, Artificial Sequence
  Synthetic
ucggguggggcgcggagacg

SEQ ID NO: 16000 - RNA, 21 nt, Artificial Sequence
  Synthetic
cucggguggggcgcggagacg

SEQ ID NO: 16001 - RNA, 22 nt, Artificial Sequence
  Synthetic
ccucggguggggcgcggagacg

SEQ ID NO: 16002 - RNA, 23 nt, Artificial Sequence
  Synthetic
cccucggguggggcgcggagacg

SEQ ID NO: 16003 - RNA, 24 nt, Artificial Sequence
  Synthetic
gcccucggguggggcgcggagacg

SEQ ID NO: 16004 - RNA, 18 nt, Artificial Sequence
  Synthetic
cggauccacgacccgacg

SEQ ID NO: 16005 - RNA, 19 nt, Artificial Sequence
  Synthetic
acggauccacgacccgacg

SEQ ID NO: 16006 - RNA, 20 nt, Artificial Sequence
  Synthetic
cacggauccacgacccgacg

SEQ ID NO: 16007 - RNA, 21 nt, Artificial Sequence
  Synthetic
acacggauccacgacccgacg

SEQ ID NO: 16008 - RNA, 22 nt, Artificial Sequence
  Synthetic
gacacggauccacgacccgacg

SEQ ID NO: 16009 - RNA, 23 nt, Artificial Sequence
  Synthetic
cgacacggauccacgacccgacg

SEQ ID NO: 16010 - RNA, 24 nt, Artificial Sequence
  Synthetic
ccgacacggauccacgacccgacg

SEQ ID NO: 16011 - RNA, 18 nt, Artificial Sequence
  Synthetic
gcuaguuccgcgucgacg

SEQ ID NO: 16012 - RNA, 19 nt, Artificial Sequence
  Synthetic
cgcuaguuccgcgucgacg

SEQ ID NO: 16013 - RNA, 20 nt, Artificial Sequence
  Synthetic
gcgcuaguuccgcgucgacg

SEQ ID NO: 16014 - RNA, 21 nt, Artificial Sequence
  Synthetic
cgcgcuaguuccgcgucgacg

SEQ ID NO: 16015 - RNA, 22 nt, Artificial Sequence
  Synthetic
ccgcgcuaguuccgcgucgacg

SEQ ID NO: 16016 - RNA, 23 nt, Artificial Sequence
  Synthetic
uccgcgcuaguuccgcgucgacg

SEQ ID NO: 16017 - RNA, 24 nt, Artificial Sequence
  Synthetic
guccgcgcuaguuccgcgucgacg

SEQ ID NO: 16018 - RNA, 18 nt, Artificial Sequence
  Synthetic
gcuccccgggccccaccg

SEQ ID NO: 16019 - RNA, 19 nt, Artificial Sequence
  Synthetic
ggcuccccgggccccaccg

SEQ ID NO: 16020 - RNA, 20 nt, Artificial Sequence
  Synthetic
cggcuccccgggccccaccg

SEQ ID NO: 16021 - RNA, 21 nt, Artificial Sequence
  Synthetic
ccggcuccccgggccccaccg

SEQ ID NO: 16022 - RNA, 22 nt, Artificial Sequence
  Synthetic
cccggcuccccgggccccaccg

SEQ ID NO: 16023 - RNA, 23 nt, Artificial Sequence
  Synthetic
ccccggcuccccgggccccaccg

SEQ ID NO: 16024 - RNA, 24 nt, Artificial Sequence
  Synthetic
gccccggcuccccgggccccaccg

SEQ ID NO: 16025 - RNA, 18 nt, Artificial Sequence
  Synthetic
guccggcgggcgggaccg

SEQ ID NO: 16026 - RNA, 19 nt, Artificial Sequence
  Synthetic
cguccggcgggcgggaccg

SEQ ID NO: 16027 - RNA, 20 nt, Artificial Sequence
  Synthetic
gcguccggcgggcgggaccg

SEQ ID NO: 16028 - RNA, 21 nt, Artificial Sequence
  Synthetic
ggcguccggcgggcgggaccg

SEQ ID NO: 16029 - RNA, 22 nt, Artificial Sequence
  Synthetic
cggcguccggcgggcgggaccg

SEQ ID NO: 16030 - RNA, 23 nt, Artificial Sequence
  Synthetic
ccggcguccggcgggcgggaccg

SEQ ID NO: 16031 - RNA, 24 nt, Artificial Sequence
  Synthetic
cccggcguccggcgggcgggaccg

SEQ ID NO: 16032 - RNA, 18 nt, Artificial Sequence
  Synthetic
gcucguaucucauuaccg

SEQ ID NO: 16033 - RNA, 19 nt, Artificial Sequence
  Synthetic
ggcucguaucucauuaccg

SEQ ID NO: 16034 - RNA, 20 nt, Artificial Sequence
  Synthetic
gggcucguaucucauuaccg

SEQ ID NO: 16035 - RNA, 21 nt, Artificial Sequence
  Synthetic
ggggcucguaucucauuaccg

SEQ ID NO: 16036 - RNA, 22 nt, Artificial Sequence
  Synthetic
cggggcucguaucucauuaccg

SEQ ID NO: 16037 - RNA, 23 nt, Artificial Sequence
  Synthetic
gcggggcucguaucucauuaccg

SEQ ID NO: 16038 - RNA, 24 nt, Artificial Sequence
  Synthetic
cgcggggcucguaucucauuaccg

SEQ ID NO: 16039 - RNA, 18 nt, Artificial Sequence
  Synthetic
cgaccucgacgacgcccg

SEQ ID NO: 16040 - RNA, 19 nt, Artificial Sequence
  Synthetic
acgaccucgacgacgcccg

SEQ ID NO: 16041 - RNA, 20 nt, Artificial Sequence
  Synthetic
cacgaccucgacgacgcccg

SEQ ID NO: 16042 - RNA, 21 nt, Artificial Sequence
  Synthetic
ccacgaccucgacgacgcccg

SEQ ID NO: 16043 - RNA, 22 nt, Artificial Sequence
  Synthetic
cccacgaccucgacgacgcccg

SEQ ID NO: 16044 - RNA, 23 nt, Artificial Sequence
  Synthetic
ccccacgaccucgacgacgcccg

SEQ ID NO: 16045 - RNA, 24 nt, Artificial Sequence
  Synthetic
cccccacgaccucgacgacgcccg

SEQ ID NO: 16046 - RNA, 18 nt, Artificial Sequence
  Synthetic
ccguucggggugggcccg

SEQ ID NO: 16047 - RNA, 19 nt, Artificial Sequence
  Synthetic
uccguucggggugggcccg

SEQ ID NO: 16048 - RNA, 20 nt, Artificial Sequence
  Synthetic
uuccguucggggugggcccg

SEQ ID NO: 16049 - RNA, 21 nt, Artificial Sequence
  Synthetic
auuccguucggggugggcccg

SEQ ID NO: 16050 - RNA, 22 nt, Artificial Sequence
  Synthetic
aauuccguucggggugggcccg

SEQ ID NO: 16051 - RNA, 23 nt, Artificial Sequence
  Synthetic
gaauuccguucggggugggcccg

SEQ ID NO: 16052 - RNA, 24 nt, Artificial Sequence
  Synthetic
ggaauuccguucggggugggcccg

SEQ ID NO: 16053 - RNA, 18 nt, Artificial Sequence
  Synthetic
uucggggugggcccgccg

SEQ ID NO: 16054 - RNA, 19 nt, Artificial Sequence
  Synthetic
guucggggugggcccgccg

SEQ ID NO: 16055 - RNA, 20 nt, Artificial Sequence
  Synthetic
cguucggggugggcccgccg

SEQ ID NO: 16056 - RNA, 21 nt, Artificial Sequence
  Synthetic
ccguucggggugggcccgccg

SEQ ID NO: 16057 - RNA, 22 nt, Artificial Sequence
  Synthetic
uccguucggggugggcccgccg

SEQ ID NO: 16058 - RNA, 23 nt, Artificial Sequence
  Synthetic
uuccguucggggugggcccgccg

SEQ ID NO: 16059 - RNA, 24 nt, Artificial Sequence
  Synthetic
auuccguucggggugggcccgccg

SEQ ID NO: 16060 - RNA, 18 nt, Artificial Sequence
  Synthetic
cguuggucccggcguccg

SEQ ID NO: 16061 - RNA, 19 nt, Artificial Sequence
  Synthetic
ccguuggucccggcguccg

SEQ ID NO: 16062 - RNA, 20 nt, Artificial Sequence
  Synthetic
cccguuggucccggcguccg

SEQ ID NO: 16063 - RNA, 21 nt, Artificial Sequence
  Synthetic
ucccguuggucccggcguccg

SEQ ID NO: 16064 - RNA, 22 nt, Artificial Sequence
  Synthetic
gucccguuggucccggcguccg

SEQ ID NO: 16065 - RNA, 23 nt, Artificial Sequence
  Synthetic
cgucccguuggucccggcguccg

SEQ ID NO: 16066 - RNA, 24 nt, Artificial Sequence
  Synthetic
ccgucccguuggucccggcguccg

SEQ ID NO: 16067 - RNA, 18 nt, Artificial Sequence
  Synthetic
cgauacgcggacgaagcg

SEQ ID NO: 16068 - RNA, 19 nt, Artificial Sequence
  Synthetic
ccgauacgcggacgaagcg

SEQ ID NO: 16069 - RNA, 20 nt, Artificial Sequence
  Synthetic
gccgauacgcggacgaagcg

SEQ ID NO: 16070 - RNA, 21 nt, Artificial Sequence
  Synthetic
cgccgauacgcggacgaagcg

SEQ ID NO: 16071 - RNA, 22 nt, Artificial Sequence
  Synthetic
acgccgauacgcggacgaagcg

SEQ ID NO: 16072 - RNA, 23 nt, Artificial Sequence
  Synthetic
gacgccgauacgcggacgaagcg

SEQ ID NO: 16073 - RNA, 24 nt, Artificial Sequence
  Synthetic
ggacgccgauacgcggacgaagcg

SEQ ID NO: 16074 - RNA, 18 nt, Artificial Sequence
  Synthetic
cccagaccgcgacgagcg

SEQ ID NO: 16075 - RNA, 19 nt, Artificial Sequence
  Synthetic
gcccagaccgcgacgagcg

SEQ ID NO: 16076 - RNA, 20 nt, Artificial Sequence
  Synthetic
agcccagaccgcgacgagcg

SEQ ID NO: 16077 - RNA, 21 nt, Artificial Sequence
  Synthetic
gagcccagaccgcgacgagcg

SEQ ID NO: 16078 - RNA, 22 nt, Artificial Sequence
  Synthetic
cgagcccagaccgcgacgagcg

SEQ ID NO: 16079 - RNA, 23 nt, Artificial Sequence
  Synthetic
ccgagcccagaccgcgacgagcg

SEQ ID NO: 16080 - RNA, 24 nt, Artificial Sequence
  Synthetic
cccgagcccagaccgcgacgagcg

SEQ ID NO: 16081 - RNA, 18 nt, Artificial Sequence
  Synthetic
ccccgagcccagaccgcg

SEQ ID NO: 16082 - RNA, 19 nt, Artificial Sequence
  Synthetic
accccgagcccagaccgcg

SEQ ID NO: 16083 - RNA, 20 nt, Artificial Sequence
  Synthetic
caccccgagcccagaccgcg

SEQ ID NO: 16084 - RNA, 21 nt, Artificial Sequence
  Synthetic
ccaccccgagcccagaccgcg

SEQ ID NO: 16085 - RNA, 22 nt, Artificial Sequence
  Synthetic
cccaccccgagcccagaccgcg

SEQ ID NO: 16086 - RNA, 23 nt, Artificial Sequence
  Synthetic
gcccaccccgagcccagaccgcg

SEQ ID NO: 16087 - RNA, 24 nt, Artificial Sequence
  Synthetic
cgcccaccccgagcccagaccgcg

SEQ ID NO: 16088 - RNA, 18 nt, Artificial Sequence
  Synthetic
cgucagacgcucgccgcg

SEQ ID NO: 16089 - RNA, 19 nt, Artificial Sequence
  Synthetic
ccgucagacgcucgccgcg

SEQ ID NO: 16090 - RNA, 20 nt, Artificial Sequence
  Synthetic
accgucagacgcucgccgcg

SEQ ID NO: 16091 - RNA, 21 nt, Artificial Sequence
  Synthetic
gaccgucagacgcucgccgcg

SEQ ID NO: 16092 - RNA, 22 nt, Artificial Sequence
  Synthetic
agaccgucagacgcucgccgcg

SEQ ID NO: 16093 - RNA, 23 nt, Artificial Sequence
  Synthetic
cagaccgucagacgcucgccgcg

SEQ ID NO: 16094 - RNA, 24 nt, Artificial Sequence
  Synthetic
acagaccgucagacgcucgccgcg

SEQ ID NO: 16095 - RNA, 18 nt, Artificial Sequence
  Synthetic
ggacggccaacgggcgcg

SEQ ID NO: 16096 - RNA, 19 nt, Artificial Sequence
  Synthetic
gggacggccaacgggcgcg

SEQ ID NO: 16097 - RNA, 20 nt, Artificial Sequence
  Synthetic
ggggacggccaacgggcgcg

SEQ ID NO: 16098 - RNA, 21 nt, Artificial Sequence
  Synthetic
cggggacggccaacgggcgcg

SEQ ID NO: 16099 - RNA, 22 nt, Artificial Sequence
  Synthetic
ccggggacggccaacgggcgcg

SEQ ID NO: 16100 - RNA, 23 nt, Artificial Sequence
  Synthetic
cccggggacggccaacgggcgcg

SEQ ID NO: 16101 - RNA, 24 nt, Artificial Sequence
  Synthetic
gcccggggacggccaacgggcgcg

SEQ ID NO: 16102 - RNA, 18 nt, Artificial Sequence
  Synthetic
gcccccggcgugccggcg

SEQ ID NO: 16103 - RNA, 19 nt, Artificial Sequence
  Synthetic
ggcccccggcgugccggcg

SEQ ID NO: 16104 - RNA, 20 nt, Artificial Sequence
  Synthetic
gggcccccggcgugccggcg

SEQ ID NO: 16105 - RNA, 21 nt, Artificial Sequence
  Synthetic
cgggcccccggcgugccggcg

SEQ ID NO: 16106 - RNA, 22 nt, Artificial Sequence
  Synthetic
acgggcccccggcgugccggcg

SEQ ID NO: 16107 - RNA, 23 nt, Artificial Sequence
  Synthetic
cacgggcccccggcgugccggcg

SEQ ID NO: 16108 - RNA, 24 nt, Artificial Sequence
  Synthetic
ccacgggcccccggcgugccggcg

SEQ ID NO: 16109 - RNA, 18 nt, Artificial Sequence
  Synthetic
gggcccgccgggggggcg

SEQ ID NO: 16110 - RNA, 19 nt, Artificial Sequence
  Synthetic
ugggcccgccgggggggcg

SEQ ID NO: 16111 - RNA, 20 nt, Artificial Sequence
  Synthetic
gugggcccgccgggggggcg

SEQ ID NO: 16112 - RNA, 21 nt, Artificial Sequence
  Synthetic
ggugggcccgccgggggggcg

SEQ ID NO: 16113 - RNA, 22 nt, Artificial Sequence
  Synthetic
gggugggcccgccgggggggcg

SEQ ID NO: 16114 - RNA, 23 nt, Artificial Sequence
  Synthetic
ggggugggcccgccgggggggcg

SEQ ID NO: 16115 - RNA, 24 nt, Artificial Sequence
  Synthetic
cggggugggcccgccgggggggcg

SEQ ID NO: 16116 - RNA, 18 nt, Artificial Sequence
  Synthetic
gggcccucggguggggcg

SEQ ID NO: 16117 - RNA, 19 nt, Artificial Sequence
  Synthetic
ggggcccucggguggggcg

SEQ ID NO: 16118 - RNA, 20 nt, Artificial Sequence
  Synthetic
gggggcccucggguggggcg

SEQ ID NO: 16119 - RNA, 21 nt, Artificial Sequence
  Synthetic
ggggggcccucggguggggcg

SEQ ID NO: 16120 - RNA, 22 nt, Artificial Sequence
  Synthetic
cggggggcccucggguggggcg

SEQ ID NO: 16121 - RNA, 23 nt, Artificial Sequence
  Synthetic
gcggggggcccucggguggggcg

SEQ ID NO: 16122 - RNA, 24 nt, Artificial Sequence
  Synthetic
agcggggggcccucggguggggcg

SEQ ID NO: 16123 - RNA, 18 nt, Artificial Sequence
  Synthetic
cccgcaucggcgauggcg

SEQ ID NO: 16124 - RNA, 19 nt, Artificial Sequence
  Synthetic
ccccgcaucggcgauggcg

SEQ ID NO: 16125 - RNA, 20 nt, Artificial Sequence
  Synthetic
gccccgcaucggcgauggcg

SEQ ID NO: 16126 - RNA, 21 nt, Artificial Sequence
  Synthetic
cgccccgcaucggcgauggcg

SEQ ID NO: 16127 - RNA, 22 nt, Artificial Sequence
  Synthetic
ucgccccgcaucggcgauggcg

SEQ ID NO: 16128 - RNA, 23 nt, Artificial Sequence
  Synthetic
aucgccccgcaucggcgauggcg

SEQ ID NO: 16129 - RNA, 24 nt, Artificial Sequence
  Synthetic
gaucgccccgcaucggcgauggcg

SEQ ID NO: 16130 - RNA, 18 nt, Artificial Sequence
  Synthetic
gcaucggcgauggcgucg

SEQ ID NO: 16131 - RNA, 19 nt, Artificial Sequence
  Synthetic
cgcaucggcgauggcgucg

SEQ ID NO: 16132 - RNA, 20 nt, Artificial Sequence
  Synthetic
ccgcaucggcgauggcgucg

SEQ ID NO: 16133 - RNA, 21 nt, Artificial Sequence
  Synthetic
cccgcaucggcgauggcgucg

SEQ ID NO: 16134 - RNA, 22 nt, Artificial Sequence
  Synthetic
ccccgcaucggcgauggcgucg

SEQ ID NO: 16135 - RNA, 23 nt, Artificial Sequence
  Synthetic
gccccgcaucggcgauggcgucg

SEQ ID NO: 16136 - RNA, 24 nt, Artificial Sequence
  Synthetic
cgccccgcaucggcgauggcgucg

SEQ ID NO: 16137 - RNA, 18 nt, Artificial Sequence
  Synthetic
cgucgacggcgggggucg

SEQ ID NO: 16138 - RNA, 19 nt, Artificial Sequence
  Synthetic
gcgucgacggcgggggucg

SEQ ID NO: 16139 - RNA, 20 nt, Artificial Sequence
  Synthetic
cgcgucgacggcgggggucg

SEQ ID NO: 16140 - RNA, 21 nt, Artificial Sequence
  Synthetic
ccgcgucgacggcgggggucg

SEQ ID NO: 16141 - RNA, 22 nt, Artificial Sequence
  Synthetic
uccgcgucgacggcgggggucg

SEQ ID NO: 16142 - RNA, 23 nt, Artificial Sequence
  Synthetic
uuccgcgucgacggcgggggucg

SEQ ID NO: 16143 - RNA, 24 nt, Artificial Sequence
  Synthetic
guuccgcgucgacggcgggggucg

SEQ ID NO: 16144 - RNA, 18 nt, Artificial Sequence
  Synthetic
gcgcggagacggaggagg

SEQ ID NO: 16145 - RNA, 19 nt, Artificial Sequence
  Synthetic
ggcgcggagacggaggagg

SEQ ID NO: 16146 - RNA, 20 nt, Artificial Sequence
  Synthetic
gggcgcggagacggaggagg

SEQ ID NO: 16147 - RNA, 21 nt, Artificial Sequence
  Synthetic
ggggcgcggagacggaggagg

SEQ ID NO: 16148 - RNA, 22 nt, Artificial Sequence
  Synthetic
uggggcgcggagacggaggagg

SEQ ID NO: 16149 - RNA, 23 nt, Artificial Sequence
  Synthetic
guggggcgcggagacggaggagg

SEQ ID NO: 16150 - RNA, 24 nt, Artificial Sequence
  Synthetic
gguggggcgcggagacggaggagg

SEQ ID NO: 16151 - RNA, 18 nt, Artificial Sequence
  Synthetic
gguggggcgcggagacgg

SEQ ID NO: 16152 - RNA, 19 nt, Artificial Sequence
  Synthetic
ggguggggcgcggagacgg

SEQ ID NO: 16153 - RNA, 20 nt, Artificial Sequence
  Synthetic
cggguggggcgcggagacgg

SEQ ID NO: 16154 - RNA, 21 nt, Artificial Sequence
  Synthetic
ucggguggggcgcggagacgg

SEQ ID NO: 16155 - RNA, 22 nt, Artificial Sequence
  Synthetic
cucggguggggcgcggagacgg

SEQ ID NO: 16156 - RNA, 23 nt, Artificial Sequence
  Synthetic
ccucggguggggcgcggagacgg

SEQ ID NO: 16157 - RNA, 24 nt, Artificial Sequence
  Synthetic
cccucggguggggcgcggagacgg

SEQ ID NO: 16158 - RNA, 18 nt, Artificial Sequence
  Synthetic
cuaguuccgcgucgacgg

SEQ ID NO: 16159 - RNA, 19 nt, Artificial Sequence
  Synthetic
gcuaguuccgcgucgacgg

SEQ ID NO: 16160 - RNA, 20 nt, Artificial Sequence
  Synthetic
cgcuaguuccgcgucgacgg

SEQ ID NO: 16161 - RNA, 21 nt, Artificial Sequence
  Synthetic
gcgcuaguuccgcgucgacgg

SEQ ID NO: 16162 - RNA, 22 nt, Artificial Sequence
  Synthetic
cgcgcuaguuccgcgucgacgg

SEQ ID NO: 16163 - RNA, 23 nt, Artificial Sequence
  Synthetic
ccgcgcuaguuccgcgucgacgg

SEQ ID NO: 16164 - RNA, 24 nt, Artificial Sequence
  Synthetic
uccgcgcuaguuccgcgucgacgg

SEQ ID NO: 16165 - RNA, 18 nt, Artificial Sequence
  Synthetic
cgacgcccggcgggacgg

SEQ ID NO: 16166 - RNA, 19 nt, Artificial Sequence
  Synthetic
acgacgcccggcgggacgg

SEQ ID NO: 16167 - RNA, 20 nt, Artificial Sequence
  Synthetic
gacgacgcccggcgggacgg

SEQ ID NO: 16168 - RNA, 21 nt, Artificial Sequence
  Synthetic
cgacgacgcccggcgggacgg

SEQ ID NO: 16169 - RNA, 22 nt, Artificial Sequence
  Synthetic
ucgacgacgcccggcgggacgg

SEQ ID NO: 16170 - RNA, 23 nt, Artificial Sequence
  Synthetic
cucgacgacgcccggcgggacgg

SEQ ID NO: 16171 - RNA, 24 nt, Artificial Sequence
  Synthetic
ccucgacgacgcccggcgggacgg

SEQ ID NO: 16172 - RNA, 18 nt, Artificial Sequence
  Synthetic
gaccucgacgacgcccgg

SEQ ID NO: 16173 - RNA, 19 nt, Artificial Sequence
  Synthetic
cgaccucgacgacgcccgg

SEQ ID NO: 16174 - RNA, 20 nt, Artificial Sequence
  Synthetic
acgaccucgacgacgcccgg

SEQ ID NO: 16175 - RNA, 21 nt, Artificial Sequence
  Synthetic
cacgaccucgacgacgcccgg

SEQ ID NO: 16176 - RNA, 22 nt, Artificial Sequence
  Synthetic
ccacgaccucgacgacgcccgg

SEQ ID NO: 16177 - RNA, 23 nt, Artificial Sequence
  Synthetic
cccacgaccucgacgacgcccgg

SEQ ID NO: 16178 - RNA, 24 nt, Artificial Sequence
  Synthetic
ccccacgaccucgacgacgcccgg

SEQ ID NO: 16179 - RNA, 18 nt, Artificial Sequence
  Synthetic
ucggggugggcccgccgg

SEQ ID NO: 16180 - RNA, 19 nt, Artificial Sequence
  Synthetic
uucggggugggcccgccgg

SEQ ID NO: 16181 - RNA, 20 nt, Artificial Sequence
  Synthetic
guucggggugggcccgccgg

SEQ ID NO: 16182 - RNA, 21 nt, Artificial Sequence
  Synthetic
cguucggggugggcccgccgg

SEQ ID NO: 16183 - RNA, 22 nt, Artificial Sequence
  Synthetic
ccguucggggugggcccgccgg

SEQ ID NO: 16184 - RNA, 23 nt, Artificial Sequence
  Synthetic
uccguucggggugggcccgccgg

SEQ ID NO: 16185 - RNA, 24 nt, Artificial Sequence
  Synthetic
uuccguucggggugggcccgccgg

SEQ ID NO: 16186 - RNA, 18 nt, Artificial Sequence
  Synthetic
cgggacgccgauacgcgg

SEQ ID NO: 16187 - RNA, 19 nt, Artificial Sequence
  Synthetic
ccgggacgccgauacgcgg

SEQ ID NO: 16188 - RNA, 20 nt, Artificial Sequence
  Synthetic
gccgggacgccgauacgcgg

SEQ ID NO: 16189 - RNA, 21 nt, Artificial Sequence
  Synthetic
cgccgggacgccgauacgcgg

SEQ ID NO: 16190 - RNA, 22 nt, Artificial Sequence
  Synthetic
gcgccgggacgccgauacgcgg

SEQ ID NO: 16191 - RNA, 23 nt, Artificial Sequence
  Synthetic
cgcgccgggacgccgauacgcgg

SEQ ID NO: 16192 - RNA, 24 nt, Artificial Sequence
  Synthetic
ccgcgccgggacgccgauacgcgg

SEQ ID NO: 16193 - RNA, 18 nt, Artificial Sequence
  Synthetic
uacgcggacgaagcgcgg

SEQ ID NO: 16194 - RNA, 19 nt, Artificial Sequence
  Synthetic
auacgcggacgaagcgcgg

SEQ ID NO: 16195 - RNA, 20 nt, Artificial Sequence
  Synthetic
gauacgcggacgaagcgcgg

SEQ ID NO: 16196 - RNA, 21 nt, Artificial Sequence
  Synthetic
cgauacgcggacgaagcgcgg

SEQ ID NO: 16197 - RNA, 22 nt, Artificial Sequence
  Synthetic
ccgauacgcggacgaagcgcgg

SEQ ID NO: 16198 - RNA, 23 nt, Artificial Sequence
  Synthetic
gccgauacgcggacgaagcgcgg

SEQ ID NO: 16199 - RNA, 24 nt, Artificial Sequence
  Synthetic
cgccgauacgcggacgaagcgcgg

SEQ ID NO: 16200 - RNA, 18 nt, Artificial Sequence
  Synthetic
ccauggcagauggcgcgg

SEQ ID NO: 16201 - RNA, 19 nt, Artificial Sequence
  Synthetic
cccauggcagauggcgcgg

SEQ ID NO: 16202 - RNA, 20 nt, Artificial Sequence
  Synthetic
gcccauggcagauggcgcgg

SEQ ID NO: 16203 - RNA, 21 nt, Artificial Sequence
  Synthetic
cgcccauggcagauggcgcgg

SEQ ID NO: 16204 - RNA, 22 nt, Artificial Sequence
  Synthetic
ccgcccauggcagauggcgcgg

SEQ ID NO: 16205 - RNA, 23 nt, Artificial Sequence
  Synthetic
cccgcccauggcagauggcgcgg

SEQ ID NO: 16206 - RNA, 24 nt, Artificial Sequence
  Synthetic
ccccgcccauggcagauggcgcgg

SEQ ID NO: 16207 - RNA, 18 nt, Artificial Sequence
  Synthetic
ggucccggcguccggcgg

SEQ ID NO: 16208 - RNA, 19 nt, Artificial Sequence
  Synthetic
uggucccggcguccggcgg

SEQ ID NO: 16209 - RNA, 20 nt, Artificial Sequence
  Synthetic
uuggucccggcguccggcgg

SEQ ID NO: 16210 - RNA, 21 nt, Artificial Sequence
  Synthetic
guuggucccggcguccggcgg

SEQ ID NO: 16211 - RNA, 22 nt, Artificial Sequence
  Synthetic
cguuggucccggcguccggcgg

SEQ ID NO: 16212 - RNA, 23 nt, Artificial Sequence
  Synthetic
ccguuggucccggcguccggcgg

SEQ ID NO: 16213 - RNA, 24 nt, Artificial Sequence
  Synthetic
cccguuggucccggcguccggcgg

SEQ ID NO: 16214 - RNA, 18 nt, Artificial Sequence
  Synthetic
cgagcggggggcccucgg

SEQ ID NO: 16215 - RNA, 19 nt, Artificial Sequence
  Synthetic
acgagcggggggcccucgg

SEQ ID NO: 16216 - RNA, 20 nt, Artificial Sequence
  Synthetic
gacgagcggggggcccucgg

SEQ ID NO: 16217 - RNA, 21 nt, Artificial Sequence
  Synthetic
cgacgagcggggggcccucgg

SEQ ID NO: 16218 - RNA, 22 nt, Artificial Sequence
  Synthetic
gcgacgagcggggggcccucgg

SEQ ID NO: 16219 - RNA, 23 nt, Artificial Sequence
  Synthetic
cgcgacgagcggggggcccucgg

SEQ ID NO: 16220 - RNA, 24 nt, Artificial Sequence
  Synthetic
ccgcgacgagcggggggcccucgg

SEQ ID NO: 16221 - RNA, 18 nt, Artificial Sequence
  Synthetic
cgcggagacggaggaggg

SEQ ID NO: 16222 - RNA, 19 nt, Artificial Sequence
  Synthetic
gcgcggagacggaggaggg

SEQ ID NO: 16223 - RNA, 20 nt, Artificial Sequence
  Synthetic
ggcgcggagacggaggaggg

SEQ ID NO: 16224 - RNA, 21 nt, Artificial Sequence
  Synthetic
gggcgcggagacggaggaggg

SEQ ID NO: 16225 - RNA, 22 nt, Artificial Sequence
  Synthetic
ggggcgcggagacggaggaggg

SEQ ID NO: 16226 - RNA, 23 nt, Artificial Sequence
  Synthetic
uggggcgcggagacggaggaggg

SEQ ID NO: 16227 - RNA, 24 nt, Artificial Sequence
  Synthetic
guggggcgcggagacggaggaggg

SEQ ID NO: 16228 - RNA, 18 nt, Artificial Sequence
  Synthetic
acgcggacgaagcgcggg

SEQ ID NO: 16229 - RNA, 19 nt, Artificial Sequence
  Synthetic
uacgcggacgaagcgcggg

SEQ ID NO: 16230 - RNA, 20 nt, Artificial Sequence
  Synthetic
auacgcggacgaagcgcggg

SEQ ID NO: 16231 - RNA, 21 nt, Artificial Sequence
  Synthetic
gauacgcggacgaagcgcggg

SEQ ID NO: 16232 - RNA, 22 nt, Artificial Sequence
  Synthetic
cgauacgcggacgaagcgcggg

SEQ ID NO: 16233 - RNA, 23 nt, Artificial Sequence
  Synthetic
ccgauacgcggacgaagcgcggg

SEQ ID NO: 16234 - RNA, 24 nt, Artificial Sequence
  Synthetic
gccgauacgcggacgaagcgcggg

SEQ ID NO: 16235 - RNA, 18 nt, Artificial Sequence
  Synthetic
ucgacgacgcccggcggg

SEQ ID NO: 16236 - RNA, 19 nt, Artificial Sequence
  Synthetic
cucgacgacgcccggcggg

SEQ ID NO: 16237 - RNA, 20 nt, Artificial Sequence
  Synthetic
ccucgacgacgcccggcggg

SEQ ID NO: 16238 - RNA, 21 nt, Artificial Sequence
  Synthetic
accucgacgacgcccggcggg

SEQ ID NO: 16239 - RNA, 22 nt, Artificial Sequence
  Synthetic
gaccucgacgacgcccggcggg

SEQ ID NO: 16240 - RNA, 23 nt, Artificial Sequence
  Synthetic
cgaccucgacgacgcccggcggg

SEQ ID NO: 16241 - RNA, 24 nt, Artificial Sequence
  Synthetic
acgaccucgacgacgcccggcggg

SEQ ID NO: 16242 - RNA, 18 nt, Artificial Sequence
  Synthetic
gucccggcguccggcggg

SEQ ID NO: 16243 - RNA, 19 nt, Artificial Sequence
  Synthetic
ggucccggcguccggcggg

SEQ ID NO: 16244 - RNA, 20 nt, Artificial Sequence
  Synthetic
uggucccggcguccggcggg

SEQ ID NO: 16245 - RNA, 21 nt, Artificial Sequence
  Synthetic
uuggucccggcguccggcggg

SEQ ID NO: 16246 - RNA, 22 nt, Artificial Sequence
  Synthetic
guuggucccggcguccggcggg

SEQ ID NO: 16247 - RNA, 23 nt, Artificial Sequence
  Synthetic
cguuggucccggcguccggcggg

SEQ ID NO: 16248 - RNA, 24 nt, Artificial Sequence
  Synthetic
ccguuggucccggcguccggcggg

SEQ ID NO: 16249 - RNA, 18 nt, Artificial Sequence
  Synthetic
aaugagaugccaugcggg

SEQ ID NO: 16250 - RNA, 19 nt, Artificial Sequence
  Synthetic
uaaugagaugccaugcggg

SEQ ID NO: 16251 - RNA, 20 nt, Artificial Sequence
  Synthetic
guaaugagaugccaugcggg

SEQ ID NO: 16252 - RNA, 21 nt, Artificial Sequence
  Synthetic
gguaaugagaugccaugcggg

SEQ ID NO: 16253 - RNA, 22 nt, Artificial Sequence
  Synthetic
cgguaaugagaugccaugcggg

SEQ ID NO: 16254 - RNA, 23 nt, Artificial Sequence
  Synthetic
gcgguaaugagaugccaugcggg

SEQ ID NO: 16255 - RNA, 24 nt, Artificial Sequence
  Synthetic
ggcgguaaugagaugccaugcggg

SEQ ID NO: 16256 - RNA, 18 nt, Artificial Sequence
  Synthetic
gagcggggggcccucggg

SEQ ID NO: 16257 - RNA, 19 nt, Artificial Sequence
  Synthetic
cgagcggggggcccucggg

SEQ ID NO: 16258 - RNA, 20 nt, Artificial Sequence
  Synthetic
acgagcggggggcccucggg

SEQ ID NO: 16259 - RNA, 21 nt, Artificial Sequence
  Synthetic
gacgagcggggggcccucggg

SEQ ID NO: 16260 - RNA, 22 nt, Artificial Sequence
  Synthetic
cgacgagcggggggcccucggg

SEQ ID NO: 16261 - RNA, 23 nt, Artificial Sequence
  Synthetic
gcgacgagcggggggcccucggg

SEQ ID NO: 16262 - RNA, 24 nt, Artificial Sequence
  Synthetic
cgcgacgagcggggggcccucggg

SEQ ID NO: 16263 - RNA, 18 nt, Artificial Sequence
  Synthetic
cggcgugccggcgucggg

SEQ ID NO: 16264 - RNA, 19 nt, Artificial Sequence
  Synthetic
ccggcgugccggcgucggg

SEQ ID NO: 16265 - RNA, 20 nt, Artificial Sequence
  Synthetic
cccggcgugccggcgucggg

SEQ ID NO: 16266 - RNA, 21 nt, Artificial Sequence
  Synthetic
ccccggcgugccggcgucggg

SEQ ID NO: 16267 - RNA, 22 nt, Artificial Sequence
  Synthetic
cccccggcgugccggcgucggg

SEQ ID NO: 16268 - RNA, 23 nt, Artificial Sequence
  Synthetic
gcccccggcgugccggcgucggg

SEQ ID NO: 16269 - RNA, 24 nt, Artificial Sequence
  Synthetic
ggcccccggcgugccggcgucggg

SEQ ID NO: 16270 - RNA, 18 nt, Artificial Sequence
  Synthetic
aauggaauuccguucggg

SEQ ID NO: 16271 - RNA, 19 nt, Artificial Sequence
  Synthetic
uaauggaauuccguucggg

SEQ ID NO: 16272 - RNA, 20 nt, Artificial Sequence
  Synthetic
auaauggaauuccguucggg

SEQ ID NO: 16273 - RNA, 21 nt, Artificial Sequence
  Synthetic
cauaauggaauuccguucggg

SEQ ID NO: 16274 - RNA, 22 nt, Artificial Sequence
  Synthetic
gcauaauggaauuccguucggg

SEQ ID NO: 16275 - RNA, 23 nt, Artificial Sequence
  Synthetic
ugcauaauggaauuccguucggg

SEQ ID NO: 16276 - RNA, 24 nt, Artificial Sequence
  Synthetic
gugcauaauggaauuccguucggg

SEQ ID NO: 16277 - RNA, 18 nt, Artificial Sequence
  Synthetic
uggcgcggaugggcgggg

SEQ ID NO: 16278 - RNA, 19 nt, Artificial Sequence
  Synthetic
auggcgcggaugggcgggg

SEQ ID NO: 16279 - RNA, 20 nt, Artificial Sequence
  Synthetic
gauggcgcggaugggcgggg

SEQ ID NO: 16280 - RNA, 21 nt, Artificial Sequence
  Synthetic
agauggcgcggaugggcgggg

SEQ ID NO: 16281 - RNA, 22 nt, Artificial Sequence
  Synthetic
cagauggcgcggaugggcgggg

SEQ ID NO: 16282 - RNA, 23 nt, Artificial Sequence
  Synthetic
gcagauggcgcggaugggcgggg

SEQ ID NO: 16283 - RNA, 24 nt, Artificial Sequence
  Synthetic
ggcagauggcgcggaugggcgggg

SEQ ID NO: 16284 - RNA, 18 nt, Artificial Sequence
  Synthetic
augagaugccaugcgggg

SEQ ID NO: 16285 - RNA, 19 nt, Artificial Sequence
  Synthetic
aaugagaugccaugcgggg

SEQ ID NO: 16286 - RNA, 20 nt, Artificial Sequence
  Synthetic
uaaugagaugccaugcgggg

SEQ ID NO: 16287 - RNA, 21 nt, Artificial Sequence
  Synthetic
guaaugagaugccaugcgggg

SEQ ID NO: 16288 - RNA, 22 nt, Artificial Sequence
  Synthetic
gguaaugagaugccaugcgggg

SEQ ID NO: 16289 - RNA, 23 nt, Artificial Sequence
  Synthetic
cgguaaugagaugccaugcgggg

SEQ ID NO: 16290 - RNA, 24 nt, Artificial Sequence
  Synthetic
gcgguaaugagaugccaugcgggg

SEQ ID NO: 16291 - RNA, 18 nt, Artificial Sequence
  Synthetic
ggugggcccgccgggggg

SEQ ID NO: 16292 - RNA, 19 nt, Artificial Sequence
  Synthetic
gggugggcccgccgggggg

SEQ ID NO: 16293 - RNA, 20 nt, Artificial Sequence
  Synthetic
ggggugggcccgccgggggg

SEQ ID NO: 16294 - RNA, 21 nt, Artificial Sequence
  Synthetic
cggggugggcccgccgggggg

SEQ ID NO: 16295 - RNA, 22 nt, Artificial Sequence
  Synthetic
ucggggugggcccgccgggggg

SEQ ID NO: 16296 - RNA, 23 nt, Artificial Sequence
  Synthetic
uucggggugggcccgccgggggg

SEQ ID NO: 16297 - RNA, 24 nt, Artificial Sequence
  Synthetic
guucggggugggcccgccgggggg

SEQ ID NO: 16298 - RNA, 18 nt, Artificial Sequence
  Synthetic
gugggcccgccggggggg

SEQ ID NO: 16299 - RNA, 19 nt, Artificial Sequence
  Synthetic
ggugggcccgccggggggg

SEQ ID NO: 16300 - RNA, 20 nt, Artificial Sequence
  Synthetic
gggugggcccgccggggggg

SEQ ID NO: 16301 - RNA, 21 nt, Artificial Sequence
  Synthetic
ggggugggcccgccggggggg

SEQ ID NO: 16302 - RNA, 22 nt, Artificial Sequence
  Synthetic
cggggugggcccgccggggggg

SEQ ID NO: 16303 - RNA, 23 nt, Artificial Sequence
  Synthetic
ucggggugggcccgccggggggg

SEQ ID NO: 16304 - RNA, 24 nt, Artificial Sequence
  Synthetic
uucggggugggcccgccggggggg

SEQ ID NO: 16305 - RNA, 18 nt, Artificial Sequence
  Synthetic
gcagauggcgcggauggg

SEQ ID NO: 16306 - RNA, 19 nt, Artificial Sequence
  Synthetic
ggcagauggcgcggauggg

SEQ ID NO: 16307 - RNA, 20 nt, Artificial Sequence
  Synthetic
uggcagauggcgcggauggg

SEQ ID NO: 16308 - RNA, 21 nt, Artificial Sequence
  Synthetic
auggcagauggcgcggauggg

SEQ ID NO: 16309 - RNA, 22 nt, Artificial Sequence
  Synthetic
cauggcagauggcgcggauggg

SEQ ID NO: 16310 - RNA, 23 nt, Artificial Sequence
  Synthetic
ccauggcagauggcgcggauggg

SEQ ID NO: 16311 - RNA, 24 nt, Artificial Sequence
  Synthetic
cccauggcagauggcgcggauggg

SEQ ID NO: 16312 - RNA, 18 nt, Artificial Sequence
  Synthetic
ccgcccgccggccaaugg

SEQ ID NO: 16313 - RNA, 19 nt, Artificial Sequence
  Synthetic
cccgcccgccggccaaugg

SEQ ID NO: 16314 - RNA, 20 nt, Artificial Sequence
  Synthetic
ucccgcccgccggccaaugg

SEQ ID NO: 16315 - RNA, 21 nt, Artificial Sequence
  Synthetic
gucccgcccgccggccaaugg

SEQ ID NO: 16316 - RNA, 22 nt, Artificial Sequence
  Synthetic
ggucccgcccgccggccaaugg

SEQ ID NO: 16317 - RNA, 23 nt, Artificial Sequence
  Synthetic
cggucccgcccgccggccaaugg

SEQ ID NO: 16318 - RNA, 24 nt, Artificial Sequence
  Synthetic
gcggucccgcccgccggccaaugg

SEQ ID NO: 16319 - RNA, 18 nt, Artificial Sequence
  Synthetic
ggcagauggcgcggaugg

SEQ ID NO: 16320 - RNA, 19 nt, Artificial Sequence
  Synthetic
uggcagauggcgcggaugg

SEQ ID NO: 16321 - RNA, 20 nt, Artificial Sequence
  Synthetic
auggcagauggcgcggaugg

SEQ ID NO: 16322 - RNA, 21 nt, Artificial Sequence
  Synthetic
cauggcagauggcgcggaugg

SEQ ID NO: 16323 - RNA, 22 nt, Artificial Sequence
  Synthetic
ccauggcagauggcgcggaugg

SEQ ID NO: 16324 - RNA, 23 nt, Artificial Sequence
  Synthetic
cccauggcagauggcgcggaugg

SEQ ID NO: 16325 - RNA, 24 nt, Artificial Sequence
  Synthetic
gcccauggcagauggcgcggaugg

SEQ ID NO: 16326 - RNA, 18 nt, Artificial Sequence
  Synthetic
cccgcccgccggccaaug

SEQ ID NO: 16327 - RNA, 19 nt, Artificial Sequence
  Synthetic
ucccgcccgccggccaaug

SEQ ID NO: 16328 - RNA, 20 nt, Artificial Sequence
  Synthetic
gucccgcccgccggccaaug

SEQ ID NO: 16329 - RNA, 18 nt, Artificial Sequence
  Synthetic
cgguaaugagaugccaug

SEQ ID NO: 16330 - RNA, 19 nt, Artificial Sequence
  Synthetic
gcgguaaugagaugccaug

SEQ ID NO: 16331 - RNA, 20 nt, Artificial Sequence
  Synthetic
ggcgguaaugagaugccaug

SEQ ID NO: 16332 - RNA, 21 nt, Artificial Sequence
  Synthetic
gggcgguaaugagaugccaug

SEQ ID NO: 16333 - RNA, 22 nt, Artificial Sequence
  Synthetic
cgggcgguaaugagaugccaug

SEQ ID NO: 16334 - RNA, 23 nt, Artificial Sequence
  Synthetic
ucgggcgguaaugagaugccaug

SEQ ID NO: 16335 - RNA, 24 nt, Artificial Sequence
  Synthetic
aucgggcgguaaugagaugccaug

SEQ ID NO: 16336 - RNA, 18 nt, Artificial Sequence
  Synthetic
ccguuccucguuagcaug

SEQ ID NO: 16337 - RNA, 19 nt, Artificial Sequence
  Synthetic
cccguuccucguuagcaug

SEQ ID NO: 16338 - RNA, 20 nt, Artificial Sequence
  Synthetic
gcccguuccucguuagcaug

SEQ ID NO: 16339 - RNA, 21 nt, Artificial Sequence
  Synthetic
ugcccguuccucguuagcaug

SEQ ID NO: 16340 - RNA, 22 nt, Artificial Sequence
  Synthetic
cugcccguuccucguuagcaug

SEQ ID NO: 16341 - RNA, 23 nt, Artificial Sequence
  Synthetic
ccugcccguuccucguuagcaug

SEQ ID NO: 16342 - RNA, 24 nt, Artificial Sequence
  Synthetic
cccugcccguuccucguuagcaug

SEQ ID NO: 16343 - RNA, 18 nt, Artificial Sequence
  Synthetic
ucccgcccgccggccaau

SEQ ID NO: 16344 - RNA, 19 nt, Artificial Sequence
  Synthetic
gucccgcccgccggccaau

SEQ ID NO: 16345 - RNA, 20 nt, Artificial Sequence
  Synthetic
ggucccgcccgccggccaau

SEQ ID NO: 16346 - RNA, 18 nt, Artificial Sequence
  Synthetic
gcgguaaugagaugccau

SEQ ID NO: 16347 - RNA, 19 nt, Artificial Sequence
  Synthetic
ggcgguaaugagaugccau

SEQ ID NO: 16348 - RNA, 20 nt, Artificial Sequence
  Synthetic
gggcgguaaugagaugccau

SEQ ID NO: 16349 - RNA, 21 nt, Artificial Sequence
  Synthetic
cgggcgguaaugagaugccau

SEQ ID NO: 16350 - RNA, 22 nt, Artificial Sequence
  Synthetic
ucgggcgguaaugagaugccau

SEQ ID NO: 16351 - RNA, 23 nt, Artificial Sequence
  Synthetic
aucgggcgguaaugagaugccau

SEQ ID NO: 16352 - RNA, 24 nt, Artificial Sequence
  Synthetic
gaucgggcgguaaugagaugccau

SEQ ID NO: 16353 - RNA, 18 nt, Artificial Sequence
  Synthetic
cccguuccucguuagcau

SEQ ID NO: 16354 - RNA, 19 nt, Artificial Sequence
  Synthetic
gcccguuccucguuagcau

SEQ ID NO: 16355 - RNA, 20 nt, Artificial Sequence
  Synthetic
ugcccguuccucguuagcau

SEQ ID NO: 16356 - RNA, 21 nt, Artificial Sequence
  Synthetic
cugcccguuccucguuagcau

SEQ ID NO: 16357 - RNA, 22 nt, Artificial Sequence
  Synthetic
ccugcccguuccucguuagcau

SEQ ID NO: 16358 - RNA, 23 nt, Artificial Sequence
  Synthetic
cccugcccguuccucguuagcau

SEQ ID NO: 16359 - RNA, 24 nt, Artificial Sequence
  Synthetic
ccccugcccguuccucguuagcau

SEQ ID NO: 16360 - RNA, 18 nt, Artificial Sequence
  Synthetic
gccggccccugggacuau

SEQ ID NO: 16361 - RNA, 19 nt, Artificial Sequence
  Synthetic
cgccggccccugggacuau

SEQ ID NO: 16362 - RNA, 20 nt, Artificial Sequence
  Synthetic
ccgccggccccugggacuau

SEQ ID NO: 16363 - RNA, 21 nt, Artificial Sequence
  Synthetic
cccgccggccccugggacuau

SEQ ID NO: 16364 - RNA, 22 nt, Artificial Sequence
  Synthetic
ucccgccggccccugggacuau

SEQ ID NO: 16365 - RNA, 23 nt, Artificial Sequence
  Synthetic
uucccgccggccccugggacuau

SEQ ID NO: 16366 - RNA, 24 nt, Artificial Sequence
  Synthetic
cuucccgccggccccugggacuau

SEQ ID NO: 16367 - RNA, 18 nt, Artificial Sequence
  Synthetic
accgccgaaccgggaagu

SEQ ID NO: 16368 - RNA, 19 nt, Artificial Sequence
  Synthetic
uaccgccgaaccgggaagu

SEQ ID NO: 16369 - RNA, 20 nt, Artificial Sequence
  Synthetic
uuaccgccgaaccgggaagu

SEQ ID NO: 16370 - RNA, 21 nt, Artificial Sequence
  Synthetic
auuaccgccgaaccgggaagu

SEQ ID NO: 16371 - RNA, 22 nt, Artificial Sequence
  Synthetic
cauuaccgccgaaccgggaagu

SEQ ID NO: 16372 - RNA, 23 nt, Artificial Sequence
  Synthetic
ucauuaccgccgaaccgggaagu

SEQ ID NO: 16373 - RNA, 24 nt, Artificial Sequence
  Synthetic
cucauuaccgccgaaccgggaagu

SEQ ID NO: 16374 - RNA, 18 nt, Artificial Sequence
  Synthetic
ugcauaauggaauuccgu

SEQ ID NO: 16375 - RNA, 19 nt, Artificial Sequence
  Synthetic
gugcauaauggaauuccgu

SEQ ID NO: 16376 - RNA, 20 nt, Artificial Sequence
  Synthetic
cgugcauaauggaauuccgu

SEQ ID NO: 16377 - RNA, 21 nt, Artificial Sequence
  Synthetic
ucgugcauaauggaauuccgu

SEQ ID NO: 16378 - RNA, 22 nt, Artificial Sequence
  Synthetic
gucgugcauaauggaauuccgu

SEQ ID NO: 16379 - RNA, 23 nt, Artificial Sequence
  Synthetic
ggucgugcauaauggaauuccgu

SEQ ID NO: 16380 - RNA, 24 nt, Artificial Sequence
  Synthetic
gggucgugcauaauggaauuccgu

SEQ ID NO: 16381 - RNA, 18 nt, Artificial Sequence
  Synthetic
cccccggcgugccggcgu

SEQ ID NO: 16382 - RNA, 19 nt, Artificial Sequence
  Synthetic
gcccccggcgugccggcgu

SEQ ID NO: 16383 - RNA, 20 nt, Artificial Sequence
  Synthetic
ggcccccggcgugccggcgu

SEQ ID NO: 16384 - RNA, 21 nt, Artificial Sequence
  Synthetic
gggcccccggcgugccggcgu

SEQ ID NO: 16385 - RNA, 22 nt, Artificial Sequence
  Synthetic
cgggcccccggcgugccggcgu

SEQ ID NO: 16386 - RNA, 23 nt, Artificial Sequence
  Synthetic
acgggcccccggcgugccggcgu

SEQ ID NO: 16387 - RNA, 24 nt, Artificial Sequence
  Synthetic
cacgggcccccggcgugccggcgu

SEQ ID NO: 16388 - RNA, 18 nt, Artificial Sequence
  Synthetic
ccgcaucggcgauggcgu

SEQ ID NO: 16389 - RNA, 19 nt, Artificial Sequence
  Synthetic
cccgcaucggcgauggcgu

SEQ ID NO: 16390 - RNA, 20 nt, Artificial Sequence
  Synthetic
ccccgcaucggcgauggcgu

SEQ ID NO: 16391 - RNA, 21 nt, Artificial Sequence
  Synthetic
gccccgcaucggcgauggcgu

SEQ ID NO: 16392 - RNA, 22 nt, Artificial Sequence
  Synthetic
cgccccgcaucggcgauggcgu

SEQ ID NO: 16393 - RNA, 23 nt, Artificial Sequence
  Synthetic
ucgccccgcaucggcgauggcgu

SEQ ID NO: 16394 - RNA, 24 nt, Artificial Sequence
  Synthetic
aucgccccgcaucggcgauggcgu

SEQ ID NO: 16395 - RNA, 19 nt, Artificial Sequence
  Synthetic
gucggacgacgaggacgaa

SEQ ID NO: 16396 - RNA, 24 nt, Artificial Sequence
  Synthetic
gccuuuuuugcacggguaagcacc

SEQ ID NO: 16397 - RNA, 19 nt, Artificial Sequence
  Synthetic
gacgacgaggacgaggacc

SEQ ID NO: 16398 - RNA, 20 nt, Artificial Sequence
  Synthetic
ggacgacgaggacgaggacc

SEQ ID NO: 16399 - RNA, 22 nt, Artificial Sequence
  Synthetic
gcggacgacgaggacgaggacc

SEQ ID NO: 16400 - RNA, 19 nt, Artificial Sequence
  Synthetic
gagcacgcggaccgggagc

SEQ ID NO: 16401 - RNA, 20 nt, Artificial Sequence
  Synthetic
ggagcacgcggaccgggagc

SEQ ID NO: 16402 - RNA, 22 nt, Artificial Sequence
  Synthetic
gcggagcacgcggaccgggagc

SEQ ID NO: 16403 - RNA, 18 nt, Artificial Sequence
  Synthetic
gucgucggcucgaaaggc

SEQ ID NO: 16404 - RNA, 24 nt, Artificial Sequence
  Synthetic
gucaucgucgucggcucgaaaggc

SEQ ID NO: 16405 - RNA, 19 nt, Artificial Sequence
  Synthetic
guccggggcggcgaggccg

SEQ ID NO: 16406 - RNA, 20 nt, Artificial Sequence
  Synthetic
gguccggggcggcgaggccg

SEQ ID NO: 16407 - RNA, 21 nt, Artificial Sequence
  Synthetic
ggguccggggcggcgaggccg

SEQ ID NO: 16408 - RNA, 22 nt, Artificial Sequence
  Synthetic
gggguccggggcggcgaggccg

SEQ ID NO: 16409 - RNA, 23 nt, Artificial Sequence
  Synthetic
ggggguccggggcggcgaggccg

SEQ ID NO: 16410 - RNA, 18 nt, Artificial Sequence
  Synthetic
gcggcgacaggcgguccg

SEQ ID NO: 16411 - RNA, 20 nt, Artificial Sequence
  Synthetic
gcgcggcgacaggcgguccg

SEQ ID NO: 16412 - RNA, 21 nt, Artificial Sequence
  Synthetic
ggcgcggcgacaggcgguccg

SEQ ID NO: 16413 - RNA, 22 nt, Artificial Sequence
  Synthetic
gggcgcggcgacaggcgguccg

SEQ ID NO: 16414 - RNA, 24 nt, Artificial Sequence
  Synthetic
gcgggcgcggcgacaggcgguccg

SEQ ID NO: 16415 - RNA, 18 nt, Artificial Sequence
  Synthetic
gggcccgggcggcggggg

SEQ ID NO: 16416 - RNA, 20 nt, Artificial Sequence
  Synthetic
gcgggcccgggcggcggggg

SEQ ID NO: 16417 - RNA, 21 nt, Artificial Sequence
  Synthetic
ggcgggcccgggcggcggggg

SEQ ID NO: 16418 - RNA, 22 nt, Artificial Sequence
  Synthetic
gggcgggcccgggcggcggggg

SEQ ID NO: 16419 - RNA, 23 nt, Artificial Sequence
  Synthetic
ggggcgggcccgggcggcggggg

SEQ ID NO: 16420 - RNA, 24 nt, Artificial Sequence
  Synthetic
gggggcgggcccgggcggcggggg

SEQ ID NO: 16421 - RNA, 18 nt, Artificial Sequence
  Synthetic
gacgccccggcucgggau

SEQ ID NO: 16422 - RNA, 20 nt, Artificial Sequence
  Synthetic
gcgacgccccggcucgggau

SEQ ID NO: 16423 - RNA, 19 nt, Artificial Sequence
  Synthetic
gcaucgcgacgccccggcu

SEQ ID NO: 16424 - RNA, 20 nt, Artificial Sequence
  Synthetic
ggcaucgcgacgccccggcu

SEQ ID NO: 16425 - RNA, 23 nt, Artificial Sequence
  Synthetic
gucggcaucgcgacgccccggcu

SEQ ID NO: 16426 - RNA, 18 nt, Artificial Sequence
  Synthetic
ggccgcggggucgggcgu

SEQ ID NO: 16427 - RNA, 20 nt, Artificial Sequence
  Synthetic
gaggccgcggggucgggcgu

SEQ ID NO: 16428 - RNA, 22 nt, Artificial Sequence
  Synthetic
gcgaggccgcggggucgggcgu

SEQ ID NO: 16429 - RNA, 23 nt, Artificial Sequence
  Synthetic
ggcgaggccgcggggucgggcgu

SEQ ID NO: 16430 - RNA, 19 nt, Artificial Sequence
  Synthetic
gacaggcgguccguggggu

SEQ ID NO: 16431 - RNA, 21 nt, Artificial Sequence
  Synthetic
gcgacaggcgguccguggggu

SEQ ID NO: 16432 - RNA, 22 nt, Artificial Sequence
  Synthetic
ggcgacaggcgguccguggggu

SEQ ID NO: 16433 - RNA, 24 nt, Artificial Sequence
  Synthetic
gcggcgacaggcgguccguggggu

SEQ ID NO: 16434 - RNA, 21 nt, Artificial Sequence
  Synthetic
guuucugucgucggaggcccc

SEQ ID NO: 16435 - RNA, 22 nt, Artificial Sequence
  Synthetic
gguuucugucgucggaggcccc

SEQ ID NO: 16436 - RNA, 23 nt, Artificial Sequence
  Synthetic
ggguuucugucgucggaggcccc

SEQ ID NO: 16437 - RNA, 18 nt, Artificial Sequence
  Synthetic
gugcguccccuguguuuc

SEQ ID NO: 16438 - RNA, 19 nt, Artificial Sequence
  Synthetic
ggugcguccccuguguuuc

SEQ ID NO: 16439 - RNA, 20 nt, Artificial Sequence
  Synthetic
gggugcguccccuguguuuc

SEQ ID NO: 16440 - RNA, 21 nt, Artificial Sequence
  Synthetic
ggggugcguccccuguguuuc

SEQ ID NO: 16441 - RNA, 19 nt, Artificial Sequence
  Synthetic
gugcaaaaaaggcggaccg

SEQ ID NO: 16442 - RNA, 20 nt, Artificial Sequence
  Synthetic
gcccgcccccggggccggcg

SEQ ID NO: 16443 - RNA, 21 nt, Artificial Sequence
  Synthetic
ggcccgcccccggggccggcg

SEQ ID NO: 16444 - RNA, 22 nt, Artificial Sequence
  Synthetic
gggcccgcccccggggccggcg

SEQ ID NO: 16445 - RNA, 18 nt, Artificial Sequence
  Synthetic
gaggcgcgggccgucggg

SEQ ID NO: 16446 - RNA, 20 nt, Artificial Sequence
  Synthetic
gcgaggcgcgggccgucggg

SEQ ID NO: 16447 - RNA, 24 nt, Artificial Sequence
  Synthetic
gcacgcgaggcgcgggccgucggg

SEQ ID NO: 16448 - RNA, 19 nt, Artificial Sequence
  Synthetic
gccgacgacgaugacgggg

SEQ ID NO: 16449 - RNA, 21 nt, Artificial Sequence
  Synthetic
gagccgacgacgaugacgggg

SEQ ID NO: 16450 - RNA, 19 nt, Artificial Sequence
  Synthetic
guccccuguguuucguggg

SEQ ID NO: 16451 - RNA, 21 nt, Artificial Sequence
  Synthetic
gcguccccuguguuucguggg

SEQ ID NO: 16452 - RNA, 23 nt, Artificial Sequence
  Synthetic
gugcguccccuguguuucguggg

SEQ ID NO: 16453 - RNA, 24 nt, Artificial Sequence
  Synthetic
ggugcguccccuguguuucguggg

SEQ ID NO: 16454 - RNA, 18 nt, Artificial Sequence
  Synthetic
guuucguggguggggugg

SEQ ID NO: 16455 - RNA, 20 nt, Artificial Sequence
  Synthetic
guguuucguggguggggugg

SEQ ID NO: 16456 - RNA, 20 nt, Artificial Sequence
  Synthetic
gucaucgaccucgucggacu

SEQ ID NO: 16457 - RNA, 22 nt, Artificial Sequence
  Synthetic
gcgucaucgaccucgucggacu

SEQ ID NO: 16458 - RNA, 23 nt, Artificial Sequence
  Synthetic
ggcgucaucgaccucgucggacu

SEQ ID NO: 16459 - RNA, 18 nt, Artificial Sequence
  Synthetic
ucggacgacgaggacgaa

SEQ ID NO: 16460 - RNA, 20 nt, Artificial Sequence
  Synthetic
cgucggacgacgaggacgaa

SEQ ID NO: 16461 - RNA, 21 nt, Artificial Sequence
  Synthetic
ucgucggacgacgaggacgaa

SEQ ID NO: 16462 - RNA, 22 nt, Artificial Sequence
  Synthetic
cucgucggacgacgaggacgaa

SEQ ID NO: 16463 - RNA, 23 nt, Artificial Sequence
  Synthetic
ccucgucggacgacgaggacgaa

SEQ ID NO: 16464 - RNA, 24 nt, Artificial Sequence
  Synthetic
uccucgucggacgacgaggacgaa

SEQ ID NO: 16465 - RNA, 18 nt, Artificial Sequence
  Synthetic
uuugcacggguaagcacc

SEQ ID NO: 16466 - RNA, 19 nt, Artificial Sequence
  Synthetic
uuuugcacggguaagcacc

SEQ ID NO: 16467 - RNA, 20 nt, Artificial Sequence
  Synthetic
uuuuugcacggguaagcacc

SEQ ID NO: 16468 - RNA, 21 nt, Artificial Sequence
  Synthetic
uuuuuugcacggguaagcacc

SEQ ID NO: 16469 - RNA, 22 nt, Artificial Sequence
  Synthetic
cuuuuuugcacggguaagcacc

SEQ ID NO: 16470 - RNA, 23 nt, Artificial Sequence
  Synthetic
ccuuuuuugcacggguaagcacc

SEQ ID NO: 16471 - RNA, 18 nt, Artificial Sequence
  Synthetic
acgacgaggacgaggacc

SEQ ID NO: 16472 - RNA, 21 nt, Artificial Sequence
  Synthetic
cggacgacgaggacgaggacc

SEQ ID NO: 16473 - RNA, 23 nt, Artificial Sequence
  Synthetic
ugcggacgacgaggacgaggacc

SEQ ID NO: 16474 - RNA, 24 nt, Artificial Sequence
  Synthetic
augcggacgacgaggacgaggacc

SEQ ID NO: 16475 - RNA, 18 nt, Artificial Sequence
  Synthetic
agcacgcggaccgggagc

SEQ ID NO: 16476 - RNA, 21 nt, Artificial Sequence
  Synthetic
cggagcacgcggaccgggagc

SEQ ID NO: 16477 - RNA, 23 nt, Artificial Sequence
  Synthetic
ugcggagcacgcggaccgggagc

SEQ ID NO: 16478 - RNA, 24 nt, Artificial Sequence
  Synthetic
cugcggagcacgcggaccgggagc

SEQ ID NO: 16479 - RNA, 19 nt, Artificial Sequence
  Synthetic
cgucgucggcucgaaaggc

SEQ ID NO: 16480 - RNA, 20 nt, Artificial Sequence
  Synthetic
ucgucgucggcucgaaaggc

SEQ ID NO: 16481 - RNA, 21 nt, Artificial Sequence
  Synthetic
aucgucgucggcucgaaaggc

SEQ ID NO: 16482 - RNA, 22 nt, Artificial Sequence
  Synthetic
caucgucgucggcucgaaaggc

SEQ ID NO: 16483 - RNA, 23 nt, Artificial Sequence
  Synthetic
ucaucgucgucggcucgaaaggc

SEQ ID NO: 16484 - RNA, 18 nt, Artificial Sequence
  Synthetic
ccgguccgccuuuuuugc

SEQ ID NO: 16485 - RNA, 19 nt, Artificial Sequence
  Synthetic
accgguccgccuuuuuugc

SEQ ID NO: 16486 - RNA, 20 nt, Artificial Sequence
  Synthetic
caccgguccgccuuuuuugc

SEQ ID NO: 16487 - RNA, 21 nt, Artificial Sequence
  Synthetic
ccaccgguccgccuuuuuugc

SEQ ID NO: 16488 - RNA, 22 nt, Artificial Sequence
  Synthetic
cccaccgguccgccuuuuuugc

SEQ ID NO: 16489 - RNA, 23 nt, Artificial Sequence
  Synthetic
acccaccgguccgccuuuuuugc

SEQ ID NO: 16490 - RNA, 24 nt, Artificial Sequence
  Synthetic
aacccaccgguccgccuuuuuugc

SEQ ID NO: 16491 - RNA, 18 nt, Artificial Sequence
  Synthetic
uccggggcggcgaggccg

SEQ ID NO: 16492 - RNA, 24 nt, Artificial Sequence
  Synthetic
cggggguccggggcggcgaggccg

SEQ ID NO: 16493 - RNA, 19 nt, Artificial Sequence
  Synthetic
cgcggcgacaggcgguccg

SEQ ID NO: 16494 - RNA, 23 nt, Artificial Sequence
  Synthetic
cgggcgcggcgacaggcgguccg

SEQ ID NO: 16495 - RNA, 19 nt, Artificial Sequence
  Synthetic
cgggcccgggcggcggggg

SEQ ID NO: 16496 - RNA, 19 nt, Artificial Sequence
  Synthetic
cgacgccccggcucgggau

SEQ ID NO: 16497 - RNA, 21 nt, Artificial Sequence
  Synthetic
cgcgacgccccggcucgggau

SEQ ID NO: 16498 - RNA, 22 nt, Artificial Sequence
  Synthetic
ucgcgacgccccggcucgggau

SEQ ID NO: 16499 - RNA, 23 nt, Artificial Sequence
  Synthetic
aucgcgacgccccggcucgggau

SEQ ID NO: 16500 - RNA, 24 nt, Artificial Sequence
  Synthetic
caucgcgacgccccggcucgggau

SEQ ID NO: 16501 - RNA, 18 nt, Artificial Sequence
  Synthetic
caucgcgacgccccggcu

SEQ ID NO: 16502 - RNA, 21 nt, Artificial Sequence
  Synthetic
cggcaucgcgacgccccggcu

SEQ ID NO: 16503 - RNA, 22 nt, Artificial Sequence
  Synthetic
ucggcaucgcgacgccccggcu

SEQ ID NO: 16504 - RNA, 24 nt, Artificial Sequence
  Synthetic
cgucggcaucgcgacgccccggcu

SEQ ID NO: 16505 - RNA, 19 nt, Artificial Sequence
  Synthetic
aggccgcggggucgggcgu

SEQ ID NO: 16506 - RNA, 21 nt, Artificial Sequence
  Synthetic
cgaggccgcggggucgggcgu

SEQ ID NO: 16507 - RNA, 24 nt, Artificial Sequence
  Synthetic
cggcgaggccgcggggucgggcgu

SEQ ID NO: 16508 - RNA, 18 nt, Artificial Sequence
  Synthetic
acaggcgguccguggggu

SEQ ID NO: 16509 - RNA, 20 nt, Artificial Sequence
  Synthetic
cgacaggcgguccguggggu

SEQ ID NO: 16510 - RNA, 23 nt, Artificial Sequence
  Synthetic
cggcgacaggcgguccguggggu

SEQ ID NO: 16511 - RNA, 18 nt, Artificial Sequence
  Synthetic
ucugucgucggaggcccc

SEQ ID NO: 16512 - RNA, 19 nt, Artificial Sequence
  Synthetic
uucugucgucggaggcccc

SEQ ID NO: 16513 - RNA, 20 nt, Artificial Sequence
  Synthetic
uuucugucgucggaggcccc

SEQ ID NO: 16514 - RNA, 24 nt, Artificial Sequence
  Synthetic
uggguuucugucgucggaggcccc

SEQ ID NO: 16515 - RNA, 22 nt, Artificial Sequence
  Synthetic
cggggugcguccccuguguuuc

SEQ ID NO: 16516 - RNA, 23 nt, Artificial Sequence
  Synthetic
ccggggugcguccccuguguuuc

SEQ ID NO: 16517 - RNA, 24 nt, Artificial Sequence
  Synthetic
cccggggugcguccccuguguuuc

SEQ ID NO: 16518 - RNA, 18 nt, Artificial Sequence
  Synthetic
ugcaaaaaaggcggaccg

SEQ ID NO: 16519 - RNA, 20 nt, Artificial Sequence
  Synthetic
cgugcaaaaaaggcggaccg

SEQ ID NO: 16520 - RNA, 21 nt, Artificial Sequence
  Synthetic
ccgugcaaaaaaggcggaccg

SEQ ID NO: 16521 - RNA, 22 nt, Artificial Sequence
  Synthetic
cccgugcaaaaaaggcggaccg

SEQ ID NO: 16522 - RNA, 23 nt, Artificial Sequence
  Synthetic
acccgugcaaaaaaggcggaccg

SEQ ID NO: 16523 - RNA, 24 nt, Artificial Sequence
  Synthetic
uacccgugcaaaaaaggcggaccg

SEQ ID NO: 16524 - RNA, 18 nt, Artificial Sequence
  Synthetic
ccgcccccggggccggcg

SEQ ID NO: 16525 - RNA, 19 nt, Artificial Sequence
  Synthetic
cccgcccccggggccggcg

SEQ ID NO: 16526 - RNA, 23 nt, Artificial Sequence
  Synthetic
cgggcccgcccccggggccggcg

SEQ ID NO: 16527 - RNA, 24 nt, Artificial Sequence
  Synthetic
ccgggcccgcccccggggccggcg

SEQ ID NO: 16528 - RNA, 19 nt, Artificial Sequence
  Synthetic
cgaggcgcgggccgucggg

SEQ ID NO: 16529 - RNA, 21 nt, Artificial Sequence
  Synthetic
cgcgaggcgcgggccgucggg

SEQ ID NO: 16530 - RNA, 22 nt, Artificial Sequence
  Synthetic
acgcgaggcgcgggccgucggg

SEQ ID NO: 16531 - RNA, 23 nt, Artificial Sequence
  Synthetic
cacgcgaggcgcgggccgucggg

SEQ ID NO: 16532 - RNA, 18 nt, Artificial Sequence
  Synthetic
ccgacgacgaugacgggg

SEQ ID NO: 16533 - RNA, 20 nt, Artificial Sequence
  Synthetic
agccgacgacgaugacgggg

SEQ ID NO: 16534 - RNA, 22 nt, Artificial Sequence
  Synthetic
cgagccgacgacgaugacgggg

SEQ ID NO: 16535 - RNA, 23 nt, Artificial Sequence
  Synthetic
ucgagccgacgacgaugacgggg

SEQ ID NO: 16536 - RNA, 24 nt, Artificial Sequence
  Synthetic
uucgagccgacgacgaugacgggg

SEQ ID NO: 16537 - RNA, 18 nt, Artificial Sequence
  Synthetic
uccccuguguuucguggg

SEQ ID NO: 16538 - RNA, 20 nt, Artificial Sequence
  Synthetic
cguccccuguguuucguggg

SEQ ID NO: 16539 - RNA, 22 nt, Artificial Sequence
  Synthetic
ugcguccccuguguuucguggg

SEQ ID NO: 16540 - RNA, 19 nt, Artificial Sequence
  Synthetic
uguuucguggguggggugg

SEQ ID NO: 16541 - RNA, 21 nt, Artificial Sequence
  Synthetic
uguguuucguggguggggugg

SEQ ID NO: 16542 - RNA, 22 nt, Artificial Sequence
  Synthetic
cuguguuucguggguggggugg

SEQ ID NO: 16543 - RNA, 23 nt, Artificial Sequence
  Synthetic
ccuguguuucguggguggggugg

SEQ ID NO: 16544 - RNA, 24 nt, Artificial Sequence
  Synthetic
cccuguguuucguggguggggugg

SEQ ID NO: 16545 - RNA, 18 nt, Artificial Sequence
  Synthetic
caucgaccucgucggacu

SEQ ID NO: 16546 - RNA, 19 nt, Artificial Sequence
  Synthetic
ucaucgaccucgucggacu

SEQ ID NO: 16547 - RNA, 21 nt, Artificial Sequence
  Synthetic
cgucaucgaccucgucggacu

SEQ ID NO: 16548 - RNA, 24 nt, Artificial Sequence
  Synthetic
cggcgucaucgaccucgucggacu

SEQ ID NO: 16549 - RNA, 18 nt, Artificial Sequence
  Synthetic
ggccgccggguaaaagaa

SEQ ID NO: 16550 - RNA, 19 nt, Artificial Sequence
  Synthetic
gggccgccggguaaaagaa

SEQ ID NO: 16551 - RNA, 20 nt, Artificial Sequence
  Synthetic
ggggccgccggguaaaagaa

SEQ ID NO: 16552 - RNA, 21 nt, Artificial Sequence
  Synthetic
cggggccgccggguaaaagaa

SEQ ID NO: 16553 - RNA, 22 nt, Artificial Sequence
  Synthetic
gcggggccgccggguaaaagaa

SEQ ID NO: 16554 - RNA, 23 nt, Artificial Sequence
  Synthetic
ggcggggccgccggguaaaagaa

SEQ ID NO: 16555 - RNA, 24 nt, Artificial Sequence
  Synthetic
gggcggggccgccggguaaaagaa

SEQ ID NO: 16556 - RNA, 18 nt, Artificial Sequence
  Synthetic
aucgggaucgcaucggaa

SEQ ID NO: 16557 - RNA, 19 nt, Artificial Sequence
  Synthetic
gaucgggaucgcaucggaa

SEQ ID NO: 16558 - RNA, 20 nt, Artificial Sequence
  Synthetic
ggaucgggaucgcaucggaa

SEQ ID NO: 16559 - RNA, 21 nt, Artificial Sequence
  Synthetic
gggaucgggaucgcaucggaa

SEQ ID NO: 16560 - RNA, 22 nt, Artificial Sequence
  Synthetic
cgggaucgggaucgcaucggaa

SEQ ID NO: 16561 - RNA, 23 nt, Artificial Sequence
  Synthetic
ucgggaucgggaucgcaucggaa

SEQ ID NO: 16562 - RNA, 24 nt, Artificial Sequence
  Synthetic
cucgggaucgggaucgcaucggaa

SEQ ID NO: 16563 - RNA, 18 nt, Artificial Sequence
  Synthetic
ggcggggccgccggguaa

SEQ ID NO: 16564 - RNA, 19 nt, Artificial Sequence
  Synthetic
gggcggggccgccggguaa

SEQ ID NO: 16565 - RNA, 20 nt, Artificial Sequence
  Synthetic
ggggcggggccgccggguaa

SEQ ID NO: 16566 - RNA, 21 nt, Artificial Sequence
  Synthetic
gggggcggggccgccggguaa

SEQ ID NO: 16567 - RNA, 22 nt, Artificial Sequence
  Synthetic
agggggcggggccgccggguaa

SEQ ID NO: 16568 - RNA, 23 nt, Artificial Sequence
  Synthetic
aagggggcggggccgccggguaa

SEQ ID NO: 16569 - RNA, 24 nt, Artificial Sequence
  Synthetic
caagggggcggggccgccggguaa

SEQ ID NO: 16570 - RNA, 18 nt, Artificial Sequence
  Synthetic
caccccacccacgaaaca

SEQ ID NO: 16571 - RNA, 19 nt, Artificial Sequence
  Synthetic
ccaccccacccacgaaaca

SEQ ID NO: 16572 - RNA, 20 nt, Artificial Sequence
  Synthetic
cccaccccacccacgaaaca

SEQ ID NO: 16573 - RNA, 21 nt, Artificial Sequence
  Synthetic
gcccaccccacccacgaaaca

SEQ ID NO: 16574 - RNA, 22 nt, Artificial Sequence
  Synthetic
cgcccaccccacccacgaaaca

SEQ ID NO: 16575 - RNA, 23 nt, Artificial Sequence
  Synthetic
ccgcccaccccacccacgaaaca

SEQ ID NO: 16576 - RNA, 24 nt, Artificial Sequence
  Synthetic
cccgcccaccccacccacgaaaca

SEQ ID NO: 16577 - RNA, 18 nt, Artificial Sequence
  Synthetic
ccccacccacgaaacaca

SEQ ID NO: 16578 - RNA, 19 nt, Artificial Sequence
  Synthetic
accccacccacgaaacaca

SEQ ID NO: 16579 - RNA, 20 nt, Artificial Sequence
  Synthetic
caccccacccacgaaacaca

SEQ ID NO: 16580 - RNA, 21 nt, Artificial Sequence
  Synthetic
ccaccccacccacgaaacaca

SEQ ID NO: 16581 - RNA, 22 nt, Artificial Sequence
  Synthetic
cccaccccacccacgaaacaca

SEQ ID NO: 16582 - RNA, 23 nt, Artificial Sequence
  Synthetic
gcccaccccacccacgaaacaca

SEQ ID NO: 16583 - RNA, 24 nt, Artificial Sequence
  Synthetic
cgcccaccccacccacgaaacaca

SEQ ID NO: 16584 - RNA, 18 nt, Artificial Sequence
  Synthetic
ggacggccuccucuacca

SEQ ID NO: 16585 - RNA, 19 nt, Artificial Sequence
  Synthetic
cggacggccuccucuacca

SEQ ID NO: 16586 - RNA, 20 nt, Artificial Sequence
  Synthetic
ccggacggccuccucuacca

SEQ ID NO: 16587 - RNA, 21 nt, Artificial Sequence
  Synthetic
uccggacggccuccucuacca

SEQ ID NO: 16588 - RNA, 22 nt, Artificial Sequence
  Synthetic
guccggacggccuccucuacca

SEQ ID NO: 16589 - RNA, 23 nt, Artificial Sequence
  Synthetic
cguccggacggccuccucuacca

SEQ ID NO: 16590 - RNA, 24 nt, Artificial Sequence
  Synthetic
ucguccggacggccuccucuacca

SEQ ID NO: 16591 - RNA, 18 nt, Artificial Sequence
  Synthetic
cucgggaucgggaucgca

SEQ ID NO: 16592 - RNA, 19 nt, Artificial Sequence
  Synthetic
gcucgggaucgggaucgca

SEQ ID NO: 16593 - RNA, 20 nt, Artificial Sequence
  Synthetic
ggcucgggaucgggaucgca

SEQ ID NO: 16594 - RNA, 21 nt, Artificial Sequence
  Synthetic
cggcucgggaucgggaucgca

SEQ ID NO: 16595 - RNA, 22 nt, Artificial Sequence
  Synthetic
ccggcucgggaucgggaucgca

SEQ ID NO: 16596 - RNA, 23 nt, Artificial Sequence
  Synthetic
cccggcucgggaucgggaucgca

SEQ ID NO: 16597 - RNA, 24 nt, Artificial Sequence
  Synthetic
ccccggcucgggaucgggaucgca

SEQ ID NO: 16598 - RNA, 18 nt, Artificial Sequence
  Synthetic
ccgggagcgggagucgca

SEQ ID NO: 16599 - RNA, 19 nt, Artificial Sequence
  Synthetic
accgggagcgggagucgca

SEQ ID NO: 16600 - RNA, 20 nt, Artificial Sequence
  Synthetic
gaccgggagcgggagucgca

SEQ ID NO: 16601 - RNA, 21 nt, Artificial Sequence
  Synthetic
ggaccgggagcgggagucgca

SEQ ID NO: 16602 - RNA, 22 nt, Artificial Sequence
  Synthetic
cggaccgggagcgggagucgca

SEQ ID NO: 16603 - RNA, 23 nt, Artificial Sequence
  Synthetic
gcggaccgggagcgggagucgca

SEQ ID NO: 16604 - RNA, 24 nt, Artificial Sequence
  Synthetic
cgcggaccgggagcgggagucgca

SEQ ID NO: 16605 - RNA, 18 nt, Artificial Sequence
  Synthetic
ggcgccggccacgaacga

SEQ ID NO: 16606 - RNA, 19 nt, Artificial Sequence
  Synthetic
cggcgccggccacgaacga

SEQ ID NO: 16607 - RNA, 20 nt, Artificial Sequence
  Synthetic
acggcgccggccacgaacga

SEQ ID NO: 16608 - RNA, 21 nt, Artificial Sequence
  Synthetic
gacggcgccggccacgaacga

SEQ ID NO: 16609 - RNA, 22 nt, Artificial Sequence
  Synthetic
agacggcgccggccacgaacga

SEQ ID NO: 16610 - RNA, 23 nt, Artificial Sequence
  Synthetic
cagacggcgccggccacgaacga

SEQ ID NO: 16611 - RNA, 24 nt, Artificial Sequence
  Synthetic
gcagacggcgccggccacgaacga

SEQ ID NO: 16612 - RNA, 18 nt, Artificial Sequence
  Synthetic
cccgggggccuccgacga

SEQ ID NO: 16613 - RNA, 19 nt, Artificial Sequence
  Synthetic
ccccgggggccuccgacga

SEQ ID NO: 16614 - RNA, 20 nt, Artificial Sequence
  Synthetic
accccgggggccuccgacga

SEQ ID NO: 16615 - RNA, 21 nt, Artificial Sequence
  Synthetic
caccccgggggccuccgacga

SEQ ID NO: 16616 - RNA, 22 nt, Artificial Sequence
  Synthetic
gcaccccgggggccuccgacga

SEQ ID NO: 16617 - RNA, 23 nt, Artificial Sequence
  Synthetic
cgcaccccgggggccuccgacga

SEQ ID NO: 16618 - RNA, 24 nt, Artificial Sequence
  Synthetic
acgcaccccgggggccuccgacga

SEQ ID NO: 16619 - RNA, 18 nt, Artificial Sequence
  Synthetic
ggacgcgggggcggagga

SEQ ID NO: 16620 - RNA, 19 nt, Artificial Sequence
  Synthetic
gggacgcgggggcggagga

SEQ ID NO: 16621 - RNA, 20 nt, Artificial Sequence
  Synthetic
ggggacgcgggggcggagga

SEQ ID NO: 16622 - RNA, 21 nt, Artificial Sequence
  Synthetic
gggggacgcgggggcggagga

SEQ ID NO: 16623 - RNA, 22 nt, Artificial Sequence
  Synthetic
ggggggacgcgggggcggagga

SEQ ID NO: 16624 - RNA, 23 nt, Artificial Sequence
  Synthetic
gggggggacgcgggggcggagga

SEQ ID NO: 16625 - RNA, 24 nt, Artificial Sequence
  Synthetic
agggggggacgcgggggcggagga

SEQ ID NO: 16626 - RNA, 18 nt, Artificial Sequence
  Synthetic
ccuugggugggcggagga

SEQ ID NO: 16627 - RNA, 19 nt, Artificial Sequence
  Synthetic
accuugggugggcggagga

SEQ ID NO: 16628 - RNA, 20 nt, Artificial Sequence
  Synthetic
caccuugggugggcggagga

SEQ ID NO: 16629 - RNA, 21 nt, Artificial Sequence
  Synthetic
gcaccuugggugggcggagga

SEQ ID NO: 16630 - RNA, 22 nt, Artificial Sequence
  Synthetic
agcaccuugggugggcggagga

SEQ ID NO: 16631 - RNA, 23 nt, Artificial Sequence
  Synthetic
aagcaccuugggugggcggagga

SEQ ID NO: 16632 - RNA, 24 nt, Artificial Sequence
  Synthetic
uaagcaccuugggugggcggagga

SEQ ID NO: 16633 - RNA, 18 nt, Artificial Sequence
  Synthetic
ggcugcggagcacgcgga

SEQ ID NO: 16634 - RNA, 19 nt, Artificial Sequence
  Synthetic
cggcugcggagcacgcgga

SEQ ID NO: 16635 - RNA, 20 nt, Artificial Sequence
  Synthetic
gcggcugcggagcacgcgga

SEQ ID NO: 16636 - RNA, 21 nt, Artificial Sequence
  Synthetic
agcggcugcggagcacgcgga

SEQ ID NO: 16637 - RNA, 22 nt, Artificial Sequence
  Synthetic
gagcggcugcggagcacgcgga

SEQ ID NO: 16638 - RNA, 23 nt, Artificial Sequence
  Synthetic
ggagcggcugcggagcacgcgga

SEQ ID NO: 16639 - RNA, 24 nt, Artificial Sequence
  Synthetic
gggagcggcugcggagcacgcgga

SEQ ID NO: 16640 - RNA, 18 nt, Artificial Sequence
  Synthetic
gaucgggaucgcaucgga

SEQ ID NO: 16641 - RNA, 19 nt, Artificial Sequence
  Synthetic
ggaucgggaucgcaucgga

SEQ ID NO: 16642 - RNA, 20 nt, Artificial Sequence
  Synthetic
gggaucgggaucgcaucgga

SEQ ID NO: 16643 - RNA, 21 nt, Artificial Sequence
  Synthetic
cgggaucgggaucgcaucgga

SEQ ID NO: 16644 - RNA, 22 nt, Artificial Sequence
  Synthetic
ucgggaucgggaucgcaucgga

SEQ ID NO: 16645 - RNA, 23 nt, Artificial Sequence
  Synthetic
cucgggaucgggaucgcaucgga

SEQ ID NO: 16646 - RNA, 24 nt, Artificial Sequence
  Synthetic
gcucgggaucgggaucgcaucgga

SEQ ID NO: 16647 - RNA, 18 nt, Artificial Sequence
  Synthetic
ucgcagagggccgucgga

SEQ ID NO: 16648 - RNA, 19 nt, Artificial Sequence
  Synthetic
gucgcagagggccgucgga

SEQ ID NO: 16649 - RNA, 20 nt, Artificial Sequence
  Synthetic
agucgcagagggccgucgga

SEQ ID NO: 16650 - RNA, 21 nt, Artificial Sequence
  Synthetic
gagucgcagagggccgucgga

SEQ ID NO: 16651 - RNA, 22 nt, Artificial Sequence
  Synthetic
ggagucgcagagggccgucgga

SEQ ID NO: 16652 - RNA, 23 nt, Artificial Sequence
  Synthetic
gggagucgcagagggccgucgga

SEQ ID NO: 16653 - RNA, 24 nt, Artificial Sequence
  Synthetic
cgggagucgcagagggccgucgga

SEQ ID NO: 16654 - RNA, 18 nt, Artificial Sequence
  Synthetic
ggagcacgcggaccggga

SEQ ID NO: 16655 - RNA, 19 nt, Artificial Sequence
  Synthetic
cggagcacgcggaccggga

SEQ ID NO: 16656 - RNA, 20 nt, Artificial Sequence
  Synthetic
gcggagcacgcggaccggga

SEQ ID NO: 16657 - RNA, 21 nt, Artificial Sequence
  Synthetic
ugcggagcacgcggaccggga

SEQ ID NO: 16658 - RNA, 22 nt, Artificial Sequence
  Synthetic
cugcggagcacgcggaccggga

SEQ ID NO: 16659 - RNA, 23 nt, Artificial Sequence
  Synthetic
gcugcggagcacgcggaccggga

SEQ ID NO: 16660 - RNA, 24 nt, Artificial Sequence
  Synthetic
ggcugcggagcacgcggaccggga

SEQ ID NO: 16661 - RNA, 18 nt, Artificial Sequence
  Synthetic
cgacgccccggcucggga

SEQ ID NO: 16662 - RNA, 19 nt, Artificial Sequence
  Synthetic
gcgacgccccggcucggga

SEQ ID NO: 16663 - RNA, 20 nt, Artificial Sequence
  Synthetic
cgcgacgccccggcucggga

SEQ ID NO: 16664 - RNA, 21 nt, Artificial Sequence
  Synthetic
ucgcgacgccccggcucggga

SEQ ID NO: 16665 - RNA, 22 nt, Artificial Sequence
  Synthetic
aucgcgacgccccggcucggga

SEQ ID NO: 16666 - RNA, 23 nt, Artificial Sequence
  Synthetic
caucgcgacgccccggcucggga

SEQ ID NO: 16667 - RNA, 24 nt, Artificial Sequence
  Synthetic
gcaucgcgacgccccggcucggga

SEQ ID NO: 16668 - RNA, 18 nt, Artificial Sequence
  Synthetic
ccggauacgcgccgcgua

SEQ ID NO: 16669 - RNA, 19 nt, Artificial Sequence
  Synthetic
uccggauacgcgccgcgua

SEQ ID NO: 16670 - RNA, 20 nt, Artificial Sequence
  Synthetic
guccggauacgcgccgcgua

SEQ ID NO: 16671 - RNA, 21 nt, Artificial Sequence
  Synthetic
gguccggauacgcgccgcgua

SEQ ID NO: 16672 - RNA, 22 nt, Artificial Sequence
  Synthetic
ggguccggauacgcgccgcgua

SEQ ID NO: 16673 - RNA, 23 nt, Artificial Sequence
  Synthetic
gggguccggauacgcgccgcgua

SEQ ID NO: 16674 - RNA, 24 nt, Artificial Sequence
  Synthetic
ugggguccggauacgcgccgcgua

SEQ ID NO: 16675 - RNA, 18 nt, Artificial Sequence
  Synthetic
gguaaaagaagugagaac

SEQ ID NO: 16676 - RNA, 19 nt, Artificial Sequence
  Synthetic
ggguaaaagaagugagaac

SEQ ID NO: 16677 - RNA, 20 nt, Artificial Sequence
  Synthetic
cggguaaaagaagugagaac

SEQ ID NO: 16678 - RNA, 21 nt, Artificial Sequence
  Synthetic
ccggguaaaagaagugagaac

SEQ ID NO: 16679 - RNA, 22 nt, Artificial Sequence
  Synthetic
gccggguaaaagaagugagaac

SEQ ID NO: 16680 - RNA, 23 nt, Artificial Sequence
  Synthetic
cgccggguaaaagaagugagaac

SEQ ID NO: 16681 - RNA, 24 nt, Artificial Sequence
  Synthetic
ccgccggguaaaagaagugagaac

SEQ ID NO: 16682 - RNA, 18 nt, Artificial Sequence
  Synthetic
accccacccacgaaacac

SEQ ID NO: 16683 - RNA, 19 nt, Artificial Sequence
  Synthetic
caccccacccacgaaacac

SEQ ID NO: 16684 - RNA, 20 nt, Artificial Sequence
  Synthetic
ccaccccacccacgaaacac

SEQ ID NO: 16685 - RNA, 21 nt, Artificial Sequence
  Synthetic
cccaccccacccacgaaacac

SEQ ID NO: 16686 - RNA, 22 nt, Artificial Sequence
  Synthetic
gcccaccccacccacgaaacac

SEQ ID NO: 16687 - RNA, 23 nt, Artificial Sequence
  Synthetic
cgcccaccccacccacgaaacac

SEQ ID NO: 16688 - RNA, 24 nt, Artificial Sequence
  Synthetic
ccgcccaccccacccacgaaacac

SEQ ID NO: 16689 - RNA, 18 nt, Artificial Sequence
  Synthetic
cgcaucggaaagggacac

SEQ ID NO: 16690 - RNA, 19 nt, Artificial Sequence
  Synthetic
ucgcaucggaaagggacac

SEQ ID NO: 16691 - RNA, 20 nt, Artificial Sequence
  Synthetic
aucgcaucggaaagggacac

SEQ ID NO: 16692 - RNA, 21 nt, Artificial Sequence
  Synthetic
gaucgcaucggaaagggacac

SEQ ID NO: 16693 - RNA, 22 nt, Artificial Sequence
  Synthetic
ggaucgcaucggaaagggacac

SEQ ID NO: 16694 - RNA, 23 nt, Artificial Sequence
  Synthetic
gggaucgcaucggaaagggacac

SEQ ID NO: 16695 - RNA, 24 nt, Artificial Sequence
  Synthetic
cgggaucgcaucggaaagggacac

SEQ ID NO: 16696 - RNA, 18 nt, Artificial Sequence
  Synthetic
ggagcggcugcggagcac

SEQ ID NO: 16697 - RNA, 19 nt, Artificial Sequence
  Synthetic
gggagcggcugcggagcac

SEQ ID NO: 16698 - RNA, 20 nt, Artificial Sequence
  Synthetic
cgggagcggcugcggagcac

SEQ ID NO: 16699 - RNA, 21 nt, Artificial Sequence
  Synthetic
acgggagcggcugcggagcac

SEQ ID NO: 16700 - RNA, 22 nt, Artificial Sequence
  Synthetic
gacgggagcggcugcggagcac

SEQ ID NO: 16701 - RNA, 23 nt, Artificial Sequence
  Synthetic
cgacgggagcggcugcggagcac

SEQ ID NO: 16702 - RNA, 24 nt, Artificial Sequence
  Synthetic
acgacgggagcggcugcggagcac

SEQ ID NO: 16703 - RNA, 18 nt, Artificial Sequence
  Synthetic
gcgccggccacgaacgac

SEQ ID NO: 16704 - RNA, 19 nt, Artificial Sequence
  Synthetic
ggcgccggccacgaacgac

SEQ ID NO: 16705 - RNA, 20 nt, Artificial Sequence
  Synthetic
cggcgccggccacgaacgac

SEQ ID NO: 16706 - RNA, 21 nt, Artificial Sequence
  Synthetic
acggcgccggccacgaacgac

SEQ ID NO: 16707 - RNA, 22 nt, Artificial Sequence
  Synthetic
gacggcgccggccacgaacgac

SEQ ID NO: 16708 - RNA, 23 nt, Artificial Sequence
  Synthetic
agacggcgccggccacgaacgac

SEQ ID NO: 16709 - RNA, 24 nt, Artificial Sequence
  Synthetic
cagacggcgccggccacgaacgac

SEQ ID NO: 16710 - RNA, 18 nt, Artificial Sequence
  Synthetic
gaagaggaugcggacgac

SEQ ID NO: 16711 - RNA, 19 nt, Artificial Sequence
  Synthetic
cgaagaggaugcggacgac

SEQ ID NO: 16712 - RNA, 20 nt, Artificial Sequence
  Synthetic
acgaagaggaugcggacgac

SEQ ID NO: 16713 - RNA, 21 nt, Artificial Sequence
  Synthetic
gacgaagaggaugcggacgac

SEQ ID NO: 16714 - RNA, 22 nt, Artificial Sequence
  Synthetic
ggacgaagaggaugcggacgac

SEQ ID NO: 16715 - RNA, 23 nt, Artificial Sequence
  Synthetic
aggacgaagaggaugcggacgac

SEQ ID NO: 16716 - RNA, 24 nt, Artificial Sequence
  Synthetic
gaggacgaagaggaugcggacgac

SEQ ID NO: 16717 - RNA, 18 nt, Artificial Sequence
  Synthetic
ucguccucgucggacgac

SEQ ID NO: 16718 - RNA, 19 nt, Artificial Sequence
  Synthetic
cucguccucgucggacgac

SEQ ID NO: 16719 - RNA, 20 nt, Artificial Sequence
  Synthetic
ccucguccucgucggacgac

SEQ ID NO: 16720 - RNA, 21 nt, Artificial Sequence
  Synthetic
uccucguccucgucggacgac

SEQ ID NO: 16721 - RNA, 22 nt, Artificial Sequence
  Synthetic
guccucguccucgucggacgac

SEQ ID NO: 16722 - RNA, 23 nt, Artificial Sequence
  Synthetic
cguccucguccucgucggacgac

SEQ ID NO: 16723 - RNA, 24 nt, Artificial Sequence
  Synthetic
ucguccucguccucgucggacgac

SEQ ID NO: 16724 - RNA, 18 nt, Artificial Sequence
  Synthetic
gaugcggacgacgaggac

SEQ ID NO: 16725 - RNA, 19 nt, Artificial Sequence
  Synthetic
ggaugcggacgacgaggac

SEQ ID NO: 16726 - RNA, 20 nt, Artificial Sequence
  Synthetic
aggaugcggacgacgaggac

SEQ ID NO: 16727 - RNA, 21 nt, Artificial Sequence
  Synthetic
gaggaugcggacgacgaggac

SEQ ID NO: 16728 - RNA, 22 nt, Artificial Sequence
  Synthetic
agaggaugcggacgacgaggac

SEQ ID NO: 16729 - RNA, 23 nt, Artificial Sequence
  Synthetic
aagaggaugcggacgacgaggac

SEQ ID NO: 16730 - RNA, 24 nt, Artificial Sequence
  Synthetic
gaagaggaugcggacgacgaggac

SEQ ID NO: 16731 - RNA, 18 nt, Artificial Sequence
  Synthetic
gacgacgaggacgaggac

SEQ ID NO: 16732 - RNA, 19 nt, Artificial Sequence
  Synthetic
ggacgacgaggacgaggac

SEQ ID NO: 16733 - RNA, 20 nt, Artificial Sequence
  Synthetic
cggacgacgaggacgaggac

SEQ ID NO: 16734 - RNA, 21 nt, Artificial Sequence
  Synthetic
gcggacgacgaggacgaggac

SEQ ID NO: 16735 - RNA, 22 nt, Artificial Sequence
  Synthetic
ugcggacgacgaggacgaggac

SEQ ID NO: 16736 - RNA, 23 nt, Artificial Sequence
  Synthetic
augcggacgacgaggacgaggac

SEQ ID NO: 16737 - RNA, 24 nt, Artificial Sequence
  Synthetic
gaugcggacgacgaggacgaggac

SEQ ID NO: 16738 - RNA, 18 nt, Artificial Sequence
  Synthetic
ggaaagggacacgcggac

SEQ ID NO: 16739 - RNA, 19 nt, Artificial Sequence
  Synthetic
cggaaagggacacgcggac

SEQ ID NO: 16740 - RNA, 20 nt, Artificial Sequence
  Synthetic
ucggaaagggacacgcggac

SEQ ID NO: 16741 - RNA, 21 nt, Artificial Sequence
  Synthetic
aucggaaagggacacgcggac

SEQ ID NO: 16742 - RNA, 22 nt, Artificial Sequence
  Synthetic
caucggaaagggacacgcggac

SEQ ID NO: 16743 - RNA, 23 nt, Artificial Sequence
  Synthetic
gcaucggaaagggacacgcggac

SEQ ID NO: 16744 - RNA, 24 nt, Artificial Sequence
  Synthetic
cgcaucggaaagggacacgcggac

SEQ ID NO: 16745 - RNA, 18 nt, Artificial Sequence
  Synthetic
gcugcggagcacgcggac

SEQ ID NO: 16746 - RNA, 19 nt, Artificial Sequence
  Synthetic
ggcugcggagcacgcggac

SEQ ID NO: 16747 - RNA, 20 nt, Artificial Sequence
  Synthetic
cggcugcggagcacgcggac

SEQ ID NO: 16748 - RNA, 21 nt, Artificial Sequence
  Synthetic
gcggcugcggagcacgcggac

SEQ ID NO: 16749 - RNA, 22 nt, Artificial Sequence
  Synthetic
agcggcugcggagcacgcggac

SEQ ID NO: 16750 - RNA, 23 nt, Artificial Sequence
  Synthetic
gagcggcugcggagcacgcggac

SEQ ID NO: 16751 - RNA, 24 nt, Artificial Sequence
  Synthetic
ggagcggcugcggagcacgcggac

SEQ ID NO: 16752 - RNA, 18 nt, Artificial Sequence
  Synthetic
ggcggaggagggggggac

SEQ ID NO: 16753 - RNA, 19 nt, Artificial Sequence
  Synthetic
gggcggaggagggggggac

SEQ ID NO: 16754 - RNA, 20 nt, Artificial Sequence
  Synthetic
ugggcggaggagggggggac

SEQ ID NO: 16755 - RNA, 21 nt, Artificial Sequence
  Synthetic
gugggcggaggagggggggac

SEQ ID NO: 16756 - RNA, 22 nt, Artificial Sequence
  Synthetic
ggugggcggaggagggggggac

SEQ ID NO: 16757 - RNA, 23 nt, Artificial Sequence
  Synthetic
gggugggcggaggagggggggac

SEQ ID NO: 16758 - RNA, 24 nt, Artificial Sequence
  Synthetic
ugggugggcggaggagggggggac

SEQ ID NO: 16759 - RNA, 18 nt, Artificial Sequence
  Synthetic
aaacacaggggacgcacc

SEQ ID NO: 16760 - RNA, 19 nt, Artificial Sequence
  Synthetic
gaaacacaggggacgcacc

SEQ ID NO: 16761 - RNA, 20 nt, Artificial Sequence
  Synthetic
cgaaacacaggggacgcacc

SEQ ID NO: 16762 - RNA, 21 nt, Artificial Sequence
  Synthetic
acgaaacacaggggacgcacc

SEQ ID NO: 16763 - RNA, 22 nt, Artificial Sequence
  Synthetic
cacgaaacacaggggacgcacc

SEQ ID NO: 16764 - RNA, 23 nt, Artificial Sequence
  Synthetic
ccacgaaacacaggggacgcacc

SEQ ID NO: 16765 - RNA, 24 nt, Artificial Sequence
  Synthetic
cccacgaaacacaggggacgcacc

SEQ ID NO: 16766 - RNA, 18 nt, Artificial Sequence
  Synthetic
cugcggagcacgcggacc

SEQ ID NO: 16767 - RNA, 19 nt, Artificial Sequence
  Synthetic
gcugcggagcacgcggacc

SEQ ID NO: 16768 - RNA, 20 nt, Artificial Sequence
  Synthetic
ggcugcggagcacgcggacc

SEQ ID NO: 16769 - RNA, 21 nt, Artificial Sequence
  Synthetic
cggcugcggagcacgcggacc

SEQ ID NO: 16770 - RNA, 22 nt, Artificial Sequence
  Synthetic
gcggcugcggagcacgcggacc

SEQ ID NO: 16771 - RNA, 23 nt, Artificial Sequence
  Synthetic
agcggcugcggagcacgcggacc

SEQ ID NO: 16772 - RNA, 24 nt, Artificial Sequence
  Synthetic
gagcggcugcggagcacgcggacc

SEQ ID NO: 16773 - RNA, 18 nt, Artificial Sequence
  Synthetic
cggacggccuccucuacc

SEQ ID NO: 16774 - RNA, 19 nt, Artificial Sequence
  Synthetic
ccggacggccuccucuacc

SEQ ID NO: 16775 - RNA, 20 nt, Artificial Sequence
  Synthetic
uccggacggccuccucuacc

SEQ ID NO: 16776 - RNA, 21 nt, Artificial Sequence
  Synthetic
guccggacggccuccucuacc

SEQ ID NO: 16777 - RNA, 22 nt, Artificial Sequence
  Synthetic
cguccggacggccuccucuacc

SEQ ID NO: 16778 - RNA, 23 nt, Artificial Sequence
  Synthetic
ucguccggacggccuccucuacc

SEQ ID NO: 16779 - RNA, 24 nt, Artificial Sequence
  Synthetic
aucguccggacggccuccucuacc

SEQ ID NO: 16780 - RNA, 18 nt, Artificial Sequence
  Synthetic
gacccgcccaccccaccc

SEQ ID NO: 16781 - RNA, 19 nt, Artificial Sequence
  Synthetic
agacccgcccaccccaccc

SEQ ID NO: 16782 - RNA, 20 nt, Artificial Sequence
  Synthetic
aagacccgcccaccccaccc

SEQ ID NO: 16783 - RNA, 21 nt, Artificial Sequence
  Synthetic
aaagacccgcccaccccaccc

SEQ ID NO: 16784 - RNA, 22 nt, Artificial Sequence
  Synthetic
gaaagacccgcccaccccaccc

SEQ ID NO: 16785 - RNA, 23 nt, Artificial Sequence
  Synthetic
ggaaagacccgcccaccccaccc

SEQ ID NO: 16786 - RNA, 24 nt, Artificial Sequence
  Synthetic
gggaaagacccgcccaccccaccc

SEQ ID NO: 16787 - RNA, 18 nt, Artificial Sequence
  Synthetic
aacacaggggacgcaccc

SEQ ID NO: 16788 - RNA, 19 nt, Artificial Sequence
  Synthetic
aaacacaggggacgcaccc

SEQ ID NO: 16789 - RNA, 20 nt, Artificial Sequence
  Synthetic
gaaacacaggggacgcaccc

SEQ ID NO: 16790 - RNA, 21 nt, Artificial Sequence
  Synthetic
cgaaacacaggggacgcaccc

SEQ ID NO: 16791 - RNA, 22 nt, Artificial Sequence
  Synthetic
acgaaacacaggggacgcaccc

SEQ ID NO: 16792 - RNA, 23 nt, Artificial Sequence
  Synthetic
cacgaaacacaggggacgcaccc

SEQ ID NO: 16793 - RNA, 24 nt, Artificial Sequence
  Synthetic
ccacgaaacacaggggacgcaccc

SEQ ID NO: 16794 - RNA, 18 nt, Artificial Sequence
  Synthetic
acacaggggacgcacccc

SEQ ID NO: 16795 - RNA, 19 nt, Artificial Sequence
  Synthetic
aacacaggggacgcacccc

SEQ ID NO: 16796 - RNA, 20 nt, Artificial Sequence
  Synthetic
aaacacaggggacgcacccc

SEQ ID NO: 16797 - RNA, 21 nt, Artificial Sequence
  Synthetic
gaaacacaggggacgcacccc

SEQ ID NO: 16798 - RNA, 22 nt, Artificial Sequence
  Synthetic
cgaaacacaggggacgcacccc

SEQ ID NO: 16799 - RNA, 23 nt, Artificial Sequence
  Synthetic
acgaaacacaggggacgcacccc

SEQ ID NO: 16800 - RNA, 24 nt, Artificial Sequence
  Synthetic
cacgaaacacaggggacgcacccc

SEQ ID NO: 16801 - RNA, 18 nt, Artificial Sequence
  Synthetic
cgacuccgcgccggcccc

SEQ ID NO: 16802 - RNA, 19 nt, Artificial Sequence
  Synthetic
ccgacuccgcgccggcccc

SEQ ID NO: 16803 - RNA, 20 nt, Artificial Sequence
  Synthetic
cccgacuccgcgccggcccc

SEQ ID NO: 16804 - RNA, 21 nt, Artificial Sequence
  Synthetic
gcccgacuccgcgccggcccc

SEQ ID NO: 16805 - RNA, 22 nt, Artificial Sequence
  Synthetic
ugcccgacuccgcgccggcccc

SEQ ID NO: 16806 - RNA, 23 nt, Artificial Sequence
  Synthetic
gugcccgacuccgcgccggcccc

SEQ ID NO: 16807 - RNA, 24 nt, Artificial Sequence
  Synthetic
cgugcccgacuccgcgccggcccc

SEQ ID NO: 16808 - RNA, 18 nt, Artificial Sequence
  Synthetic
ccgacuccgcgccggccc

SEQ ID NO: 16809 - RNA, 19 nt, Artificial Sequence
  Synthetic
cccgacuccgcgccggccc

SEQ ID NO: 16810 - RNA, 20 nt, Artificial Sequence
  Synthetic
gcccgacuccgcgccggccc

SEQ ID NO: 16811 - RNA, 21 nt, Artificial Sequence
  Synthetic
ugcccgacuccgcgccggccc

SEQ ID NO: 16812 - RNA, 22 nt, Artificial Sequence
  Synthetic
gugcccgacuccgcgccggccc

SEQ ID NO: 16813 - RNA, 23 nt, Artificial Sequence
  Synthetic
cgugcccgacuccgcgccggccc

SEQ ID NO: 16814 - RNA, 24 nt, Artificial Sequence
  Synthetic
ccgugcccgacuccgcgccggccc

SEQ ID NO: 16815 - RNA, 18 nt, Artificial Sequence
  Synthetic
guccggggcggcgaggcc

SEQ ID NO: 16816 - RNA, 19 nt, Artificial Sequence
  Synthetic
gguccggggcggcgaggcc

SEQ ID NO: 16817 - RNA, 20 nt, Artificial Sequence
  Synthetic
ggguccggggcggcgaggcc

SEQ ID NO: 16818 - RNA, 21 nt, Artificial Sequence
  Synthetic
gggguccggggcggcgaggcc

SEQ ID NO: 16819 - RNA, 22 nt, Artificial Sequence
  Synthetic
ggggguccggggcggcgaggcc

SEQ ID NO: 16820 - RNA, 23 nt, Artificial Sequence
  Synthetic
cggggguccggggcggcgaggcc

SEQ ID NO: 16821 - RNA, 24 nt, Artificial Sequence
  Synthetic
gcggggguccggggcggcgaggcc

SEQ ID NO: 16822 - RNA, 18 nt, Artificial Sequence
  Synthetic
cccgacuccgcgccggcc

SEQ ID NO: 16823 - RNA, 19 nt, Artificial Sequence
  Synthetic
gcccgacuccgcgccggcc

SEQ ID NO: 16824 - RNA, 20 nt, Artificial Sequence
  Synthetic
ugcccgacuccgcgccggcc

SEQ ID NO: 16825 - RNA, 21 nt, Artificial Sequence
  Synthetic
gugcccgacuccgcgccggcc

SEQ ID NO: 16826 - RNA, 22 nt, Artificial Sequence
  Synthetic
cgugcccgacuccgcgccggcc

SEQ ID NO: 16827 - RNA, 23 nt, Artificial Sequence
  Synthetic
ccgugcccgacuccgcgccggcc

SEQ ID NO: 16828 - RNA, 24 nt, Artificial Sequence
  Synthetic
gccgugcccgacuccgcgccggcc

SEQ ID NO: 16829 - RNA, 18 nt, Artificial Sequence
  Synthetic
ccgcagacggcgccggcc

SEQ ID NO: 16830 - RNA, 19 nt, Artificial Sequence
  Synthetic
cccgcagacggcgccggcc

SEQ ID NO: 16831 - RNA, 20 nt, Artificial Sequence
  Synthetic
gcccgcagacggcgccggcc

SEQ ID NO: 16832 - RNA, 21 nt, Artificial Sequence
  Synthetic
cgcccgcagacggcgccggcc

SEQ ID NO: 16833 - RNA, 22 nt, Artificial Sequence
  Synthetic
acgcccgcagacggcgccggcc

SEQ ID NO: 16834 - RNA, 23 nt, Artificial Sequence
  Synthetic
gacgcccgcagacggcgccggcc

SEQ ID NO: 16835 - RNA, 24 nt, Artificial Sequence
  Synthetic
cgacgcccgcagacggcgccggcc

SEQ ID NO: 16836 - RNA, 18 nt, Artificial Sequence
  Synthetic
ggccucccguucgcggcc

SEQ ID NO: 16837 - RNA, 19 nt, Artificial Sequence
  Synthetic
gggccucccguucgcggcc

SEQ ID NO: 16838 - RNA, 20 nt, Artificial Sequence
  Synthetic
ggggccucccguucgcggcc

SEQ ID NO: 16839 - RNA, 21 nt, Artificial Sequence
  Synthetic
cggggccucccguucgcggcc

SEQ ID NO: 16840 - RNA, 22 nt, Artificial Sequence
  Synthetic
gcggggccucccguucgcggcc

SEQ ID NO: 16841 - RNA, 23 nt, Artificial Sequence
  Synthetic
agcggggccucccguucgcggcc

SEQ ID NO: 16842 - RNA, 24 nt, Artificial Sequence
  Synthetic
uagcggggccucccguucgcggcc

SEQ ID NO: 16843 - RNA, 18 nt, Artificial Sequence
  Synthetic
cgcggcgacaggcggucc

SEQ ID NO: 16844 - RNA, 19 nt, Artificial Sequence
  Synthetic
gcgcggcgacaggcggucc

SEQ ID NO: 16845 - RNA, 20 nt, Artificial Sequence
  Synthetic
ggcgcggcgacaggcggucc

SEQ ID NO: 16846 - RNA, 21 nt, Artificial Sequence
  Synthetic
gggcgcggcgacaggcggucc

SEQ ID NO: 16847 - RNA, 22 nt, Artificial Sequence
  Synthetic
cgggcgcggcgacaggcggucc

SEQ ID NO: 16848 - RNA, 23 nt, Artificial Sequence
  Synthetic
gcgggcgcggcgacaggcggucc

SEQ ID NO: 16849 - RNA, 24 nt, Artificial Sequence
  Synthetic
ggcgggcgcggcgacaggcggucc

SEQ ID NO: 16850 - RNA, 18 nt, Artificial Sequence
  Synthetic
aaagggacacgcggacgc

SEQ ID NO: 16851 - RNA, 19 nt, Artificial Sequence
  Synthetic
gaaagggacacgcggacgc

SEQ ID NO: 16852 - RNA, 20 nt, Artificial Sequence
  Synthetic
ggaaagggacacgcggacgc

SEQ ID NO: 16853 - RNA, 21 nt, Artificial Sequence
  Synthetic
cggaaagggacacgcggacgc

SEQ ID NO: 16854 - RNA, 22 nt, Artificial Sequence
  Synthetic
ucggaaagggacacgcggacgc

SEQ ID NO: 16855 - RNA, 23 nt, Artificial Sequence
  Synthetic
aucggaaagggacacgcggacgc

SEQ ID NO: 16856 - RNA, 24 nt, Artificial Sequence
  Synthetic
caucggaaagggacacgcggacgc

SEQ ID NO: 16857 - RNA, 18 nt, Artificial Sequence
  Synthetic
cggaggagggggggacgc

SEQ ID NO: 16858 - RNA, 19 nt, Artificial Sequence
  Synthetic
gcggaggagggggggacgc

SEQ ID NO: 16859 - RNA, 20 nt, Artificial Sequence
  Synthetic
ggcggaggagggggggacgc

SEQ ID NO: 16860 - RNA, 21 nt, Artificial Sequence
  Synthetic
gggcggaggagggggggacgc

SEQ ID NO: 16861 - RNA, 22 nt, Artificial Sequence
  Synthetic
ugggcggaggagggggggacgc

SEQ ID NO: 16862 - RNA, 23 nt, Artificial Sequence
  Synthetic
gugggcggaggagggggggacgc

SEQ ID NO: 16863 - RNA, 24 nt, Artificial Sequence
  Synthetic
ggugggcggaggagggggggacgc

SEQ ID NO: 16864 - RNA, 18 nt, Artificial Sequence
  Synthetic
gcaucgcgacgccccggc

SEQ ID NO: 16865 - RNA, 19 nt, Artificial Sequence
  Synthetic
ggcaucgcgacgccccggc

SEQ ID NO: 16866 - RNA, 20 nt, Artificial Sequence
  Synthetic
cggcaucgcgacgccccggc

SEQ ID NO: 16867 - RNA, 21 nt, Artificial Sequence
  Synthetic
ucggcaucgcgacgccccggc

SEQ ID NO: 16868 - RNA, 22 nt, Artificial Sequence
  Synthetic
gucggcaucgcgacgccccggc

SEQ ID NO: 16869 - RNA, 23 nt, Artificial Sequence
  Synthetic
cgucggcaucgcgacgccccggc

SEQ ID NO: 16870 - RNA, 24 nt, Artificial Sequence
  Synthetic
gcgucggcaucgcgacgccccggc

SEQ ID NO: 16871 - RNA, 18 nt, Artificial Sequence
  Synthetic
ggggcgggcccgggcggc

SEQ ID NO: 16872 - RNA, 19 nt, Artificial Sequence
  Synthetic
gggggcgggcccgggcggc

SEQ ID NO: 16873 - RNA, 20 nt, Artificial Sequence
  Synthetic
cgggggcgggcccgggcggc

SEQ ID NO: 16874 - RNA, 21 nt, Artificial Sequence
  Synthetic
ccgggggcgggcccgggcggc

SEQ ID NO: 16875 - RNA, 22 nt, Artificial Sequence
  Synthetic
cccgggggcgggcccgggcggc

SEQ ID NO: 16876 - RNA, 23 nt, Artificial Sequence
  Synthetic
ccccgggggcgggcccgggcggc

SEQ ID NO: 16877 - RNA, 24 nt, Artificial Sequence
  Synthetic
gccccgggggcgggcccgggcggc

SEQ ID NO: 16878 - RNA, 18 nt, Artificial Sequence
  Synthetic
cccgucaucgucgucggc

SEQ ID NO: 16879 - RNA, 19 nt, Artificial Sequence
  Synthetic
ccccgucaucgucgucggc

SEQ ID NO: 16880 - RNA, 20 nt, Artificial Sequence
  Synthetic
uccccgucaucgucgucggc

SEQ ID NO: 16881 - RNA, 21 nt, Artificial Sequence
  Synthetic
guccccgucaucgucgucggc

SEQ ID NO: 16882 - RNA, 22 nt, Artificial Sequence
  Synthetic
cguccccgucaucgucgucggc

SEQ ID NO: 16883 - RNA, 23 nt, Artificial Sequence
  Synthetic
ucguccccgucaucgucgucggc

SEQ ID NO: 16884 - RNA, 24 nt, Artificial Sequence
  Synthetic
cucguccccgucaucgucgucggc

SEQ ID NO: 16885 - RNA, 18 nt, Artificial Sequence
  Synthetic
ccguucgcggccccgggc

SEQ ID NO: 16886 - RNA, 19 nt, Artificial Sequence
  Synthetic
cccguucgcggccccgggc

SEQ ID NO: 16887 - RNA, 20 nt, Artificial Sequence
  Synthetic
ucccguucgcggccccgggc

SEQ ID NO: 16888 - RNA, 21 nt, Artificial Sequence
  Synthetic
cucccguucgcggccccgggc

SEQ ID NO: 16889 - RNA, 22 nt, Artificial Sequence
  Synthetic
ccucccguucgcggccccgggc

SEQ ID NO: 16890 - RNA, 23 nt, Artificial Sequence
  Synthetic
gccucccguucgcggccccgggc

SEQ ID NO: 16891 - RNA, 24 nt, Artificial Sequence
  Synthetic
ggccucccguucgcggccccgggc

SEQ ID NO: 16892 - RNA, 18 nt, Artificial Sequence
  Synthetic
ccggccccgggggcgggc

SEQ ID NO: 16893 - RNA, 19 nt, Artificial Sequence
  Synthetic
gccggccccgggggcgggc

SEQ ID NO: 16894 - RNA, 20 nt, Artificial Sequence
  Synthetic
cgccggccccgggggcgggc

SEQ ID NO: 16895 - RNA, 21 nt, Artificial Sequence
  Synthetic
gcgccggccccgggggcgggc

SEQ ID NO: 16896 - RNA, 22 nt, Artificial Sequence
  Synthetic
cgcgccggccccgggggcgggc

SEQ ID NO: 16897 - RNA, 23 nt, Artificial Sequence
  Synthetic
ccgcgccggccccgggggcgggc

SEQ ID NO: 16898 - RNA, 24 nt, Artificial Sequence
  Synthetic
uccgcgccggccccgggggcgggc

SEQ ID NO: 16899 - RNA, 18 nt, Artificial Sequence
  Synthetic
gcucgaaaggcggggguc

SEQ ID NO: 16900 - RNA, 19 nt, Artificial Sequence
  Synthetic
ggcucgaaaggcggggguc

SEQ ID NO: 16901 - RNA, 20 nt, Artificial Sequence
  Synthetic
cggcucgaaaggcggggguc

SEQ ID NO: 16902 - RNA, 21 nt, Artificial Sequence
  Synthetic
ucggcucgaaaggcggggguc

SEQ ID NO: 16903 - RNA, 22 nt, Artificial Sequence
  Synthetic
gucggcucgaaaggcggggguc

SEQ ID NO: 16904 - RNA, 23 nt, Artificial Sequence
  Synthetic
cgucggcucgaaaggcggggguc

SEQ ID NO: 16905 - RNA, 24 nt, Artificial Sequence
  Synthetic
ucgucggcucgaaaggcggggguc

SEQ ID NO: 16906 - RNA, 18 nt, Artificial Sequence
  Synthetic
ucgucgucggcucgaaag

SEQ ID NO: 16907 - RNA, 19 nt, Artificial Sequence
  Synthetic
aucgucgucggcucgaaag

SEQ ID NO: 16908 - RNA, 20 nt, Artificial Sequence
  Synthetic
caucgucgucggcucgaaag

SEQ ID NO: 16909 - RNA, 21 nt, Artificial Sequence
  Synthetic
ucaucgucgucggcucgaaag

SEQ ID NO: 16910 - RNA, 22 nt, Artificial Sequence
  Synthetic
gucaucgucgucggcucgaaag

SEQ ID NO: 16911 - RNA, 23 nt, Artificial Sequence
  Synthetic
cgucaucgucgucggcucgaaag

SEQ ID NO: 16912 - RNA, 24 nt, Artificial Sequence
  Synthetic
ccgucaucgucgucggcucgaaag

SEQ ID NO: 16913 - RNA, 18 nt, Artificial Sequence
  Synthetic
cucuaccauggaggccag

SEQ ID NO: 16914 - RNA, 19 nt, Artificial Sequence
  Synthetic
ccucuaccauggaggccag

SEQ ID NO: 16915 - RNA, 20 nt, Artificial Sequence
  Synthetic
uccucuaccauggaggccag

SEQ ID NO: 16916 - RNA, 21 nt, Artificial Sequence
  Synthetic
cuccucuaccauggaggccag

SEQ ID NO: 16917 - RNA, 22 nt, Artificial Sequence
  Synthetic
ccuccucuaccauggaggccag

SEQ ID NO: 16918 - RNA, 23 nt, Artificial Sequence
  Synthetic
gccuccucuaccauggaggccag

SEQ ID NO: 16919 - RNA, 24 nt, Artificial Sequence
  Synthetic
ggccuccucuaccauggaggccag

SEQ ID NO: 16920 - RNA, 18 nt, Artificial Sequence
  Synthetic
gacgcgggggcggaggag

SEQ ID NO: 16921 - RNA, 19 nt, Artificial Sequence
  Synthetic
ggacgcgggggcggaggag

SEQ ID NO: 16922 - RNA, 20 nt, Artificial Sequence
  Synthetic
gggacgcgggggcggaggag

SEQ ID NO: 16923 - RNA, 21 nt, Artificial Sequence
  Synthetic
ggggacgcgggggcggaggag

SEQ ID NO: 16924 - RNA, 22 nt, Artificial Sequence
  Synthetic
gggggacgcgggggcggaggag

SEQ ID NO: 16925 - RNA, 23 nt, Artificial Sequence
  Synthetic
ggggggacgcgggggcggaggag

SEQ ID NO: 16926 - RNA, 24 nt, Artificial Sequence
  Synthetic
gggggggacgcgggggcggaggag

SEQ ID NO: 16927 - RNA, 18 nt, Artificial Sequence
  Synthetic
cuugggugggcggaggag

SEQ ID NO: 16928 - RNA, 19 nt, Artificial Sequence
  Synthetic
ccuugggugggcggaggag

SEQ ID NO: 16929 - RNA, 20 nt, Artificial Sequence
  Synthetic
accuugggugggcggaggag

SEQ ID NO: 16930 - RNA, 21 nt, Artificial Sequence
  Synthetic
caccuugggugggcggaggag

SEQ ID NO: 16931 - RNA, 22 nt, Artificial Sequence
  Synthetic
gcaccuugggugggcggaggag

SEQ ID NO: 16932 - RNA, 23 nt, Artificial Sequence
  Synthetic
agcaccuugggugggcggaggag

SEQ ID NO: 16933 - RNA, 24 nt, Artificial Sequence
  Synthetic
aagcaccuugggugggcggaggag

SEQ ID NO: 16934 - RNA, 18 nt, Artificial Sequence
  Synthetic
ggggacgcgggggcggag

SEQ ID NO: 16935 - RNA, 19 nt, Artificial Sequence
  Synthetic
gggggacgcgggggcggag

SEQ ID NO: 16936 - RNA, 20 nt, Artificial Sequence
  Synthetic
ggggggacgcgggggcggag

SEQ ID NO: 16937 - RNA, 21 nt, Artificial Sequence
  Synthetic
gggggggacgcgggggcggag

SEQ ID NO: 16938 - RNA, 22 nt, Artificial Sequence
  Synthetic
agggggggacgcgggggcggag

SEQ ID NO: 16939 - RNA, 23 nt, Artificial Sequence
  Synthetic
gagggggggacgcgggggcggag

SEQ ID NO: 16940 - RNA, 24 nt, Artificial Sequence
  Synthetic
ggagggggggacgcgggggcggag

SEQ ID NO: 16941 - RNA, 18 nt, Artificial Sequence
  Synthetic
caccuugggugggcggag

SEQ ID NO: 16942 - RNA, 19 nt, Artificial Sequence
  Synthetic
gcaccuugggugggcggag

SEQ ID NO: 16943 - RNA, 20 nt, Artificial Sequence
  Synthetic
agcaccuugggugggcggag

SEQ ID NO: 16944 - RNA, 21 nt, Artificial Sequence
  Synthetic
aagcaccuugggugggcggag

SEQ ID NO: 16945 - RNA, 22 nt, Artificial Sequence
  Synthetic
uaagcaccuugggugggcggag

SEQ ID NO: 16946 - RNA, 23 nt, Artificial Sequence
  Synthetic
guaagcaccuugggugggcggag

SEQ ID NO: 16947 - RNA, 24 nt, Artificial Sequence
  Synthetic
gguaagcaccuugggugggcggag

SEQ ID NO: 16948 - RNA, 18 nt, Artificial Sequence
  Synthetic
gagcacgcggaccgggag

SEQ ID NO: 16949 - RNA, 19 nt, Artificial Sequence
  Synthetic
ggagcacgcggaccgggag

SEQ ID NO: 16950 - RNA, 20 nt, Artificial Sequence
  Synthetic
cggagcacgcggaccgggag

SEQ ID NO: 16951 - RNA, 21 nt, Artificial Sequence
  Synthetic
gcggagcacgcggaccgggag

SEQ ID NO: 16952 - RNA, 22 nt, Artificial Sequence
  Synthetic
ugcggagcacgcggaccgggag

SEQ ID NO: 16953 - RNA, 23 nt, Artificial Sequence
  Synthetic
cugcggagcacgcggaccgggag

SEQ ID NO: 16954 - RNA, 24 nt, Artificial Sequence
  Synthetic
gcugcggagcacgcggaccgggag

SEQ ID NO: 16955 - RNA, 18 nt, Artificial Sequence
  Synthetic
cggauacgcgccgcguag

SEQ ID NO: 16956 - RNA, 19 nt, Artificial Sequence
  Synthetic
ccggauacgcgccgcguag

SEQ ID NO: 16957 - RNA, 20 nt, Artificial Sequence
  Synthetic
uccggauacgcgccgcguag

SEQ ID NO: 16958 - RNA, 21 nt, Artificial Sequence
  Synthetic
guccggauacgcgccgcguag

SEQ ID NO: 16959 - RNA, 22 nt, Artificial Sequence
  Synthetic
gguccggauacgcgccgcguag

SEQ ID NO: 16960 - RNA, 23 nt, Artificial Sequence
  Synthetic
ggguccggauacgcgccgcguag

SEQ ID NO: 16961 - RNA, 24 nt, Artificial Sequence
  Synthetic
gggguccggauacgcgccgcguag

SEQ ID NO: 16962 - RNA, 18 nt, Artificial Sequence
  Synthetic
cggcgccggccacgaacg

SEQ ID NO: 16963 - RNA, 19 nt, Artificial Sequence
  Synthetic
acggcgccggccacgaacg

SEQ ID NO: 16964 - RNA, 20 nt, Artificial Sequence
  Synthetic
gacggcgccggccacgaacg

SEQ ID NO: 16965 - RNA, 21 nt, Artificial Sequence
  Synthetic
agacggcgccggccacgaacg

SEQ ID NO: 16966 - RNA, 22 nt, Artificial Sequence
  Synthetic
cagacggcgccggccacgaacg

SEQ ID NO: 16967 - RNA, 23 nt, Artificial Sequence
  Synthetic
gcagacggcgccggccacgaacg

SEQ ID NO: 16968 - RNA, 24 nt, Artificial Sequence
  Synthetic
cgcagacggcgccggccacgaacg

SEQ ID NO: 16969 - RNA, 18 nt, Artificial Sequence
  Synthetic
cgucggacgacgaggacg

SEQ ID NO: 16970 - RNA, 19 nt, Artificial Sequence
  Synthetic
ucgucggacgacgaggacg

SEQ ID NO: 16971 - RNA, 20 nt, Artificial Sequence
  Synthetic
cucgucggacgacgaggacg

SEQ ID NO: 16972 - RNA, 21 nt, Artificial Sequence
  Synthetic
ccucgucggacgacgaggacg

SEQ ID NO: 16973 - RNA, 22 nt, Artificial Sequence
  Synthetic
uccucgucggacgacgaggacg

SEQ ID NO: 16974 - RNA, 23 nt, Artificial Sequence
  Synthetic
guccucgucggacgacgaggacg

SEQ ID NO: 16975 - RNA, 24 nt, Artificial Sequence
  Synthetic
cguccucgucggacgacgaggacg

SEQ ID NO: 16976 - RNA, 18 nt, Artificial Sequence
  Synthetic
gaaagggacacgcggacg

SEQ ID NO: 16977 - RNA, 19 nt, Artificial Sequence
  Synthetic
ggaaagggacacgcggacg

SEQ ID NO: 16978 - RNA, 20 nt, Artificial Sequence
  Synthetic
cggaaagggacacgcggacg

SEQ ID NO: 16979 - RNA, 21 nt, Artificial Sequence
  Synthetic
ucggaaagggacacgcggacg

SEQ ID NO: 16980 - RNA, 22 nt, Artificial Sequence
  Synthetic
aucggaaagggacacgcggacg

SEQ ID NO: 16981 - RNA, 23 nt, Artificial Sequence
  Synthetic
caucggaaagggacacgcggacg

SEQ ID NO: 16982 - RNA, 24 nt, Artificial Sequence
  Synthetic
gcaucggaaagggacacgcggacg

SEQ ID NO: 16983 - RNA, 18 nt, Artificial Sequence
  Synthetic
acgaagaggaugcggacg

SEQ ID NO: 16984 - RNA, 19 nt, Artificial Sequence
  Synthetic
gacgaagaggaugcggacg

SEQ ID NO: 16985 - RNA, 20 nt, Artificial Sequence
  Synthetic
ggacgaagaggaugcggacg

SEQ ID NO: 16986 - RNA, 21 nt, Artificial Sequence
  Synthetic
aggacgaagaggaugcggacg

SEQ ID NO: 16987 - RNA, 22 nt, Artificial Sequence
  Synthetic
gaggacgaagaggaugcggacg

SEQ ID NO: 16988 - RNA, 23 nt, Artificial Sequence
  Synthetic
cgaggacgaagaggaugcggacg

SEQ ID NO: 16989 - RNA, 24 nt, Artificial Sequence
  Synthetic
acgaggacgaagaggaugcggacg

SEQ ID NO: 16990 - RNA, 18 nt, Artificial Sequence
  Synthetic
ccucguccucgucggacg

SEQ ID NO: 16991 - RNA, 19 nt, Artificial Sequence
  Synthetic
uccucguccucgucggacg

SEQ ID NO: 16992 - RNA, 20 nt, Artificial Sequence
  Synthetic
guccucguccucgucggacg

SEQ ID NO: 16993 - RNA, 21 nt, Artificial Sequence
  Synthetic
cguccucguccucgucggacg

SEQ ID NO: 16994 - RNA, 22 nt, Artificial Sequence
  Synthetic
ucguccucguccucgucggacg

SEQ ID NO: 16995 - RNA, 23 nt, Artificial Sequence
  Synthetic
gucguccucguccucgucggacg

SEQ ID NO: 16996 - RNA, 24 nt, Artificial Sequence
  Synthetic
cgucguccucguccucgucggacg

SEQ ID NO: 16997 - RNA, 18 nt, Artificial Sequence
  Synthetic
gcggaggagggggggacg

SEQ ID NO: 16998 - RNA, 19 nt, Artificial Sequence
  Synthetic
ggcggaggagggggggacg

SEQ ID NO: 16999 - RNA, 20 nt, Artificial Sequence
  Synthetic
gggcggaggagggggggacg

SEQ ID NO: 17000 - RNA, 21 nt, Artificial Sequence
  Synthetic
ugggcggaggagggggggacg

SEQ ID NO: 17001 - RNA, 22 nt, Artificial Sequence
  Synthetic
gugggcggaggagggggggacg

SEQ ID NO: 17002 - RNA, 23 nt, Artificial Sequence
  Synthetic
ggugggcggaggagggggggacg

SEQ ID NO: 17003 - RNA, 24 nt, Artificial Sequence
  Synthetic
gggugggcggaggagggggggacg

SEQ ID NO: 17004 - RNA, 18 nt, Artificial Sequence
  Synthetic
gggagucgcagagggccg

SEQ ID NO: 17005 - RNA, 19 nt, Artificial Sequence
  Synthetic
cgggagucgcagagggccg

SEQ ID NO: 17006 - RNA, 20 nt, Artificial Sequence
  Synthetic
gcgggagucgcagagggccg

SEQ ID NO: 17007 - RNA, 21 nt, Artificial Sequence
  Synthetic
agcgggagucgcagagggccg

SEQ ID NO: 17008 - RNA, 22 nt, Artificial Sequence
  Synthetic
gagcgggagucgcagagggccg

SEQ ID NO: 17009 - RNA, 23 nt, Artificial Sequence
  Synthetic
ggagcgggagucgcagagggccg

SEQ ID NO: 17010 - RNA, 24 nt, Artificial Sequence
  Synthetic
gggagcgggagucgcagagggccg

SEQ ID NO: 17011 - RNA, 18 nt, Artificial Sequence
  Synthetic
uccgcggcggcugggccg

SEQ ID NO: 17012 - RNA, 19 nt, Artificial Sequence
  Synthetic
cuccgcggcggcugggccg

SEQ ID NO: 17013 - RNA, 20 nt, Artificial Sequence
  Synthetic
ucuccgcggcggcugggccg

SEQ ID NO: 17014 - RNA, 21 nt, Artificial Sequence
  Synthetic
gucuccgcggcggcugggccg

SEQ ID NO: 17015 - RNA, 22 nt, Artificial Sequence
  Synthetic
cgucuccgcggcggcugggccg

SEQ ID NO: 17016 - RNA, 23 nt, Artificial Sequence
  Synthetic
acgucuccgcggcggcugggccg

SEQ ID NO: 17017 - RNA, 24 nt, Artificial Sequence
  Synthetic
gacgucuccgcggcggcugggccg

SEQ ID NO: 17018 - RNA, 18 nt, Artificial Sequence
  Synthetic
acgaggacccggaguccg

SEQ ID NO: 17019 - RNA, 19 nt, Artificial Sequence
  Synthetic
gacgaggacccggaguccg

SEQ ID NO: 17020 - RNA, 20 nt, Artificial Sequence
  Synthetic
ggacgaggacccggaguccg

SEQ ID NO: 17021 - RNA, 21 nt, Artificial Sequence
  Synthetic
aggacgaggacccggaguccg

SEQ ID NO: 17022 - RNA, 22 nt, Artificial Sequence
  Synthetic
gaggacgaggacccggaguccg

SEQ ID NO: 17023 - RNA, 23 nt, Artificial Sequence
  Synthetic
cgaggacgaggacccggaguccg

SEQ ID NO: 17024 - RNA, 24 nt, Artificial Sequence
  Synthetic
acgaggacgaggacccggaguccg

SEQ ID NO: 17025 - RNA, 18 nt, Artificial Sequence
  Synthetic
aagggacacgcggacgcg

SEQ ID NO: 17026 - RNA, 19 nt, Artificial Sequence
  Synthetic
aaagggacacgcggacgcg

SEQ ID NO: 17027 - RNA, 20 nt, Artificial Sequence
  Synthetic
gaaagggacacgcggacgcg

SEQ ID NO: 17028 - RNA, 21 nt, Artificial Sequence
  Synthetic
ggaaagggacacgcggacgcg

SEQ ID NO: 17029 - RNA, 22 nt, Artificial Sequence
  Synthetic
cggaaagggacacgcggacgcg

SEQ ID NO: 17030 - RNA, 23 nt, Artificial Sequence
  Synthetic
ucggaaagggacacgcggacgcg

SEQ ID NO: 17031 - RNA, 24 nt, Artificial Sequence
  Synthetic
aucggaaagggacacgcggacgcg

SEQ ID NO: 17032 - RNA, 18 nt, Artificial Sequence
  Synthetic
gcagagccagcugucgcg

SEQ ID NO: 17033 - RNA, 19 nt, Artificial Sequence
  Synthetic
agcagagccagcugucgcg

SEQ ID NO: 17034 - RNA, 20 nt, Artificial Sequence
  Synthetic
cagcagagccagcugucgcg

SEQ ID NO: 17035 - RNA, 21 nt, Artificial Sequence
  Synthetic
ccagcagagccagcugucgcg

SEQ ID NO: 17036 - RNA, 22 nt, Artificial Sequence
  Synthetic
gccagcagagccagcugucgcg

SEQ ID NO: 17037 - RNA, 23 nt, Artificial Sequence
  Synthetic
ggccagcagagccagcugucgcg

SEQ ID NO: 17038 - RNA, 24 nt, Artificial Sequence
  Synthetic
aggccagcagagccagcugucgcg

SEQ ID NO: 17039 - RNA, 18 nt, Artificial Sequence
  Synthetic
gggcgggcccgggcggcg

SEQ ID NO: 17040 - RNA, 19 nt, Artificial Sequence
  Synthetic
ggggcgggcccgggcggcg

SEQ ID NO: 17041 - RNA, 20 nt, Artificial Sequence
  Synthetic
gggggcgggcccgggcggcg

SEQ ID NO: 17042 - RNA, 21 nt, Artificial Sequence
  Synthetic
cgggggcgggcccgggcggcg

SEQ ID NO: 17043 - RNA, 22 nt, Artificial Sequence
  Synthetic
ccgggggcgggcccgggcggcg

SEQ ID NO: 17044 - RNA, 23 nt, Artificial Sequence
  Synthetic
cccgggggcgggcccgggcggcg

SEQ ID NO: 17045 - RNA, 24 nt, Artificial Sequence
  Synthetic
ccccgggggcgggcccgggcggcg

SEQ ID NO: 17046 - RNA, 18 nt, Artificial Sequence
  Synthetic
cgggggcgggcccgggcg

SEQ ID NO: 17047 - RNA, 19 nt, Artificial Sequence
  Synthetic
ccgggggcgggcccgggcg

SEQ ID NO: 17048 - RNA, 20 nt, Artificial Sequence
  Synthetic
cccgggggcgggcccgggcg

SEQ ID NO: 17049 - RNA, 21 nt, Artificial Sequence
  Synthetic
ccccgggggcgggcccgggcg

SEQ ID NO: 17050 - RNA, 22 nt, Artificial Sequence
  Synthetic
gccccgggggcgggcccgggcg

SEQ ID NO: 17051 - RNA, 23 nt, Artificial Sequence
  Synthetic
ggccccgggggcgggcccgggcg

SEQ ID NO: 17052 - RNA, 24 nt, Artificial Sequence
  Synthetic
cggccccgggggcgggcccgggcg

SEQ ID NO: 17053 - RNA, 18 nt, Artificial Sequence
  Synthetic
aggccgcggggucgggcg

SEQ ID NO: 17054 - RNA, 19 nt, Artificial Sequence
  Synthetic
gaggccgcggggucgggcg

SEQ ID NO: 17055 - RNA, 20 nt, Artificial Sequence
  Synthetic
cgaggccgcggggucgggcg

SEQ ID NO: 17056 - RNA, 21 nt, Artificial Sequence
  Synthetic
gcgaggccgcggggucgggcg

SEQ ID NO: 17057 - RNA, 22 nt, Artificial Sequence
  Synthetic
ggcgaggccgcggggucgggcg

SEQ ID NO: 17058 - RNA, 23 nt, Artificial Sequence
  Synthetic
cggcgaggccgcggggucgggcg

SEQ ID NO: 17059 - RNA, 24 nt, Artificial Sequence
  Synthetic
gcggcgaggccgcggggucgggcg

SEQ ID NO: 17060 - RNA, 18 nt, Artificial Sequence
  Synthetic
aggcggggguccggggcg

SEQ ID NO: 17061 - RNA, 19 nt, Artificial Sequence
  Synthetic
aaggcggggguccggggcg

SEQ ID NO: 17062 - RNA, 20 nt, Artificial Sequence
  Synthetic
aaaggcggggguccggggcg

SEQ ID NO: 17063 - RNA, 21 nt, Artificial Sequence
  Synthetic
gaaaggcggggguccggggcg

SEQ ID NO: 17064 - RNA, 22 nt, Artificial Sequence
  Synthetic
cgaaaggcggggguccggggcg

SEQ ID NO: 17065 - RNA, 23 nt, Artificial Sequence
  Synthetic
ucgaaaggcggggguccggggcg

SEQ ID NO: 17066 - RNA, 24 nt, Artificial Sequence
  Synthetic
cucgaaaggcggggguccggggcg

SEQ ID NO: 17067 - RNA, 18 nt, Artificial Sequence
  Synthetic
gggggggacgcgggggcg

SEQ ID NO: 17068 - RNA, 19 nt, Artificial Sequence
  Synthetic
agggggggacgcgggggcg

SEQ ID NO: 17069 - RNA, 20 nt, Artificial Sequence
  Synthetic
gagggggggacgcgggggcg

SEQ ID NO: 17070 - RNA, 21 nt, Artificial Sequence
  Synthetic
ggagggggggacgcgggggcg

SEQ ID NO: 17071 - RNA, 22 nt, Artificial Sequence
  Synthetic
aggagggggggacgcgggggcg

SEQ ID NO: 17072 - RNA, 23 nt, Artificial Sequence
  Synthetic
gaggagggggggacgcgggggcg

SEQ ID NO: 17073 - RNA, 24 nt, Artificial Sequence
  Synthetic
ggaggagggggggacgcgggggcg

SEQ ID NO: 17074 - RNA, 18 nt, Artificial Sequence
  Synthetic
aagcaccuugggugggcg

SEQ ID NO: 17075 - RNA, 19 nt, Artificial Sequence
  Synthetic
uaagcaccuugggugggcg

SEQ ID NO: 17076 - RNA, 20 nt, Artificial Sequence
  Synthetic
guaagcaccuugggugggcg

SEQ ID NO: 17077 - RNA, 21 nt, Artificial Sequence
  Synthetic
gguaagcaccuugggugggcg

SEQ ID NO: 17078 - RNA, 22 nt, Artificial Sequence
  Synthetic
ggguaagcaccuugggugggcg

SEQ ID NO: 17079 - RNA, 23 nt, Artificial Sequence
  Synthetic
cggguaagcaccuugggugggcg

SEQ ID NO: 17080 - RNA, 24 nt, Artificial Sequence
  Synthetic
acggguaagcaccuugggugggcg

SEQ ID NO: 17081 - RNA, 18 nt, Artificial Sequence
  Synthetic
ucgucguccucguccucg

SEQ ID NO: 17082 - RNA, 19 nt, Artificial Sequence
  Synthetic
gucgucguccucguccucg

SEQ ID NO: 17083 - RNA, 20 nt, Artificial Sequence
  Synthetic
cgucgucguccucguccucg

SEQ ID NO: 17084 - RNA, 21 nt, Artificial Sequence
  Synthetic
ccgucgucguccucguccucg

SEQ ID NO: 17085 - RNA, 22 nt, Artificial Sequence
  Synthetic
gccgucgucguccucguccucg

SEQ ID NO: 17086 - RNA, 23 nt, Artificial Sequence
  Synthetic
ugccgucgucguccucguccucg

SEQ ID NO: 17087 - RNA, 24 nt, Artificial Sequence
  Synthetic
uugccgucgucguccucguccucg

SEQ ID NO: 17088 - RNA, 18 nt, Artificial Sequence
  Synthetic
cugccggcgccgcgcucg

SEQ ID NO: 17089 - RNA, 19 nt, Artificial Sequence
  Synthetic
gcugccggcgccgcgcucg

SEQ ID NO: 17090 - RNA, 20 nt, Artificial Sequence
  Synthetic
ggcugccggcgccgcgcucg

SEQ ID NO: 17091 - RNA, 21 nt, Artificial Sequence
  Synthetic
gggcugccggcgccgcgcucg

SEQ ID NO: 17092 - RNA, 22 nt, Artificial Sequence
  Synthetic
ggggcugccggcgccgcgcucg

SEQ ID NO: 17093 - RNA, 23 nt, Artificial Sequence
  Synthetic
gggggcugccggcgccgcgcucg

SEQ ID NO: 17094 - RNA, 24 nt, Artificial Sequence
  Synthetic
cgggggcugccggcgccgcgcucg

SEQ ID NO: 17095 - RNA, 18 nt, Artificial Sequence
  Synthetic
gaccgggagcgggagucg

SEQ ID NO: 17096 - RNA, 19 nt, Artificial Sequence
  Synthetic
ggaccgggagcgggagucg

SEQ ID NO: 17097 - RNA, 20 nt, Artificial Sequence
  Synthetic
cggaccgggagcgggagucg

SEQ ID NO: 17098 - RNA, 21 nt, Artificial Sequence
  Synthetic
gcggaccgggagcgggagucg

SEQ ID NO: 17099 - RNA, 22 nt, Artificial Sequence
  Synthetic
cgcggaccgggagcgggagucg

SEQ ID NO: 17100 - RNA, 23 nt, Artificial Sequence
  Synthetic
acgcggaccgggagcgggagucg

SEQ ID NO: 17101 - RNA, 24 nt, Artificial Sequence
  Synthetic
cacgcggaccgggagcgggagucg

SEQ ID NO: 17102 - RNA, 18 nt, Artificial Sequence
  Synthetic
cgucgucggcucgaaagg

SEQ ID NO: 17103 - RNA, 19 nt, Artificial Sequence
  Synthetic
ucgucgucggcucgaaagg

SEQ ID NO: 17104 - RNA, 20 nt, Artificial Sequence
  Synthetic
aucgucgucggcucgaaagg

SEQ ID NO: 17105 - RNA, 21 nt, Artificial Sequence
  Synthetic
caucgucgucggcucgaaagg

SEQ ID NO: 17106 - RNA, 22 nt, Artificial Sequence
  Synthetic
ucaucgucgucggcucgaaagg

SEQ ID NO: 17107 - RNA, 23 nt, Artificial Sequence
  Synthetic
gucaucgucgucggcucgaaagg

SEQ ID NO: 17108 - RNA, 24 nt, Artificial Sequence
  Synthetic
cgucaucgucgucggcucgaaagg

SEQ ID NO: 17109 - RNA, 18 nt, Artificial Sequence
  Synthetic
aggaugcggacgacgagg

SEQ ID NO: 17110 - RNA, 19 nt, Artificial Sequence
  Synthetic
gaggaugcggacgacgagg

SEQ ID NO: 17111 - RNA, 20 nt, Artificial Sequence
  Synthetic
agaggaugcggacgacgagg

SEQ ID NO: 17112 - RNA, 21 nt, Artificial Sequence
  Synthetic
aagaggaugcggacgacgagg

SEQ ID NO: 17113 - RNA, 22 nt, Artificial Sequence
  Synthetic
gaagaggaugcggacgacgagg

SEQ ID NO: 17114 - RNA, 23 nt, Artificial Sequence
  Synthetic
cgaagaggaugcggacgacgagg

SEQ ID NO: 17115 - RNA, 24 nt, Artificial Sequence
  Synthetic
acgaagaggaugcggacgacgagg

SEQ ID NO: 17116 - RNA, 18 nt, Artificial Sequence
  Synthetic
ccucgucggacgacgagg

SEQ ID NO: 17117 - RNA, 19 nt, Artificial Sequence
  Synthetic
uccucgucggacgacgagg

SEQ ID NO: 17118 - RNA, 20 nt, Artificial Sequence
  Synthetic
guccucgucggacgacgagg

SEQ ID NO: 17119 - RNA, 21 nt, Artificial Sequence
  Synthetic
cguccucgucggacgacgagg

SEQ ID NO: 17120 - RNA, 22 nt, Artificial Sequence
  Synthetic
ucguccucgucggacgacgagg

SEQ ID NO: 17121 - RNA, 23 nt, Artificial Sequence
  Synthetic
cucguccucgucggacgacgagg

SEQ ID NO: 17122 - RNA, 24 nt, Artificial Sequence
  Synthetic
ccucguccucgucggacgacgagg

SEQ ID NO: 17123 - RNA, 18 nt, Artificial Sequence
  Synthetic
acgcgggggcggaggagg

SEQ ID NO: 17124 - RNA, 19 nt, Artificial Sequence
  Synthetic
gacgcgggggcggaggagg

SEQ ID NO: 17125 - RNA, 20 nt, Artificial Sequence
  Synthetic
ggacgcgggggcggaggagg

SEQ ID NO: 17126 - RNA, 21 nt, Artificial Sequence
  Synthetic
gggacgcgggggcggaggagg

SEQ ID NO: 17127 - RNA, 22 nt, Artificial Sequence
  Synthetic
ggggacgcgggggcggaggagg

SEQ ID NO: 17128 - RNA, 23 nt, Artificial Sequence
  Synthetic
gggggacgcgggggcggaggagg

SEQ ID NO: 17129 - RNA, 24 nt, Artificial Sequence
  Synthetic
ggggggacgcgggggcggaggagg

SEQ ID NO: 17130 - RNA, 18 nt, Artificial Sequence
  Synthetic
uugggugggcggaggagg

SEQ ID NO: 17131 - RNA, 19 nt, Artificial Sequence
  Synthetic
cuugggugggcggaggagg

SEQ ID NO: 17132 - RNA, 20 nt, Artificial Sequence
  Synthetic
ccuugggugggcggaggagg

SEQ ID NO: 17133 - RNA, 21 nt, Artificial Sequence
  Synthetic
accuugggugggcggaggagg

SEQ ID NO: 17134 - RNA, 22 nt, Artificial Sequence
  Synthetic
caccuugggugggcggaggagg

SEQ ID NO: 17135 - RNA, 23 nt, Artificial Sequence
  Synthetic
gcaccuugggugggcggaggagg

SEQ ID NO: 17136 - RNA, 24 nt, Artificial Sequence
  Synthetic
agcaccuugggugggcggaggagg

SEQ ID NO: 17137 - RNA, 18 nt, Artificial Sequence
  Synthetic
gggacgcgggggcggagg

SEQ ID NO: 17138 - RNA, 19 nt, Artificial Sequence
  Synthetic
ggggacgcgggggcggagg

SEQ ID NO: 17139 - RNA, 20 nt, Artificial Sequence
  Synthetic
gggggacgcgggggcggagg

SEQ ID NO: 17140 - RNA, 21 nt, Artificial Sequence
  Synthetic
ggggggacgcgggggcggagg

SEQ ID NO: 17141 - RNA, 22 nt, Artificial Sequence
  Synthetic
gggggggacgcgggggcggagg

SEQ ID NO: 17142 - RNA, 23 nt, Artificial Sequence
  Synthetic
agggggggacgcgggggcggagg

SEQ ID NO: 17143 - RNA, 24 nt, Artificial Sequence
  Synthetic
gagggggggacgcgggggcggagg

SEQ ID NO: 17144 - RNA, 18 nt, Artificial Sequence
  Synthetic
accuugggugggcggagg

SEQ ID NO: 17145 - RNA, 19 nt, Artificial Sequence
  Synthetic
caccuugggugggcggagg

SEQ ID NO: 17146 - RNA, 20 nt, Artificial Sequence
  Synthetic
gcaccuugggugggcggagg

SEQ ID NO: 17147 - RNA, 21 nt, Artificial Sequence
  Synthetic
agcaccuugggugggcggagg

SEQ ID NO: 17148 - RNA, 22 nt, Artificial Sequence
  Synthetic
aagcaccuugggugggcggagg

SEQ ID NO: 17149 - RNA, 23 nt, Artificial Sequence
  Synthetic
uaagcaccuugggugggcggagg

SEQ ID NO: 17150 - RNA, 24 nt, Artificial Sequence
  Synthetic
guaagcaccuugggugggcggagg

SEQ ID NO: 17151 - RNA, 18 nt, Artificial Sequence
  Synthetic
uauauauauauuauuagg

SEQ ID NO: 17152 - RNA, 19 nt, Artificial Sequence
  Synthetic
auauauauauauuauuagg

SEQ ID NO: 17153 - RNA, 20 nt, Artificial Sequence
  Synthetic
aauauauauauauuauuagg

SEQ ID NO: 17154 - RNA, 21 nt, Artificial Sequence
  Synthetic
caauauauauauauuauuagg

SEQ ID NO: 17155 - RNA, 22 nt, Artificial Sequence
  Synthetic
ccaauauauauauauuauuagg

SEQ ID NO: 17156 - RNA, 23 nt, Artificial Sequence
  Synthetic
cccaauauauauauauuauuagg

SEQ ID NO: 17157 - RNA, 24 nt, Artificial Sequence
  Synthetic
ucccaauauauauauauuauuagg

SEQ ID NO: 17158 - RNA, 18 nt, Artificial Sequence
  Synthetic
agggacacgcggacgcgg

SEQ ID NO: 17159 - RNA, 19 nt, Artificial Sequence
  Synthetic
aagggacacgcggacgcgg

SEQ ID NO: 17160 - RNA, 20 nt, Artificial Sequence
  Synthetic
aaagggacacgcggacgcgg

SEQ ID NO: 17161 - RNA, 21 nt, Artificial Sequence
  Synthetic
gaaagggacacgcggacgcgg

SEQ ID NO: 17162 - RNA, 22 nt, Artificial Sequence
  Synthetic
ggaaagggacacgcggacgcgg

SEQ ID NO: 17163 - RNA, 23 nt, Artificial Sequence
  Synthetic
cggaaagggacacgcggacgcgg

SEQ ID NO: 17164 - RNA, 24 nt, Artificial Sequence
  Synthetic
ucggaaagggacacgcggacgcgg

SEQ ID NO: 17165 - RNA, 18 nt, Artificial Sequence
  Synthetic
acgacgucuccgcggcgg

SEQ ID NO: 17166 - RNA, 19 nt, Artificial Sequence
  Synthetic
gacgacgucuccgcggcgg

SEQ ID NO: 17167 - RNA, 20 nt, Artificial Sequence
  Synthetic
ugacgacgucuccgcggcgg

SEQ ID NO: 17168 - RNA, 21 nt, Artificial Sequence
  Synthetic
gugacgacgucuccgcggcgg

SEQ ID NO: 17169 - RNA, 22 nt, Artificial Sequence
  Synthetic
cgugacgacgucuccgcggcgg

SEQ ID NO: 17170 - RNA, 23 nt, Artificial Sequence
  Synthetic
ccgugacgacgucuccgcggcgg

SEQ ID NO: 17171 - RNA, 24 nt, Artificial Sequence
  Synthetic
gccgugacgacgucuccgcggcgg

SEQ ID NO: 17172 - RNA, 18 nt, Artificial Sequence
  Synthetic
gggggcgggcccgggcgg

SEQ ID NO: 17173 - RNA, 19 nt, Artificial Sequence
  Synthetic
cgggggcgggcccgggcgg

SEQ ID NO: 17174 - RNA, 20 nt, Artificial Sequence
  Synthetic
ccgggggcgggcccgggcgg

SEQ ID NO: 17175 - RNA, 21 nt, Artificial Sequence
  Synthetic
cccgggggcgggcccgggcgg

SEQ ID NO: 17176 - RNA, 22 nt, Artificial Sequence
  Synthetic
ccccgggggcgggcccgggcgg

SEQ ID NO: 17177 - RNA, 23 nt, Artificial Sequence
  Synthetic
gccccgggggcgggcccgggcgg

SEQ ID NO: 17178 - RNA, 24 nt, Artificial Sequence
  Synthetic
ggccccgggggcgggcccgggcgg

SEQ ID NO: 17179 - RNA, 18 nt, Artificial Sequence
  Synthetic
ggggggacgcgggggcgg

SEQ ID NO: 17180 - RNA, 19 nt, Artificial Sequence
  Synthetic
gggggggacgcgggggcgg

SEQ ID NO: 17181 - RNA, 20 nt, Artificial Sequence
  Synthetic
agggggggacgcgggggcgg

SEQ ID NO: 17182 - RNA, 21 nt, Artificial Sequence
  Synthetic
gagggggggacgcgggggcgg

SEQ ID NO: 17183 - RNA, 22 nt, Artificial Sequence
  Synthetic
ggagggggggacgcgggggcgg

SEQ ID NO: 17184 - RNA, 23 nt, Artificial Sequence
  Synthetic
aggagggggggacgcgggggcgg

SEQ ID NO: 17185 - RNA, 24 nt, Artificial Sequence
  Synthetic
gaggagggggggacgcgggggcgg

SEQ ID NO: 17186 - RNA, 18 nt, Artificial Sequence
  Synthetic
agcaccuugggugggcgg

SEQ ID NO: 17187 - RNA, 19 nt, Artificial Sequence
  Synthetic
aagcaccuugggugggcgg

SEQ ID NO: 17188 - RNA, 20 nt, Artificial Sequence
  Synthetic
uaagcaccuugggugggcgg

SEQ ID NO: 17189 - RNA, 21 nt, Artificial Sequence
  Synthetic
guaagcaccuugggugggcgg

SEQ ID NO: 17190 - RNA, 22 nt, Artificial Sequence
  Synthetic
gguaagcaccuugggugggcgg

SEQ ID NO: 17191 - RNA, 23 nt, Artificial Sequence
  Synthetic
ggguaagcaccuugggugggcgg

SEQ ID NO: 17192 - RNA, 24 nt, Artificial Sequence
  Synthetic
cggguaagcaccuugggugggcgg

SEQ ID NO: 17193 - RNA, 18 nt, Artificial Sequence
  Synthetic
ugggugggcggaggaggg

SEQ ID NO: 17194 - RNA, 19 nt, Artificial Sequence
  Synthetic
uugggugggcggaggaggg

SEQ ID NO: 17195 - RNA, 20 nt, Artificial Sequence
  Synthetic
cuugggugggcggaggaggg

SEQ ID NO: 17196 - RNA, 21 nt, Artificial Sequence
  Synthetic
ccuugggugggcggaggaggg

SEQ ID NO: 17197 - RNA, 22 nt, Artificial Sequence
  Synthetic
accuugggugggcggaggaggg

SEQ ID NO: 17198 - RNA, 23 nt, Artificial Sequence
  Synthetic
caccuugggugggcggaggaggg

SEQ ID NO: 17199 - RNA, 24 nt, Artificial Sequence
  Synthetic
gcaccuugggugggcggaggaggg

SEQ ID NO: 17200 - RNA, 18 nt, Artificial Sequence
  Synthetic
cccguucgcggccccggg

SEQ ID NO: 17201 - RNA, 19 nt, Artificial Sequence
  Synthetic
ucccguucgcggccccggg

SEQ ID NO: 17202 - RNA, 20 nt, Artificial Sequence
  Synthetic
cucccguucgcggccccggg

SEQ ID NO: 17203 - RNA, 21 nt, Artificial Sequence
  Synthetic
ccucccguucgcggccccggg

SEQ ID NO: 17204 - RNA, 22 nt, Artificial Sequence
  Synthetic
gccucccguucgcggccccggg

SEQ ID NO: 17205 - RNA, 23 nt, Artificial Sequence
  Synthetic
ggccucccguucgcggccccggg

SEQ ID NO: 17206 - RNA, 24 nt, Artificial Sequence
  Synthetic
gggccucccguucgcggccccggg

SEQ ID NO: 17207 - RNA, 18 nt, Artificial Sequence
  Synthetic
gggacacgcggacgcggg

SEQ ID NO: 17208 - RNA, 19 nt, Artificial Sequence
  Synthetic
agggacacgcggacgcggg

SEQ ID NO: 17209 - RNA, 20 nt, Artificial Sequence
  Synthetic
aagggacacgcggacgcggg

SEQ ID NO: 17210 - RNA, 21 nt, Artificial Sequence
  Synthetic
aaagggacacgcggacgcggg

SEQ ID NO: 17211 - RNA, 22 nt, Artificial Sequence
  Synthetic
gaaagggacacgcggacgcggg

SEQ ID NO: 17212 - RNA, 23 nt, Artificial Sequence
  Synthetic
ggaaagggacacgcggacgcggg

SEQ ID NO: 17213 - RNA, 24 nt, Artificial Sequence
  Synthetic
cggaaagggacacgcggacgcggg

SEQ ID NO: 17214 - RNA, 18 nt, Artificial Sequence
  Synthetic
uccgcgccggccccgggg

SEQ ID NO: 17215 - RNA, 19 nt, Artificial Sequence
  Synthetic
cuccgcgccggccccgggg

SEQ ID NO: 17216 - RNA, 20 nt, Artificial Sequence
  Synthetic
acuccgcgccggccccgggg

SEQ ID NO: 17217 - RNA, 21 nt, Artificial Sequence
  Synthetic
gacuccgcgccggccccgggg

SEQ ID NO: 17218 - RNA, 22 nt, Artificial Sequence
  Synthetic
cgacuccgcgccggccccgggg

SEQ ID NO: 17219 - RNA, 23 nt, Artificial Sequence
  Synthetic
ccgacuccgcgccggccccgggg

SEQ ID NO: 17220 - RNA, 24 nt, Artificial Sequence
  Synthetic
cccgacuccgcgccggccccgggg

SEQ ID NO: 17221 - RNA, 18 nt, Artificial Sequence
  Synthetic
ggacacgcggacgcgggg

SEQ ID NO: 17222 - RNA, 19 nt, Artificial Sequence
  Synthetic
gggacacgcggacgcgggg

SEQ ID NO: 17223 - RNA, 20 nt, Artificial Sequence
  Synthetic
agggacacgcggacgcgggg

SEQ ID NO: 17224 - RNA, 21 nt, Artificial Sequence
  Synthetic
aagggacacgcggacgcgggg

SEQ ID NO: 17225 - RNA, 22 nt, Artificial Sequence
  Synthetic
aaagggacacgcggacgcgggg

SEQ ID NO: 17226 - RNA, 23 nt, Artificial Sequence
  Synthetic
gaaagggacacgcggacgcgggg

SEQ ID NO: 17227 - RNA, 24 nt, Artificial Sequence
  Synthetic
ggaaagggacacgcggacgcgggg

SEQ ID NO: 17228 - RNA, 18 nt, Artificial Sequence
  Synthetic
ggagggggggacgcgggg

SEQ ID NO: 17229 - RNA, 19 nt, Artificial Sequence
  Synthetic
aggagggggggacgcgggg

SEQ ID NO: 17230 - RNA, 20 nt, Artificial Sequence
  Synthetic
gaggagggggggacgcgggg

SEQ ID NO: 17231 - RNA, 21 nt, Artificial Sequence
  Synthetic
ggaggagggggggacgcgggg

SEQ ID NO: 17232 - RNA, 22 nt, Artificial Sequence
  Synthetic
cggaggagggggggacgcgggg

SEQ ID NO: 17233 - RNA, 23 nt, Artificial Sequence
  Synthetic
gcggaggagggggggacgcgggg

SEQ ID NO: 17234 - RNA, 24 nt, Artificial Sequence
  Synthetic
ggcggaggagggggggacgcgggg

SEQ ID NO: 17235 - RNA, 18 nt, Artificial Sequence
  Synthetic
ggcggcgaggccgcgggg

SEQ ID NO: 17236 - RNA, 19 nt, Artificial Sequence
  Synthetic
gggcggcgaggccgcgggg

SEQ ID NO: 17237 - RNA, 20 nt, Artificial Sequence
  Synthetic
ggggcggcgaggccgcgggg

SEQ ID NO: 17238 - RNA, 21 nt, Artificial Sequence
  Synthetic
cggggcggcgaggccgcgggg

SEQ ID NO: 17239 - RNA, 22 nt, Artificial Sequence
  Synthetic
ccggggcggcgaggccgcgggg

SEQ ID NO: 17240 - RNA, 23 nt, Artificial Sequence
  Synthetic
uccggggcggcgaggccgcgggg

SEQ ID NO: 17241 - RNA, 24 nt, Artificial Sequence
  Synthetic
guccggggcggcgaggccgcgggg

SEQ ID NO: 17242 - RNA, 18 nt, Artificial Sequence
  Synthetic
gagggggggacgcggggg

SEQ ID NO: 17243 - RNA, 19 nt, Artificial Sequence
  Synthetic
ggagggggggacgcggggg

SEQ ID NO: 17244 - RNA, 20 nt, Artificial Sequence
  Synthetic
aggagggggggacgcggggg

SEQ ID NO: 17245 - RNA, 21 nt, Artificial Sequence
  Synthetic
gaggagggggggacgcggggg

SEQ ID NO: 17246 - RNA, 22 nt, Artificial Sequence
  Synthetic
ggaggagggggggacgcggggg

SEQ ID NO: 17247 - RNA, 23 nt, Artificial Sequence
  Synthetic
cggaggagggggggacgcggggg

SEQ ID NO: 17248 - RNA, 24 nt, Artificial Sequence
  Synthetic
gcggaggagggggggacgcggggg

SEQ ID NO: 17249 - RNA, 18 nt, Artificial Sequence
  Synthetic
guaagcaccuuggguggg

SEQ ID NO: 17250 - RNA, 19 nt, Artificial Sequence
  Synthetic
gguaagcaccuuggguggg

SEQ ID NO: 17251 - RNA, 20 nt, Artificial Sequence
  Synthetic
ggguaagcaccuuggguggg

SEQ ID NO: 17252 - RNA, 21 nt, Artificial Sequence
  Synthetic
cggguaagcaccuuggguggg

SEQ ID NO: 17253 - RNA, 22 nt, Artificial Sequence
  Synthetic
acggguaagcaccuuggguggg

SEQ ID NO: 17254 - RNA, 23 nt, Artificial Sequence
  Synthetic
cacggguaagcaccuuggguggg

SEQ ID NO: 17255 - RNA, 24 nt, Artificial Sequence
  Synthetic
gcacggguaagcaccuuggguggg

SEQ ID NO: 17256 - RNA, 18 nt, Artificial Sequence
  Synthetic
gguaagcaccuugggugg

SEQ ID NO: 17257 - RNA, 19 nt, Artificial Sequence
  Synthetic
ggguaagcaccuugggugg

SEQ ID NO: 17258 - RNA, 20 nt, Artificial Sequence
  Synthetic
cggguaagcaccuugggugg

SEQ ID NO: 17259 - RNA, 21 nt, Artificial Sequence
  Synthetic
acggguaagcaccuugggugg

SEQ ID NO: 17260 - RNA, 22 nt, Artificial Sequence
  Synthetic
cacggguaagcaccuugggugg

SEQ ID NO: 17261 - RNA, 23 nt, Artificial Sequence
  Synthetic
gcacggguaagcaccuugggugg

SEQ ID NO: 17262 - RNA, 24 nt, Artificial Sequence
  Synthetic
ugcacggguaagcaccuugggugg

SEQ ID NO: 17263 - RNA, 18 nt, Artificial Sequence
  Synthetic
cacggguaagcaccuugg

SEQ ID NO: 17264 - RNA, 19 nt, Artificial Sequence
  Synthetic
gcacggguaagcaccuugg

SEQ ID NO: 17265 - RNA, 20 nt, Artificial Sequence
  Synthetic
ugcacggguaagcaccuugg

SEQ ID NO: 17266 - RNA, 21 nt, Artificial Sequence
  Synthetic
uugcacggguaagcaccuugg

SEQ ID NO: 17267 - RNA, 22 nt, Artificial Sequence
  Synthetic
uuugcacggguaagcaccuugg

SEQ ID NO: 17268 - RNA, 23 nt, Artificial Sequence
  Synthetic
uuuugcacggguaagcaccuugg

SEQ ID NO: 17269 - RNA, 24 nt, Artificial Sequence
  Synthetic
uuuuugcacggguaagcaccuugg

SEQ ID NO: 17270 - RNA, 18 nt, Artificial Sequence
  Synthetic
gaacgacgggagcggcug

SEQ ID NO: 17271 - RNA, 19 nt, Artificial Sequence
  Synthetic
cgaacgacgggagcggcug

SEQ ID NO: 17272 - RNA, 20 nt, Artificial Sequence
  Synthetic
acgaacgacgggagcggcug

SEQ ID NO: 17273 - RNA, 21 nt, Artificial Sequence
  Synthetic
cacgaacgacgggagcggcug

SEQ ID NO: 17274 - RNA, 22 nt, Artificial Sequence
  Synthetic
ccacgaacgacgggagcggcug

SEQ ID NO: 17275 - RNA, 23 nt, Artificial Sequence
  Synthetic
gccacgaacgacgggagcggcug

SEQ ID NO: 17276 - RNA, 24 nt, Artificial Sequence
  Synthetic
ggccacgaacgacgggagcggcug

SEQ ID NO: 17277 - RNA, 18 nt, Artificial Sequence
  Synthetic
ucgggaucgggaucgcau

SEQ ID NO: 17278 - RNA, 19 nt, Artificial Sequence
  Synthetic
cucgggaucgggaucgcau

SEQ ID NO: 17279 - RNA, 20 nt, Artificial Sequence
  Synthetic
gcucgggaucgggaucgcau

SEQ ID NO: 17280 - RNA, 21 nt, Artificial Sequence
  Synthetic
ggcucgggaucgggaucgcau

SEQ ID NO: 17281 - RNA, 22 nt, Artificial Sequence
  Synthetic
cggcucgggaucgggaucgcau

SEQ ID NO: 17282 - RNA, 23 nt, Artificial Sequence
  Synthetic
ccggcucgggaucgggaucgcau

SEQ ID NO: 17283 - RNA, 24 nt, Artificial Sequence
  Synthetic
cccggcucgggaucgggaucgcau

SEQ ID NO: 17284 - RNA, 18 nt, Artificial Sequence
  Synthetic
gacgaggacgaagaggau

SEQ ID NO: 17285 - RNA, 19 nt, Artificial Sequence
  Synthetic
cgacgaggacgaagaggau

SEQ ID NO: 17286 - RNA, 20 nt, Artificial Sequence
  Synthetic
acgacgaggacgaagaggau

SEQ ID NO: 17287 - RNA, 21 nt, Artificial Sequence
  Synthetic
gacgacgaggacgaagaggau

SEQ ID NO: 17288 - RNA, 22 nt, Artificial Sequence
  Synthetic
ggacgacgaggacgaagaggau

SEQ ID NO: 17289 - RNA, 23 nt, Artificial Sequence
  Synthetic
cggacgacgaggacgaagaggau

SEQ ID NO: 17290 - RNA, 24 nt, Artificial Sequence
  Synthetic
ucggacgacgaggacgaagaggau

SEQ ID NO: 17291 - RNA, 18 nt, Artificial Sequence
  Synthetic
ccaauauauauauauuau

SEQ ID NO: 17292 - RNA, 19 nt, Artificial Sequence
  Synthetic
cccaauauauauauauuau

SEQ ID NO: 17293 - RNA, 20 nt, Artificial Sequence
  Synthetic
ucccaauauauauauauuau

SEQ ID NO: 17294 - RNA, 21 nt, Artificial Sequence
  Synthetic
gucccaauauauauauauuau

SEQ ID NO: 17295 - RNA, 22 nt, Artificial Sequence
  Synthetic
cgucccaauauauauauauuau

SEQ ID NO: 17296 - RNA, 23 nt, Artificial Sequence
  Synthetic
ucgucccaauauauauauauuau

SEQ ID NO: 17297 - RNA, 24 nt, Artificial Sequence
  Synthetic
uucgucccaauauauauauauuau

SEQ ID NO: 17298 - RNA, 18 nt, Artificial Sequence
  Synthetic
cgaacgacgggagcggcu

SEQ ID NO: 17299 - RNA, 19 nt, Artificial Sequence
  Synthetic
acgaacgacgggagcggcu

SEQ ID NO: 17300 - RNA, 20 nt, Artificial Sequence
  Synthetic
cacgaacgacgggagcggcu

SEQ ID NO: 17301 - RNA, 21 nt, Artificial Sequence
  Synthetic
ccacgaacgacgggagcggcu

SEQ ID NO: 17302 - RNA, 22 nt, Artificial Sequence
  Synthetic
gccacgaacgacgggagcggcu

SEQ ID NO: 17303 - RNA, 23 nt, Artificial Sequence
  Synthetic
ggccacgaacgacgggagcggcu

SEQ ID NO: 17304 - RNA, 24 nt, Artificial Sequence
  Synthetic
cggccacgaacgacgggagcggcu

SEQ ID NO: 17305 - RNA, 18 nt, Artificial Sequence
  Synthetic
ccgccggguaaaagaagu

SEQ ID NO: 17306 - RNA, 19 nt, Artificial Sequence
  Synthetic
gccgccggguaaaagaagu

SEQ ID NO: 17307 - RNA, 20 nt, Artificial Sequence
  Synthetic
ggccgccggguaaaagaagu

SEQ ID NO: 17308 - RNA, 21 nt, Artificial Sequence
  Synthetic
gggccgccggguaaaagaagu

SEQ ID NO: 17309 - RNA, 22 nt, Artificial Sequence
  Synthetic
ggggccgccggguaaaagaagu

SEQ ID NO: 17310 - RNA, 23 nt, Artificial Sequence
  Synthetic
cggggccgccggguaaaagaagu

SEQ ID NO: 17311 - RNA, 24 nt, Artificial Sequence
  Synthetic
gcggggccgccggguaaaagaagu

SEQ ID NO: 17312 - RNA, 18 nt, Artificial Sequence
  Synthetic
auauuauuagggcgaagu

SEQ ID NO: 17313 - RNA, 19 nt, Artificial Sequence
  Synthetic
uauauuauuagggcgaagu

SEQ ID NO: 17314 - RNA, 20 nt, Artificial Sequence
  Synthetic
auauauuauuagggcgaagu

SEQ ID NO: 17315 - RNA, 21 nt, Artificial Sequence
  Synthetic
uauauauuauuagggcgaagu

SEQ ID NO: 17316 - RNA, 22 nt, Artificial Sequence
  Synthetic
auauauauuauuagggcgaagu

SEQ ID NO: 17317 - RNA, 23 nt, Artificial Sequence
  Synthetic
uauauauauuauuagggcgaagu

SEQ ID NO: 17318 - RNA, 24 nt, Artificial Sequence
  Synthetic
auauauauauuauuagggcgaagu

SEQ ID NO: 17319 - RNA, 18 nt, Artificial Sequence
  Synthetic
ggagucgcagagggccgu

SEQ ID NO: 17320 - RNA, 19 nt, Artificial Sequence
  Synthetic
gggagucgcagagggccgu

SEQ ID NO: 17321 - RNA, 20 nt, Artificial Sequence
  Synthetic
cgggagucgcagagggccgu

SEQ ID NO: 17322 - RNA, 21 nt, Artificial Sequence
  Synthetic
gcgggagucgcagagggccgu

SEQ ID NO: 17323 - RNA, 22 nt, Artificial Sequence
  Synthetic
agcgggagucgcagagggccgu

SEQ ID NO: 17324 - RNA, 23 nt, Artificial Sequence
  Synthetic
gagcgggagucgcagagggccgu

SEQ ID NO: 17325 - RNA, 24 nt, Artificial Sequence
  Synthetic
ggagcgggagucgcagagggccgu

SEQ ID NO: 17326 - RNA, 18 nt, Artificial Sequence
  Synthetic
gucgggcgucgggaucgu

SEQ ID NO: 17327 - RNA, 19 nt, Artificial Sequence
  Synthetic
ggucgggcgucgggaucgu

SEQ ID NO: 17328 - RNA, 20 nt, Artificial Sequence
  Synthetic
gggucgggcgucgggaucgu

SEQ ID NO: 17329 - RNA, 21 nt, Artificial Sequence
  Synthetic
ggggucgggcgucgggaucgu

SEQ ID NO: 17330 - RNA, 22 nt, Artificial Sequence
  Synthetic
cggggucgggcgucgggaucgu

SEQ ID NO: 17331 - RNA, 23 nt, Artificial Sequence
  Synthetic
gcggggucgggcgucgggaucgu

SEQ ID NO: 17332 - RNA, 24 nt, Artificial Sequence
  Synthetic
cgcggggucgggcgucgggaucgu

SEQ ID NO: 17333 - RNA, 18 nt, Artificial Sequence
  Synthetic
ggcucgaaaggcgggggu

SEQ ID NO: 17334 - RNA, 19 nt, Artificial Sequence
  Synthetic
cggcucgaaaggcgggggu

SEQ ID NO: 17335 - RNA, 20 nt, Artificial Sequence
  Synthetic
ucggcucgaaaggcgggggu

SEQ ID NO: 17336 - RNA, 21 nt, Artificial Sequence
  Synthetic
gucggcucgaaaggcgggggu

SEQ ID NO: 17337 - RNA, 22 nt, Artificial Sequence
  Synthetic
cgucggcucgaaaggcgggggu

SEQ ID NO: 17338 - RNA, 23 nt, Artificial Sequence
  Synthetic
ucgucggcucgaaaggcgggggu

SEQ ID NO: 17339 - RNA, 24 nt, Artificial Sequence
  Synthetic
gucgucggcucgaaaggcgggggu

SEQ ID NO: 17340 - RNA, 18 nt, Artificial Sequence
  Synthetic
ccggcccggggccgcgaa

SEQ ID NO: 17341 - RNA, 19 nt, Artificial Sequence
  Synthetic
cccggcccggggccgcgaa

SEQ ID NO: 17342 - RNA, 20 nt, Artificial Sequence
  Synthetic
ccccggcccggggccgcgaa

SEQ ID NO: 17343 - RNA, 21 nt, Artificial Sequence
  Synthetic
gccccggcccggggccgcgaa

SEQ ID NO: 17344 - RNA, 22 nt, Artificial Sequence
  Synthetic
ggccccggcccggggccgcgaa

SEQ ID NO: 17345 - RNA, 23 nt, Artificial Sequence
  Synthetic
gggccccggcccggggccgcgaa

SEQ ID NO: 17346 - RNA, 24 nt, Artificial Sequence
  Synthetic
cgggccccggcccggggccgcgaa

SEQ ID NO: 17347 - RNA, 18 nt, Artificial Sequence
  Synthetic
cccggcccggggccgcga

SEQ ID NO: 17348 - RNA, 19 nt, Artificial Sequence
  Synthetic
ccccggcccggggccgcga

SEQ ID NO: 17349 - RNA, 20 nt, Artificial Sequence
  Synthetic
gccccggcccggggccgcga

SEQ ID NO: 17350 - RNA, 21 nt, Artificial Sequence
  Synthetic
ggccccggcccggggccgcga

SEQ ID NO: 17351 - RNA, 22 nt, Artificial Sequence
  Synthetic
gggccccggcccggggccgcga

SEQ ID NO: 17352 - RNA, 23 nt, Artificial Sequence
  Synthetic
cgggccccggcccggggccgcga

SEQ ID NO: 17353 - RNA, 24 nt, Artificial Sequence
  Synthetic
ccgggccccggcccggggccgcga

SEQ ID NO: 17354 - RNA, 18 nt, Artificial Sequence
  Synthetic
agccgacgccgccggcga

SEQ ID NO: 17355 - RNA, 19 nt, Artificial Sequence
  Synthetic
cagccgacgccgccggcga

SEQ ID NO: 17356 - RNA, 20 nt, Artificial Sequence
  Synthetic
gcagccgacgccgccggcga

SEQ ID NO: 17357 - RNA, 21 nt, Artificial Sequence
  Synthetic
cgcagccgacgccgccggcga

SEQ ID NO: 17358 - RNA, 22 nt, Artificial Sequence
  Synthetic
acgcagccgacgccgccggcga

SEQ ID NO: 17359 - RNA, 23 nt, Artificial Sequence
  Synthetic
gacgcagccgacgccgccggcga

SEQ ID NO: 17360 - RNA, 24 nt, Artificial Sequence
  Synthetic
cgacgcagccgacgccgccggcga

SEQ ID NO: 17361 - RNA, 18 nt, Artificial Sequence
  Synthetic
ucgagccgacgacgauga

SEQ ID NO: 17362 - RNA, 19 nt, Artificial Sequence
  Synthetic
uucgagccgacgacgauga

SEQ ID NO: 17363 - RNA, 20 nt, Artificial Sequence
  Synthetic
uuucgagccgacgacgauga

SEQ ID NO: 17364 - RNA, 21 nt, Artificial Sequence
  Synthetic
cuuucgagccgacgacgauga

SEQ ID NO: 17365 - RNA, 22 nt, Artificial Sequence
  Synthetic
ccuuucgagccgacgacgauga

SEQ ID NO: 17366 - RNA, 23 nt, Artificial Sequence
  Synthetic
gccuuucgagccgacgacgauga

SEQ ID NO: 17367 - RNA, 24 nt, Artificial Sequence
  Synthetic
cgccuuucgagccgacgacgauga

SEQ ID NO: 17368 - RNA, 18 nt, Artificial Sequence
  Synthetic
ccuaauaauauauauaua

SEQ ID NO: 17369 - RNA, 19 nt, Artificial Sequence
  Synthetic
cccuaauaauauauauaua

SEQ ID NO: 17370 - RNA, 20 nt, Artificial Sequence
  Synthetic
gcccuaauaauauauauaua

SEQ ID NO: 17371 - RNA, 21 nt, Artificial Sequence
  Synthetic
cgcccuaauaauauauauaua

SEQ ID NO: 17372 - RNA, 22 nt, Artificial Sequence
  Synthetic
ucgcccuaauaauauauauaua

SEQ ID NO: 17373 - RNA, 23 nt, Artificial Sequence
  Synthetic
uucgcccuaauaauauauauaua

SEQ ID NO: 17374 - RNA, 24 nt, Artificial Sequence
  Synthetic
cuucgcccuaauaauauauauaua

SEQ ID NO: 17375 - RNA, 18 nt, Artificial Sequence
  Synthetic
cugcuggccuccauggua

SEQ ID NO: 17376 - RNA, 19 nt, Artificial Sequence
  Synthetic
ucugcuggccuccauggua

SEQ ID NO: 17377 - RNA, 20 nt, Artificial Sequence
  Synthetic
cucugcuggccuccauggua

SEQ ID NO: 17378 - RNA, 21 nt, Artificial Sequence
  Synthetic
gcucugcuggccuccauggua

SEQ ID NO: 17379 - RNA, 22 nt, Artificial Sequence
  Synthetic
ggcucugcuggccuccauggua

SEQ ID NO: 17380 - RNA, 23 nt, Artificial Sequence
  Synthetic
uggcucugcuggccuccauggua

SEQ ID NO: 17381 - RNA, 24 nt, Artificial Sequence
  Synthetic
cuggcucugcuggccuccauggua

SEQ ID NO: 17382 - RNA, 18 nt, Artificial Sequence
  Synthetic
cggcccggggccgcgaac

SEQ ID NO: 17383 - RNA, 19 nt, Artificial Sequence
  Synthetic
ccggcccggggccgcgaac

SEQ ID NO: 17384 - RNA, 20 nt, Artificial Sequence
  Synthetic
cccggcccggggccgcgaac

SEQ ID NO: 17385 - RNA, 21 nt, Artificial Sequence
  Synthetic
ccccggcccggggccgcgaac

SEQ ID NO: 17386 - RNA, 22 nt, Artificial Sequence
  Synthetic
gccccggcccggggccgcgaac

SEQ ID NO: 17387 - RNA, 23 nt, Artificial Sequence
  Synthetic
ggccccggcccggggccgcgaac

SEQ ID NO: 17388 - RNA, 24 nt, Artificial Sequence
  Synthetic
gggccccggcccggggccgcgaac

SEQ ID NO: 17389 - RNA, 18 nt, Artificial Sequence
  Synthetic
acgcggccgaccacgcac

SEQ ID NO: 17390 - RNA, 19 nt, Artificial Sequence
  Synthetic
gacgcggccgaccacgcac

SEQ ID NO: 17391 - RNA, 20 nt, Artificial Sequence
  Synthetic
cgacgcggccgaccacgcac

SEQ ID NO: 17392 - RNA, 21 nt, Artificial Sequence
  Synthetic
acgacgcggccgaccacgcac

SEQ ID NO: 17393 - RNA, 22 nt, Artificial Sequence
  Synthetic
aacgacgcggccgaccacgcac

SEQ ID NO: 17394 - RNA, 23 nt, Artificial Sequence
  Synthetic
caacgacgcggccgaccacgcac

SEQ ID NO: 17395 - RNA, 24 nt, Artificial Sequence
  Synthetic
gcaacgacgcggccgaccacgcac

SEQ ID NO: 17396 - RNA, 18 nt, Artificial Sequence
  Synthetic
ucguccucgucguccgac

SEQ ID NO: 17397 - RNA, 19 nt, Artificial Sequence
  Synthetic
uucguccucgucguccgac

SEQ ID NO: 17398 - RNA, 20 nt, Artificial Sequence
  Synthetic
cuucguccucgucguccgac

SEQ ID NO: 17399 - RNA, 21 nt, Artificial Sequence
  Synthetic
ucuucguccucgucguccgac

SEQ ID NO: 17400 - RNA, 22 nt, Artificial Sequence
  Synthetic
cucuucguccucgucguccgac

SEQ ID NO: 17401 - RNA, 23 nt, Artificial Sequence
  Synthetic
ccucuucguccucgucguccgac

SEQ ID NO: 17402 - RNA, 24 nt, Artificial Sequence
  Synthetic
uccucuucguccucgucguccgac

SEQ ID NO: 17403 - RNA, 18 nt, Artificial Sequence
  Synthetic
ucgucguccgacgaggac

SEQ ID NO: 17404 - RNA, 19 nt, Artificial Sequence
  Synthetic
cucgucguccgacgaggac

SEQ ID NO: 17405 - RNA, 20 nt, Artificial Sequence
  Synthetic
ccucgucguccgacgaggac

SEQ ID NO: 17406 - RNA, 21 nt, Artificial Sequence
  Synthetic
uccucgucguccgacgaggac

SEQ ID NO: 17407 - RNA, 22 nt, Artificial Sequence
  Synthetic
guccucgucguccgacgaggac

SEQ ID NO: 17408 - RNA, 23 nt, Artificial Sequence
  Synthetic
cguccucgucguccgacgaggac

SEQ ID NO: 17409 - RNA, 24 nt, Artificial Sequence
  Synthetic
ucguccucgucguccgacgaggac

SEQ ID NO: 17410 - RNA, 18 nt, Artificial Sequence
  Synthetic
cgagccgacgacgaugac

SEQ ID NO: 17411 - RNA, 19 nt, Artificial Sequence
  Synthetic
ucgagccgacgacgaugac

SEQ ID NO: 17412 - RNA, 20 nt, Artificial Sequence
  Synthetic
uucgagccgacgacgaugac

SEQ ID NO: 17413 - RNA, 21 nt, Artificial Sequence
  Synthetic
uuucgagccgacgacgaugac

SEQ ID NO: 17414 - RNA, 22 nt, Artificial Sequence
  Synthetic
cuuucgagccgacgacgaugac

SEQ ID NO: 17415 - RNA, 23 nt, Artificial Sequence
  Synthetic
ccuuucgagccgacgacgaugac

SEQ ID NO: 17416 - RNA, 24 nt, Artificial Sequence
  Synthetic
gccuuucgagccgacgacgaugac

SEQ ID NO: 17417 - RNA, 18 nt, Artificial Sequence
  Synthetic
ggcgcguauccggacccc

SEQ ID NO: 17418 - RNA, 19 nt, Artificial Sequence
  Synthetic
cggcgcguauccggacccc

SEQ ID NO: 17419 - RNA, 20 nt, Artificial Sequence
  Synthetic
gcggcgcguauccggacccc

SEQ ID NO: 17420 - RNA, 21 nt, Artificial Sequence
  Synthetic
cgcggcgcguauccggacccc

SEQ ID NO: 17421 - RNA, 22 nt, Artificial Sequence
  Synthetic
acgcggcgcguauccggacccc

SEQ ID NO: 17422 - RNA, 23 nt, Artificial Sequence
  Synthetic
uacgcggcgcguauccggacccc

SEQ ID NO: 17423 - RNA, 24 nt, Artificial Sequence
  Synthetic
cuacgcggcgcguauccggacccc

SEQ ID NO: 17424 - RNA, 18 nt, Artificial Sequence
  Synthetic
cccggcggccccgccccc

SEQ ID NO: 17425 - RNA, 19 nt, Artificial Sequence
  Synthetic
acccggcggccccgccccc

SEQ ID NO: 17426 - RNA, 20 nt, Artificial Sequence
  Synthetic
uacccggcggccccgccccc

SEQ ID NO: 17427 - RNA, 21 nt, Artificial Sequence
  Synthetic
uuacccggcggccccgccccc

SEQ ID NO: 17428 - RNA, 22 nt, Artificial Sequence
  Synthetic
uuuacccggcggccccgccccc

SEQ ID NO: 17429 - RNA, 23 nt, Artificial Sequence
  Synthetic
uuuuacccggcggccccgccccc

SEQ ID NO: 17430 - RNA, 24 nt, Artificial Sequence
  Synthetic
cuuuuacccggcggccccgccccc

SEQ ID NO: 17431 - RNA, 18 nt, Artificial Sequence
  Synthetic
gccgcccgggcccgcccc

SEQ ID NO: 17432 - RNA, 19 nt, Artificial Sequence
  Synthetic
cgccgcccgggcccgcccc

SEQ ID NO: 17433 - RNA, 20 nt, Artificial Sequence
  Synthetic
ccgccgcccgggcccgcccc

SEQ ID NO: 17434 - RNA, 21 nt, Artificial Sequence
  Synthetic
cccgccgcccgggcccgcccc

SEQ ID NO: 17435 - RNA, 22 nt, Artificial Sequence
  Synthetic
ccccgccgcccgggcccgcccc

SEQ ID NO: 17436 - RNA, 23 nt, Artificial Sequence
  Synthetic
cccccgccgcccgggcccgcccc

SEQ ID NO: 17437 - RNA, 24 nt, Artificial Sequence
  Synthetic
ccccccgccgcccgggcccgcccc

SEQ ID NO: 17438 - RNA, 18 nt, Artificial Sequence
  Synthetic
gcgcggcgccggcagccc

SEQ ID NO: 17439 - RNA, 19 nt, Artificial Sequence
  Synthetic
agcgcggcgccggcagccc

SEQ ID NO: 17440 - RNA, 20 nt, Artificial Sequence
  Synthetic
gagcgcggcgccggcagccc

SEQ ID NO: 17441 - RNA, 21 nt, Artificial Sequence
  Synthetic
cgagcgcggcgccggcagccc

SEQ ID NO: 17442 - RNA, 22 nt, Artificial Sequence
  Synthetic
ucgagcgcggcgccggcagccc

SEQ ID NO: 17443 - RNA, 23 nt, Artificial Sequence
  Synthetic
gucgagcgcggcgccggcagccc

SEQ ID NO: 17444 - RNA, 24 nt, Artificial Sequence
  Synthetic
cgucgagcgcggcgccggcagccc

SEQ ID NO: 17445 - RNA, 18 nt, Artificial Sequence
  Synthetic
cgccgcccgggcccgccc

SEQ ID NO: 17446 - RNA, 19 nt, Artificial Sequence
  Synthetic
ccgccgcccgggcccgccc

SEQ ID NO: 17447 - RNA, 20 nt, Artificial Sequence
  Synthetic
cccgccgcccgggcccgccc

SEQ ID NO: 17448 - RNA, 21 nt, Artificial Sequence
  Synthetic
ccccgccgcccgggcccgccc

SEQ ID NO: 17449 - RNA, 22 nt, Artificial Sequence
  Synthetic
cccccgccgcccgggcccgccc

SEQ ID NO: 17450 - RNA, 23 nt, Artificial Sequence
  Synthetic
ccccccgccgcccgggcccgccc

SEQ ID NO: 17451 - RNA, 24 nt, Artificial Sequence
  Synthetic
gccccccgccgcccgggcccgccc

SEQ ID NO: 17452 - RNA, 18 nt, Artificial Sequence
  Synthetic
uucugucgucggaggccc

SEQ ID NO: 17453 - RNA, 19 nt, Artificial Sequence
  Synthetic
uuucugucgucggaggccc

SEQ ID NO: 17454 - RNA, 20 nt, Artificial Sequence
  Synthetic
guuucugucgucggaggccc

SEQ ID NO: 17455 - RNA, 21 nt, Artificial Sequence
  Synthetic
gguuucugucgucggaggccc

SEQ ID NO: 17456 - RNA, 22 nt, Artificial Sequence
  Synthetic
ggguuucugucgucggaggccc

SEQ ID NO: 17457 - RNA, 23 nt, Artificial Sequence
  Synthetic
uggguuucugucgucggaggccc

SEQ ID NO: 17458 - RNA, 24 nt, Artificial Sequence
  Synthetic
guggguuucugucgucggaggccc

SEQ ID NO: 17459 - RNA, 18 nt, Artificial Sequence
  Synthetic
gacgccggcgaggacgcc

SEQ ID NO: 17460 - RNA, 19 nt, Artificial Sequence
  Synthetic
cgacgccggcgaggacgcc

SEQ ID NO: 17461 - RNA, 20 nt, Artificial Sequence
  Synthetic
ccgacgccggcgaggacgcc

SEQ ID NO: 17462 - RNA, 21 nt, Artificial Sequence
  Synthetic
accgacgccggcgaggacgcc

SEQ ID NO: 17463 - RNA, 22 nt, Artificial Sequence
  Synthetic
caccgacgccggcgaggacgcc

SEQ ID NO: 17464 - RNA, 23 nt, Artificial Sequence
  Synthetic
gcaccgacgccggcgaggacgcc

SEQ ID NO: 17465 - RNA, 24 nt, Artificial Sequence
  Synthetic
ggcaccgacgccggcgaggacgcc

SEQ ID NO: 17466 - RNA, 18 nt, Artificial Sequence
  Synthetic
cccgccggcccagccgcc

SEQ ID NO: 17467 - RNA, 19 nt, Artificial Sequence
  Synthetic
gcccgccggcccagccgcc

SEQ ID NO: 17468 - RNA, 20 nt, Artificial Sequence
  Synthetic
cgcccgccggcccagccgcc

SEQ ID NO: 17469 - RNA, 21 nt, Artificial Sequence
  Synthetic
gcgcccgccggcccagccgcc

SEQ ID NO: 17470 - RNA, 22 nt, Artificial Sequence
  Synthetic
cgcgcccgccggcccagccgcc

SEQ ID NO: 17471 - RNA, 23 nt, Artificial Sequence
  Synthetic
ccgcgcccgccggcccagccgcc

SEQ ID NO: 17472 - RNA, 24 nt, Artificial Sequence
  Synthetic
gccgcgcccgccggcccagccgcc

SEQ ID NO: 17473 - RNA, 18 nt, Artificial Sequence
  Synthetic
ccccgcggccucgccgcc

SEQ ID NO: 17474 - RNA, 19 nt, Artificial Sequence
  Synthetic
accccgcggccucgccgcc

SEQ ID NO: 17475 - RNA, 20 nt, Artificial Sequence
  Synthetic
gaccccgcggccucgccgcc

SEQ ID NO: 17476 - RNA, 21 nt, Artificial Sequence
  Synthetic
cgaccccgcggccucgccgcc

SEQ ID NO: 17477 - RNA, 22 nt, Artificial Sequence
  Synthetic
ccgaccccgcggccucgccgcc

SEQ ID NO: 17478 - RNA, 23 nt, Artificial Sequence
  Synthetic
cccgaccccgcggccucgccgcc

SEQ ID NO: 17479 - RNA, 24 nt, Artificial Sequence
  Synthetic
gcccgaccccgcggccucgccgcc

SEQ ID NO: 17480 - RNA, 18 nt, Artificial Sequence
  Synthetic
ggcgaccgggccccggcc

SEQ ID NO: 17481 - RNA, 19 nt, Artificial Sequence
  Synthetic
cggcgaccgggccccggcc

SEQ ID NO: 17482 - RNA, 20 nt, Artificial Sequence
  Synthetic
ccggcgaccgggccccggcc

SEQ ID NO: 17483 - RNA, 21 nt, Artificial Sequence
  Synthetic
gccggcgaccgggccccggcc

SEQ ID NO: 17484 - RNA, 22 nt, Artificial Sequence
  Synthetic
cgccggcgaccgggccccggcc

SEQ ID NO: 17485 - RNA, 23 nt, Artificial Sequence
  Synthetic
ccgccggcgaccgggccccggcc

SEQ ID NO: 17486 - RNA, 24 nt, Artificial Sequence
  Synthetic
gccgccggcgaccgggccccggcc

SEQ ID NO: 17487 - RNA, 18 nt, Artificial Sequence
  Synthetic
gggccccggcccggggcc

SEQ ID NO: 17488 - RNA, 19 nt, Artificial Sequence
  Synthetic
cgggccccggcccggggcc

SEQ ID NO: 17489 - RNA, 20 nt, Artificial Sequence
  Synthetic
ccgggccccggcccggggcc

SEQ ID NO: 17490 - RNA, 21 nt, Artificial Sequence
  Synthetic
accgggccccggcccggggcc

SEQ ID NO: 17491 - RNA, 22 nt, Artificial Sequence
  Synthetic
gaccgggccccggcccggggcc

SEQ ID NO: 17492 - RNA, 23 nt, Artificial Sequence
  Synthetic
cgaccgggccccggcccggggcc

SEQ ID NO: 17493 - RNA, 24 nt, Artificial Sequence
  Synthetic
gcgaccgggccccggcccggggcc

SEQ ID NO: 17494 - RNA, 18 nt, Artificial Sequence
  Synthetic
gcgaucccgaucccgagc

SEQ ID NO: 17495 - RNA, 19 nt, Artificial Sequence
  Synthetic
ugcgaucccgaucccgagc

SEQ ID NO: 17496 - RNA, 20 nt, Artificial Sequence
  Synthetic
augcgaucccgaucccgagc

SEQ ID NO: 17497 - RNA, 21 nt, Artificial Sequence
  Synthetic
gaugcgaucccgaucccgagc

SEQ ID NO: 17498 - RNA, 22 nt, Artificial Sequence
  Synthetic
cgaugcgaucccgaucccgagc

SEQ ID NO: 17499 - RNA, 23 nt, Artificial Sequence
  Synthetic
ccgaugcgaucccgaucccgagc

SEQ ID NO: 17500 - RNA, 24 nt, Artificial Sequence
  Synthetic
uccgaugcgaucccgaucccgagc

SEQ ID NO: 17501 - RNA, 18 nt, Artificial Sequence
  Synthetic
cgacgccggcgaggacgc

SEQ ID NO: 17502 - RNA, 19 nt, Artificial Sequence
  Synthetic
ccgacgccggcgaggacgc

SEQ ID NO: 17503 - RNA, 20 nt, Artificial Sequence
  Synthetic
accgacgccggcgaggacgc

SEQ ID NO: 17504 - RNA, 21 nt, Artificial Sequence
  Synthetic
caccgacgccggcgaggacgc

SEQ ID NO: 17505 - RNA, 22 nt, Artificial Sequence
  Synthetic
gcaccgacgccggcgaggacgc

SEQ ID NO: 17506 - RNA, 23 nt, Artificial Sequence
  Synthetic
ggcaccgacgccggcgaggacgc

SEQ ID NO: 17507 - RNA, 24 nt, Artificial Sequence
  Synthetic
gggcaccgacgccggcgaggacgc

SEQ ID NO: 17508 - RNA, 18 nt, Artificial Sequence
  Synthetic
agacccgccccccgccgc

SEQ ID NO: 17509 - RNA, 19 nt, Artificial Sequence
  Synthetic
gagacccgccccccgccgc

SEQ ID NO: 17510 - RNA, 20 nt, Artificial Sequence
  Synthetic
agagacccgccccccgccgc

SEQ ID NO: 17511 - RNA, 21 nt, Artificial Sequence
  Synthetic
gagagacccgccccccgccgc

SEQ ID NO: 17512 - RNA, 22 nt, Artificial Sequence
  Synthetic
ggagagacccgccccccgccgc

SEQ ID NO: 17513 - RNA, 23 nt, Artificial Sequence
  Synthetic
cggagagacccgccccccgccgc

SEQ ID NO: 17514 - RNA, 24 nt, Artificial Sequence
  Synthetic
ccggagagacccgccccccgccgc

SEQ ID NO: 17515 - RNA, 18 nt, Artificial Sequence
  Synthetic
ccgggccuuuaugugcgc

SEQ ID NO: 17516 - RNA, 19 nt, Artificial Sequence
  Synthetic
gccgggccuuuaugugcgc

SEQ ID NO: 17517 - RNA, 20 nt, Artificial Sequence
  Synthetic
cgccgggccuuuaugugcgc

SEQ ID NO: 17518 - RNA, 21 nt, Artificial Sequence
  Synthetic
gcgccgggccuuuaugugcgc

SEQ ID NO: 17519 - RNA, 22 nt, Artificial Sequence
  Synthetic
cgcgccgggccuuuaugugcgc

SEQ ID NO: 17520 - RNA, 23 nt, Artificial Sequence
  Synthetic
ucgcgccgggccuuuaugugcgc

SEQ ID NO: 17521 - RNA, 24 nt, Artificial Sequence
  Synthetic
gucgcgccgggccuuuaugugcgc

SEQ ID NO: 17522 - RNA, 18 nt, Artificial Sequence
  Synthetic
cgaccacgcacgcgaggc

SEQ ID NO: 17523 - RNA, 19 nt, Artificial Sequence
  Synthetic
ccgaccacgcacgcgaggc

SEQ ID NO: 17524 - RNA, 20 nt, Artificial Sequence
  Synthetic
gccgaccacgcacgcgaggc

SEQ ID NO: 17525 - RNA, 21 nt, Artificial Sequence
  Synthetic
ggccgaccacgcacgcgaggc

SEQ ID NO: 17526 - RNA, 22 nt, Artificial Sequence
  Synthetic
cggccgaccacgcacgcgaggc

SEQ ID NO: 17527 - RNA, 23 nt, Artificial Sequence
  Synthetic
gcggccgaccacgcacgcgaggc

SEQ ID NO: 17528 - RNA, 24 nt, Artificial Sequence
  Synthetic
cgcggccgaccacgcacgcgaggc

SEQ ID NO: 17529 - RNA, 18 nt, Artificial Sequence
  Synthetic
cggcgaccgggccccggc

SEQ ID NO: 17530 - RNA, 19 nt, Artificial Sequence
  Synthetic
ccggcgaccgggccccggc

SEQ ID NO: 17531 - RNA, 20 nt, Artificial Sequence
  Synthetic
gccggcgaccgggccccggc

SEQ ID NO: 17532 - RNA, 21 nt, Artificial Sequence
  Synthetic
cgccggcgaccgggccccggc

SEQ ID NO: 17533 - RNA, 22 nt, Artificial Sequence
  Synthetic
ccgccggcgaccgggccccggc

SEQ ID NO: 17534 - RNA, 23 nt, Artificial Sequence
  Synthetic
gccgccggcgaccgggccccggc

SEQ ID NO: 17535 - RNA, 24 nt, Artificial Sequence
  Synthetic
cgccgccggcgaccgggccccggc

SEQ ID NO: 17536 - RNA, 18 nt, Artificial Sequence
  Synthetic
cccgcccccggggccggc

SEQ ID NO: 17537 - RNA, 19 nt, Artificial Sequence
  Synthetic
gcccgcccccggggccggc

SEQ ID NO: 17538 - RNA, 20 nt, Artificial Sequence
  Synthetic
ggcccgcccccggggccggc

SEQ ID NO: 17539 - RNA, 21 nt, Artificial Sequence
  Synthetic
gggcccgcccccggggccggc

SEQ ID NO: 17540 - RNA, 22 nt, Artificial Sequence
  Synthetic
cgggcccgcccccggggccggc

SEQ ID NO: 17541 - RNA, 23 nt, Artificial Sequence
  Synthetic
ccgggcccgcccccggggccggc

SEQ ID NO: 17542 - RNA, 24 nt, Artificial Sequence
  Synthetic
cccgggcccgcccccggggccggc

SEQ ID NO: 17543 - RNA, 18 nt, Artificial Sequence
  Synthetic
uccgaugcgaucccgauc

SEQ ID NO: 17544 - RNA, 19 nt, Artificial Sequence
  Synthetic
uuccgaugcgaucccgauc

SEQ ID NO: 17545 - RNA, 20 nt, Artificial Sequence
  Synthetic
uuuccgaugcgaucccgauc

SEQ ID NO: 17546 - RNA, 21 nt, Artificial Sequence
  Synthetic
cuuuccgaugcgaucccgauc

SEQ ID NO: 17547 - RNA, 22 nt, Artificial Sequence
  Synthetic
ccuuuccgaugcgaucccgauc

SEQ ID NO: 17548 - RNA, 23 nt, Artificial Sequence
  Synthetic
cccuuuccgaugcgaucccgauc

SEQ ID NO: 17549 - RNA, 24 nt, Artificial Sequence
  Synthetic
ucccuuuccgaugcgaucccgauc

SEQ ID NO: 17550 - RNA, 18 nt, Artificial Sequence
  Synthetic
cuuacccgugcaaaaaag

SEQ ID NO: 17551 - RNA, 19 nt, Artificial Sequence
  Synthetic
gcuuacccgugcaaaaaag

SEQ ID NO: 17552 - RNA, 20 nt, Artificial Sequence
  Synthetic
ugcuuacccgugcaaaaaag

SEQ ID NO: 17553 - RNA, 21 nt, Artificial Sequence
  Synthetic
gugcuuacccgugcaaaaaag

SEQ ID NO: 17554 - RNA, 22 nt, Artificial Sequence
  Synthetic
ggugcuuacccgugcaaaaaag

SEQ ID NO: 17555 - RNA, 23 nt, Artificial Sequence
  Synthetic
aggugcuuacccgugcaaaaaag

SEQ ID NO: 17556 - RNA, 24 nt, Artificial Sequence
  Synthetic
aaggugcuuacccgugcaaaaaag

SEQ ID NO: 17557 - RNA, 18 nt, Artificial Sequence
  Synthetic
ugcgaucccgaucccgag

SEQ ID NO: 17558 - RNA, 19 nt, Artificial Sequence
  Synthetic
augcgaucccgaucccgag

SEQ ID NO: 17559 - RNA, 20 nt, Artificial Sequence
  Synthetic
gaugcgaucccgaucccgag

SEQ ID NO: 17560 - RNA, 21 nt, Artificial Sequence
  Synthetic
cgaugcgaucccgaucccgag

SEQ ID NO: 17561 - RNA, 22 nt, Artificial Sequence
  Synthetic
ccgaugcgaucccgaucccgag

SEQ ID NO: 17562 - RNA, 23 nt, Artificial Sequence
  Synthetic
uccgaugcgaucccgaucccgag

SEQ ID NO: 17563 - RNA, 24 nt, Artificial Sequence
  Synthetic
uuccgaugcgaucccgaucccgag

SEQ ID NO: 17564 - RNA, 18 nt, Artificial Sequence
  Synthetic
cccggggccggcgcggag

SEQ ID NO: 17565 - RNA, 19 nt, Artificial Sequence
  Synthetic
ccccggggccggcgcggag

SEQ ID NO: 17566 - RNA, 20 nt, Artificial Sequence
  Synthetic
cccccggggccggcgcggag

SEQ ID NO: 17567 - RNA, 21 nt, Artificial Sequence
  Synthetic
gcccccggggccggcgcggag

SEQ ID NO: 17568 - RNA, 22 nt, Artificial Sequence
  Synthetic
cgcccccggggccggcgcggag

SEQ ID NO: 17569 - RNA, 23 nt, Artificial Sequence
  Synthetic
ccgcccccggggccggcgcggag

SEQ ID NO: 17570 - RNA, 24 nt, Artificial Sequence
  Synthetic
cccgcccccggggccggcgcggag

SEQ ID NO: 17571 - RNA, 18 nt, Artificial Sequence
  Synthetic
ugcuggccuccaugguag

SEQ ID NO: 17572 - RNA, 19 nt, Artificial Sequence
  Synthetic
cugcuggccuccaugguag

SEQ ID NO: 17573 - RNA, 20 nt, Artificial Sequence
  Synthetic
ucugcuggccuccaugguag

SEQ ID NO: 17574 - RNA, 21 nt, Artificial Sequence
  Synthetic
cucugcuggccuccaugguag

SEQ ID NO: 17575 - RNA, 22 nt, Artificial Sequence
  Synthetic
gcucugcuggccuccaugguag

SEQ ID NO: 17576 - RNA, 23 nt, Artificial Sequence
  Synthetic
ggcucugcuggccuccaugguag

SEQ ID NO: 17577 - RNA, 24 nt, Artificial Sequence
  Synthetic
uggcucugcuggccuccaugguag

SEQ ID NO: 17578 - RNA, 18 nt, Artificial Sequence
  Synthetic
ccgacgccggcgaggacg

SEQ ID NO: 17579 - RNA, 19 nt, Artificial Sequence
  Synthetic
accgacgccggcgaggacg

SEQ ID NO: 17580 - RNA, 20 nt, Artificial Sequence
  Synthetic
caccgacgccggcgaggacg

SEQ ID NO: 17581 - RNA, 18 nt, Artificial Sequence
  Synthetic
ccgccggcccagccgccg

SEQ ID NO: 17582 - RNA, 19 nt, Artificial Sequence
  Synthetic
cccgccggcccagccgccg

SEQ ID NO: 17583 - RNA, 20 nt, Artificial Sequence
  Synthetic
gcccgccggcccagccgccg

SEQ ID NO: 17584 - RNA, 21 nt, Artificial Sequence
  Synthetic
cgcccgccggcccagccgccg

SEQ ID NO: 17585 - RNA, 22 nt, Artificial Sequence
  Synthetic
gcgcccgccggcccagccgccg

SEQ ID NO: 17586 - RNA, 23 nt, Artificial Sequence
  Synthetic
cgcgcccgccggcccagccgccg

SEQ ID NO: 17587 - RNA, 24 nt, Artificial Sequence
  Synthetic
ccgcgcccgccggcccagccgccg

SEQ ID NO: 17588 - RNA, 18 nt, Artificial Sequence
  Synthetic
gggccuuuaugugcgccg

SEQ ID NO: 17589 - RNA, 19 nt, Artificial Sequence
  Synthetic
cgggccuuuaugugcgccg

SEQ ID NO: 17590 - RNA, 20 nt, Artificial Sequence
  Synthetic
ccgggccuuuaugugcgccg

SEQ ID NO: 17591 - RNA, 21 nt, Artificial Sequence
  Synthetic
gccgggccuuuaugugcgccg

SEQ ID NO: 17592 - RNA, 22 nt, Artificial Sequence
  Synthetic
cgccgggccuuuaugugcgccg

SEQ ID NO: 17593 - RNA, 23 nt, Artificial Sequence
  Synthetic
gcgccgggccuuuaugugcgccg

SEQ ID NO: 17594 - RNA, 24 nt, Artificial Sequence
  Synthetic
cgcgccgggccuuuaugugcgccg

SEQ ID NO: 17595 - RNA, 18 nt, Artificial Sequence
  Synthetic
cacgcgaggcgcgggccg

SEQ ID NO: 17596 - RNA, 19 nt, Artificial Sequence
  Synthetic
gcacgcgaggcgcgggccg

SEQ ID NO: 17597 - RNA, 20 nt, Artificial Sequence
  Synthetic
cgcacgcgaggcgcgggccg

SEQ ID NO: 17598 - RNA, 21 nt, Artificial Sequence
  Synthetic
acgcacgcgaggcgcgggccg

SEQ ID NO: 17599 - RNA, 22 nt, Artificial Sequence
  Synthetic
cacgcacgcgaggcgcgggccg

SEQ ID NO: 17600 - RNA, 23 nt, Artificial Sequence
  Synthetic
ccacgcacgcgaggcgcgggccg

SEQ ID NO: 17601 - RNA, 24 nt, Artificial Sequence
  Synthetic
accacgcacgcgaggcgcgggccg

SEQ ID NO: 17602 - RNA, 18 nt, Artificial Sequence
  Synthetic
cuucguccucgucguccg

SEQ ID NO: 17603 - RNA, 19 nt, Artificial Sequence
  Synthetic
ucuucguccucgucguccg

SEQ ID NO: 17604 - RNA, 20 nt, Artificial Sequence
  Synthetic
cucuucguccucgucguccg

SEQ ID NO: 17605 - RNA, 21 nt, Artificial Sequence
  Synthetic
ccucuucguccucgucguccg

SEQ ID NO: 17606 - RNA, 22 nt, Artificial Sequence
  Synthetic
uccucuucguccucgucguccg

SEQ ID NO: 17607 - RNA, 23 nt, Artificial Sequence
  Synthetic
auccucuucguccucgucguccg

SEQ ID NO: 17608 - RNA, 24 nt, Artificial Sequence
  Synthetic
cauccucuucguccucgucguccg

SEQ ID NO: 17609 - RNA, 18 nt, Artificial Sequence
  Synthetic
gccgucgggcgggguccg

SEQ ID NO: 17610 - RNA, 19 nt, Artificial Sequence
  Synthetic
ggccgucgggcgggguccg

SEQ ID NO: 17611 - RNA, 20 nt, Artificial Sequence
  Synthetic
gggccgucgggcgggguccg

SEQ ID NO: 17612 - RNA, 21 nt, Artificial Sequence
  Synthetic
cgggccgucgggcgggguccg

SEQ ID NO: 17613 - RNA, 22 nt, Artificial Sequence
  Synthetic
gcgggccgucgggcgggguccg

SEQ ID NO: 17614 - RNA, 23 nt, Artificial Sequence
  Synthetic
cgcgggccgucgggcgggguccg

SEQ ID NO: 17615 - RNA, 24 nt, Artificial Sequence
  Synthetic
gcgcgggccgucgggcgggguccg

SEQ ID NO: 17616 - RNA, 18 nt, Artificial Sequence
  Synthetic
cugcgggcgucggucgcg

SEQ ID NO: 17617 - RNA, 19 nt, Artificial Sequence
  Synthetic
ucugcgggcgucggucgcg

SEQ ID NO: 17618 - RNA, 20 nt, Artificial Sequence
  Synthetic
gucugcgggcgucggucgcg

SEQ ID NO: 17619 - RNA, 21 nt, Artificial Sequence
  Synthetic
cgucugcgggcgucggucgcg

SEQ ID NO: 17620 - RNA, 22 nt, Artificial Sequence
  Synthetic
ccgucugcgggcgucggucgcg

SEQ ID NO: 17621 - RNA, 23 nt, Artificial Sequence
  Synthetic
gccgucugcgggcgucggucgcg

SEQ ID NO: 17622 - RNA, 24 nt, Artificial Sequence
  Synthetic
cgccgucugcgggcgucggucgcg

SEQ ID NO: 17623 - RNA, 18 nt, Artificial Sequence
  Synthetic
gccgggccuuuaugugcg

SEQ ID NO: 17624 - RNA, 19 nt, Artificial Sequence
  Synthetic
cgccgggccuuuaugugcg

SEQ ID NO: 17625 - RNA, 20 nt, Artificial Sequence
  Synthetic
gcgccgggccuuuaugugcg

SEQ ID NO: 17626 - RNA, 21 nt, Artificial Sequence
  Synthetic
cgcgccgggccuuuaugugcg

SEQ ID NO: 17627 - RNA, 22 nt, Artificial Sequence
  Synthetic
ucgcgccgggccuuuaugugcg

SEQ ID NO: 17628 - RNA, 23 nt, Artificial Sequence
  Synthetic
gucgcgccgggccuuuaugugcg

SEQ ID NO: 17629 - RNA, 24 nt, Artificial Sequence
  Synthetic
ggucgcgccgggccuuuaugugcg

SEQ ID NO: 17630 - RNA, 18 nt, Artificial Sequence
  Synthetic
ucggcgucaucgaccucg

SEQ ID NO: 17631 - RNA, 19 nt, Artificial Sequence
  Synthetic
aucggcgucaucgaccucg

SEQ ID NO: 17632 - RNA, 20 nt, Artificial Sequence
  Synthetic
caucggcgucaucgaccucg

SEQ ID NO: 17633 - RNA, 21 nt, Artificial Sequence
  Synthetic
ccaucggcgucaucgaccucg

SEQ ID NO: 17634 - RNA, 22 nt, Artificial Sequence
  Synthetic
gccaucggcgucaucgaccucg

SEQ ID NO: 17635 - RNA, 23 nt, Artificial Sequence
  Synthetic
ggccaucggcgucaucgaccucg

SEQ ID NO: 17636 - RNA, 24 nt, Artificial Sequence
  Synthetic
cggccaucggcgucaucgaccucg

SEQ ID NO: 17637 - RNA, 18 nt, Artificial Sequence
  Synthetic
accgguggguuucugucg

SEQ ID NO: 17638 - RNA, 19 nt, Artificial Sequence
  Synthetic
gaccgguggguuucugucg

SEQ ID NO: 17639 - RNA, 20 nt, Artificial Sequence
  Synthetic
ggaccgguggguuucugucg

SEQ ID NO: 17640 - RNA, 21 nt, Artificial Sequence
  Synthetic
cggaccgguggguuucugucg

SEQ ID NO: 17641 - RNA, 22 nt, Artificial Sequence
  Synthetic
gcggaccgguggguuucugucg

SEQ ID NO: 17642 - RNA, 23 nt, Artificial Sequence
  Synthetic
ggcggaccgguggguuucugucg

SEQ ID NO: 17643 - RNA, 24 nt, Artificial Sequence
  Synthetic
aggcggaccgguggguuucugucg

SEQ ID NO: 17644 - RNA, 18 nt, Artificial Sequence
  Synthetic
ccucgucguccgacgagg

SEQ ID NO: 17645 - RNA, 19 nt, Artificial Sequence
  Synthetic
uccucgucguccgacgagg

SEQ ID NO: 17646 - RNA, 20 nt, Artificial Sequence
  Synthetic
guccucgucguccgacgagg

SEQ ID NO: 17647 - RNA, 21 nt, Artificial Sequence
  Synthetic
cguccucgucguccgacgagg

SEQ ID NO: 17648 - RNA, 22 nt, Artificial Sequence
  Synthetic
ucguccucgucguccgacgagg

SEQ ID NO: 17649 - RNA, 23 nt, Artificial Sequence
  Synthetic
uucguccucgucguccgacgagg

SEQ ID NO: 17650 - RNA, 24 nt, Artificial Sequence
  Synthetic
cuucguccucgucguccgacgagg

SEQ ID NO: 17651 - RNA, 18 nt, Artificial Sequence
  Synthetic
cgaggcgcgggccgucgg

SEQ ID NO: 17652 - RNA, 19 nt, Artificial Sequence
  Synthetic
gcgaggcgcgggccgucgg

SEQ ID NO: 17653 - RNA, 20 nt, Artificial Sequence
  Synthetic
cgcgaggcgcgggccgucgg

SEQ ID NO: 17654 - RNA, 21 nt, Artificial Sequence
  Synthetic
acgcgaggcgcgggccgucgg

SEQ ID NO: 17655 - RNA, 22 nt, Artificial Sequence
  Synthetic
cacgcgaggcgcgggccgucgg

SEQ ID NO: 17656 - RNA, 23 nt, Artificial Sequence
  Synthetic
gcacgcgaggcgcgggccgucgg

SEQ ID NO: 17657 - RNA, 24 nt, Artificial Sequence
  Synthetic
cgcacgcgaggcgcgggccgucgg

SEQ ID NO: 17658 - RNA, 18 nt, Artificial Sequence
  Synthetic
cuguguuucguggguggg

SEQ ID NO: 17659 - RNA, 19 nt, Artificial Sequence
  Synthetic
ccuguguuucguggguggg

SEQ ID NO: 17660 - RNA, 20 nt, Artificial Sequence
  Synthetic
cccuguguuucguggguggg

SEQ ID NO: 17661 - RNA, 21 nt, Artificial Sequence
  Synthetic
ccccuguguuucguggguggg

SEQ ID NO: 17662 - RNA, 22 nt, Artificial Sequence
  Synthetic
uccccuguguuucguggguggg

SEQ ID NO: 17663 - RNA, 23 nt, Artificial Sequence
  Synthetic
guccccuguguuucguggguggg

SEQ ID NO: 17664 - RNA, 24 nt, Artificial Sequence
  Synthetic
cguccccuguguuucguggguggg

SEQ ID NO: 17665 - RNA, 18 nt, Artificial Sequence
  Synthetic
uaauauauauauauuggg

SEQ ID NO: 17666 - RNA, 19 nt, Artificial Sequence
  Synthetic
auaauauauauauauuggg

SEQ ID NO: 17667 - RNA, 20 nt, Artificial Sequence
  Synthetic
aauaauauauauauauuggg

SEQ ID NO: 17668 - RNA, 21 nt, Artificial Sequence
  Synthetic
uaauaauauauauauauuggg

SEQ ID NO: 17669 - RNA, 22 nt, Artificial Sequence
  Synthetic
cuaauaauauauauauauuggg

SEQ ID NO: 17670 - RNA, 23 nt, Artificial Sequence
  Synthetic
ccuaauaauauauauauauuggg

SEQ ID NO: 17671 - RNA, 24 nt, Artificial Sequence
  Synthetic
cccuaauaauauauauauauuggg

SEQ ID NO: 17672 - RNA, 18 nt, Artificial Sequence
  Synthetic
cucugcuggccuccaugg

SEQ ID NO: 17673 - RNA, 19 nt, Artificial Sequence
  Synthetic
gcucugcuggccuccaugg

SEQ ID NO: 17674 - RNA, 20 nt, Artificial Sequence
  Synthetic
ggcucugcuggccuccaugg

SEQ ID NO: 17675 - RNA, 21 nt, Artificial Sequence
  Synthetic
uggcucugcuggccuccaugg

SEQ ID NO: 17676 - RNA, 22 nt, Artificial Sequence
  Synthetic
cuggcucugcuggccuccaugg

SEQ ID NO: 17677 - RNA, 23 nt, Artificial Sequence
  Synthetic
gcuggcucugcuggccuccaugg

SEQ ID NO: 17678 - RNA, 24 nt, Artificial Sequence
  Synthetic
agcuggcucugcuggccuccaugg

SEQ ID NO: 17679 - RNA, 18 nt, Artificial Sequence
  Synthetic
guccccuguguuucgugg

SEQ ID NO: 17680 - RNA, 19 nt, Artificial Sequence
  Synthetic
cguccccuguguuucgugg

SEQ ID NO: 17681 - RNA, 20 nt, Artificial Sequence
  Synthetic
gcguccccuguguuucgugg

SEQ ID NO: 17682 - RNA, 21 nt, Artificial Sequence
  Synthetic
ugcguccccuguguuucgugg

SEQ ID NO: 17683 - RNA, 22 nt, Artificial Sequence
  Synthetic
gugcguccccuguguuucgugg

SEQ ID NO: 17684 - RNA, 23 nt, Artificial Sequence
  Synthetic
ggugcguccccuguguuucgugg

SEQ ID NO: 17685 - RNA, 24 nt, Artificial Sequence
  Synthetic
gggugcguccccuguguuucgugg

SEQ ID NO: 17686 - RNA, 18 nt, Artificial Sequence
  Synthetic
uucgagccgacgacgaug

SEQ ID NO: 17687 - RNA, 19 nt, Artificial Sequence
  Synthetic
uuucgagccgacgacgaug

SEQ ID NO: 17688 - RNA, 20 nt, Artificial Sequence
  Synthetic
cuuucgagccgacgacgaug

SEQ ID NO: 17689 - RNA, 21 nt, Artificial Sequence
  Synthetic
ccuuucgagccgacgacgaug

SEQ ID NO: 17690 - RNA, 22 nt, Artificial Sequence
  Synthetic
gccuuucgagccgacgacgaug

SEQ ID NO: 17691 - RNA, 23 nt, Artificial Sequence
  Synthetic
cgccuuucgagccgacgacgaug

SEQ ID NO: 17692 - RNA, 24 nt, Artificial Sequence
  Synthetic
ccgccuuucgagccgacgacgaug

SEQ ID NO: 17693 - RNA, 18 nt, Artificial Sequence
  Synthetic
cuaauaauauauauauau

SEQ ID NO: 17694 - RNA, 19 nt, Artificial Sequence
  Synthetic
ccuaauaauauauauauau

SEQ ID NO: 17695 - RNA, 20 nt, Artificial Sequence
  Synthetic
cccuaauaauauauauauau

SEQ ID NO: 17696 - RNA, 21 nt, Artificial Sequence
  Synthetic
gcccuaauaauauauauauau

SEQ ID NO: 17697 - RNA, 22 nt, Artificial Sequence
  Synthetic
cgcccuaauaauauauauauau

SEQ ID NO: 17698 - RNA, 23 nt, Artificial Sequence
  Synthetic
ucgcccuaauaauauauauauau

SEQ ID NO: 17699 - RNA, 24 nt, Artificial Sequence
  Synthetic
uucgcccuaauaauauauauauau

SEQ ID NO: 17700 - RNA, 18 nt, Artificial Sequence
  Synthetic
ccgcuacgcggcgcguau

SEQ ID NO: 17701 - RNA, 19 nt, Artificial Sequence
  Synthetic
cccgcuacgcggcgcguau

SEQ ID NO: 17702 - RNA, 20 nt, Artificial Sequence
  Synthetic
ccccgcuacgcggcgcguau

SEQ ID NO: 17703 - RNA, 21 nt, Artificial Sequence
  Synthetic
gccccgcuacgcggcgcguau

SEQ ID NO: 17704 - RNA, 22 nt, Artificial Sequence
  Synthetic
ggccccgcuacgcggcgcguau

SEQ ID NO: 17705 - RNA, 23 nt, Artificial Sequence
  Synthetic
aggccccgcuacgcggcgcguau

SEQ ID NO: 17706 - RNA, 24 nt, Artificial Sequence
  Synthetic
gaggccccgcuacgcggcgcguau

SEQ ID NO: 17707 - RNA, 18 nt, Artificial Sequence
  Synthetic
ucguggccggcgccgucu

SEQ ID NO: 17708 - RNA, 19 nt, Artificial Sequence
  Synthetic
uucguggccggcgccgucu

SEQ ID NO: 17709 - RNA, 20 nt, Artificial Sequence
  Synthetic
guucguggccggcgccgucu

SEQ ID NO: 17710 - RNA, 21 nt, Artificial Sequence
  Synthetic
cguucguggccggcgccgucu

SEQ ID NO: 17711 - RNA, 22 nt, Artificial Sequence
  Synthetic
ucguucguggccggcgccgucu

SEQ ID NO: 17712 - RNA, 23 nt, Artificial Sequence
  Synthetic
gucguucguggccggcgccgucu

SEQ ID NO: 17713 - RNA, 24 nt, Artificial Sequence
  Synthetic
cgucguucguggccggcgccgucu

SEQ ID NO: 17714 - RNA, 18 nt, Artificial Sequence
  Synthetic
uauauauugggacgaagu

SEQ ID NO: 17715 - RNA, 19 nt, Artificial Sequence
  Synthetic
auauauauugggacgaagu

SEQ ID NO: 17716 - RNA, 20 nt, Artificial Sequence
  Synthetic
uauauauauugggacgaagu

SEQ ID NO: 17717 - RNA, 21 nt, Artificial Sequence
  Synthetic
auauauauauugggacgaagu

SEQ ID NO: 17718 - RNA, 22 nt, Artificial Sequence
  Synthetic
uauauauauauugggacgaagu

SEQ ID NO: 17719 - RNA, 23 nt, Artificial Sequence
  Synthetic
auauauauauauugggacgaagu

SEQ ID NO: 17720 - RNA, 24 nt, Artificial Sequence
  Synthetic
aauauauauauauugggacgaagu

SEQ ID NO: 17721 - RNA, 18 nt, Artificial Sequence
  Synthetic
caugguagaggaggccgu

SEQ ID NO: 17722 - RNA, 19 nt, Artificial Sequence
  Synthetic
ccaugguagaggaggccgu

SEQ ID NO: 17723 - RNA, 20 nt, Artificial Sequence
  Synthetic
uccaugguagaggaggccgu

SEQ ID NO: 17724 - RNA, 21 nt, Artificial Sequence
  Synthetic
cuccaugguagaggaggccgu

SEQ ID NO: 17725 - RNA, 22 nt, Artificial Sequence
  Synthetic
ccuccaugguagaggaggccgu

SEQ ID NO: 17726 - RNA, 23 nt, Artificial Sequence
  Synthetic
gccuccaugguagaggaggccgu

SEQ ID NO: 17727 - RNA, 24 nt, Artificial Sequence
  Synthetic
ggccuccaugguagaggaggccgu

SEQ ID NO: 17728 - RNA, 18 nt, Artificial Sequence
  Synthetic
ccgguggguuucugucgu

SEQ ID NO: 17729 - RNA, 19 nt, Artificial Sequence
  Synthetic
accgguggguuucugucgu

SEQ ID NO: 17730 - RNA, 20 nt, Artificial Sequence
  Synthetic
gaccgguggguuucugucgu

SEQ ID NO: 17731 - RNA, 21 nt, Artificial Sequence
  Synthetic
ggaccgguggguuucugucgu

SEQ ID NO: 17732 - RNA, 22 nt, Artificial Sequence
  Synthetic
cggaccgguggguuucugucgu

SEQ ID NO: 17733 - RNA, 23 nt, Artificial Sequence
  Synthetic
gcggaccgguggguuucugucgu

SEQ ID NO: 17734 - RNA, 24 nt, Artificial Sequence
  Synthetic
ggcggaccgguggguuucugucgu

SEQ ID NO: 17735 - RNA, 18 nt, Artificial Sequence
  Synthetic
gccccggacccccgccuu

SEQ ID NO: 17736 - RNA, 19 nt, Artificial Sequence
  Synthetic
cgccccggacccccgccuu

SEQ ID NO: 17737 - RNA, 20 nt, Artificial Sequence
  Synthetic
ccgccccggacccccgccuu

SEQ ID NO: 17738 - RNA, 21 nt, Artificial Sequence
  Synthetic
gccgccccggacccccgccuu

SEQ ID NO: 17739 - RNA, 22 nt, Artificial Sequence
  Synthetic
cgccgccccggacccccgccuu

SEQ ID NO: 17740 - RNA, 23 nt, Artificial Sequence
  Synthetic
ucgccgccccggacccccgccuu

SEQ ID NO: 17741 - RNA, 24 nt, Artificial Sequence
  Synthetic
cucgccgccccggacccccgccuu

SEQ ID NO: 17742 - RNA, 17 nt, Artificial Sequence
  Synthetic
gacggccgaucccccuc

SEQ ID NO: 17743 - RNA, 17 nt, Artificial Sequence
  Synthetic
ggcccggggagccgggg

SEQ ID NO: 17744 - RNA, 17 nt, Artificial Sequence
  Synthetic
aacuagcgcggaccggu

SEQ ID NO: 17745 - RNA, 17 nt, Artificial Sequence
  Synthetic
ccgcccgauccggcggu

SEQ ID NO: 17746 - RNA, 20 nt, Artificial Sequence
  Synthetic
agggacggccgaucccccuc

SEQ ID NO: 17747 - RNA, 20 nt, Artificial Sequence
  Synthetic
uggggcccggggagccgggg

SEQ ID NO: 17748 - RNA, 20 nt, Artificial Sequence
  Synthetic
cggaacuagcgcggaccggu

SEQ ID NO: 17749 - RNA, 17 nt, Artificial Sequence
  Synthetic
ccuccuccgcccaccca

SEQ ID NO: 17750 - RNA, 17 nt, Artificial Sequence
  Synthetic
auauugggacgaagugc

SEQ ID NO: 17751 - RNA, 20 nt, Artificial Sequence
  Synthetic
cccccuccuccgcccaccca

SEQ ID NO: 17752 - RNA, 20 nt, Artificial Sequence
  Synthetic
uauauauugggacgaagugc

SEQ ID NO: 17753 - RNA, 17 nt, Artificial Sequence
  Synthetic
gccauaaucggcgcgca

SEQ ID NO: 17754 - RNA, 17 nt, Artificial Sequence
  Synthetic
gagcccgcccgcgacga

SEQ ID NO: 17755 - RNA, 17 nt, Artificial Sequence
  Synthetic
gcgauggcggacgagga

SEQ ID NO: 17756 - RNA, 17 nt, Artificial Sequence
  Synthetic
gacgagccugccgcgga

SEQ ID NO: 17757 - RNA, 17 nt, Artificial Sequence
  Synthetic
gcggcggcgcgaccaac

SEQ ID NO: 17758 - RNA, 17 nt, Artificial Sequence
  Synthetic
gaucccgucgccccccc

SEQ ID NO: 17759 - RNA, 17 nt, Artificial Sequence
  Synthetic
gagacgaccggcggccc

SEQ ID NO: 17760 - RNA, 17 nt, Artificial Sequence
  Synthetic
gcuggauccggagaucc

SEQ ID NO: 17761 - RNA, 17 nt, Artificial Sequence
  Synthetic
gccgaucggguagaucc

SEQ ID NO: 17762 - RNA, 17 nt, Artificial Sequence
  Synthetic
ggacgggggacgucucc

SEQ ID NO: 17763 - RNA, 17 nt, Artificial Sequence
  Synthetic
gcggaaccccggcgagc

SEQ ID NO: 17764 - RNA, 17 nt, Artificial Sequence
  Synthetic
guuggucgcgccgccgc

SEQ ID NO: 17765 - RNA, 17 nt, Artificial Sequence
  Synthetic
gcggaagccgcccgcgc

SEQ ID NO: 17766 - RNA, 17 nt, Artificial Sequence
  Synthetic
ggucucauuagcaucgc

SEQ ID NO: 17767 - RNA, 17 nt, Artificial Sequence
  Synthetic
ggcggcgguccgucggc

SEQ ID NO: 17768 - RNA, 17 nt, Artificial Sequence
  Synthetic
gccucuccgcgccgauc

SEQ ID NO: 17769 - RNA, 17 nt, Artificial Sequence
  Synthetic
gguccgucggcuggauc

SEQ ID NO: 17770 - RNA, 17 nt, Artificial Sequence
  Synthetic
gcggacgcgcgggcguc

SEQ ID NO: 17771 - RNA, 17 nt, Artificial Sequence
  Synthetic
ggcgacgguccggguuc

SEQ ID NO: 17772 - RNA, 17 nt, Artificial Sequence
  Synthetic
gagcgcggcuaccgacg

SEQ ID NO: 17773 - RNA, 17 nt, Artificial Sequence
  Synthetic
gauggcggacgaggacg

SEQ ID NO: 17774 - RNA, 17 nt, Artificial Sequence
  Synthetic
ggccgccgccacggacg

SEQ ID NO: 17775 - RNA, 17 nt, Artificial Sequence
  Synthetic
ggucgcgauggcggacg

SEQ ID NO: 17776 - RNA, 17 nt, Artificial Sequence
  Synthetic
ggaaccccggcgagccg

SEQ ID NO: 17777 - RNA, 17 nt, Artificial Sequence
  Synthetic
gcucgccuucuccgccg

SEQ ID NO: 17778 - RNA, 17 nt, Artificial Sequence
  Synthetic
gggacgucuccgggccg

SEQ ID NO: 17779 - RNA, 17 nt, Artificial Sequence
  Synthetic
gacgacgcagggccgcg

SEQ ID NO: 17780 - RNA, 17 nt, Artificial Sequence
  Synthetic
gcuaaugagaugccgcg

SEQ ID NO: 17781 - RNA, 17 nt, Artificial Sequence
  Synthetic
gaucuacccgaucggcg

SEQ ID NO: 17782 - RNA, 17 nt, Artificial Sequence
  Synthetic
gcgcgccgauuauggcg

SEQ ID NO: 17783 - RNA, 17 nt, Artificial Sequence
  Synthetic
ggccucguccaccaucg

SEQ ID NO: 17784 - RNA, 17 nt, Artificial Sequence
  Synthetic
gggucucauuagcaucg

SEQ ID NO: 17785 - RNA, 17 nt, Artificial Sequence
  Synthetic
ggcugauauaguccucg

SEQ ID NO: 17786 - RNA, 17 nt, Artificial Sequence
  Synthetic
gcgacgguccggguucg

SEQ ID NO: 17787 - RNA, 17 nt, Artificial Sequence
  Synthetic
ggguucggguggcacgg

SEQ ID NO: 17788 - RNA, 17 nt, Artificial Sequence
  Synthetic
gcggcggagacgaccgg

SEQ ID NO: 17789 - RNA, 17 nt, Artificial Sequence
  Synthetic
gcgccgucgcgcuccgg

SEQ ID NO: 17790 - RNA, 17 nt, Artificial Sequence
  Synthetic
gaacccgggccgcgcgg

SEQ ID NO: 17791 - RNA, 17 nt, Artificial Sequence
  Synthetic
gagacccucgucgcggg

SEQ ID NO: 17792 - RNA, 17 nt, Artificial Sequence
  Synthetic
gccgucgcgcuccgggg

SEQ ID NO: 17793 - RNA, 17 nt, Artificial Sequence
  Synthetic
gcgguuccaccuggggg

SEQ ID NO: 17794 - RNA, 17 nt, Artificial Sequence
  Synthetic
guucuccucgccauaau

SEQ ID NO: 17795 - RNA, 17 nt, Artificial Sequence
  Synthetic
ggccgccucgucggcau

SEQ ID NO: 17796 - RNA, 17 nt, Artificial Sequence
  Synthetic
gccaggaucuacccgau

SEQ ID NO: 17797 - RNA, 17 nt, Artificial Sequence
  Synthetic
guccgccaucgcgaccu

SEQ ID NO: 17798 - RNA, 17 nt, Artificial Sequence
  Synthetic
ggugggcggcgguccgu

SEQ ID NO: 17799 - RNA, 17 nt, Artificial Sequence
  Synthetic
gauccuggcggccgcgu

SEQ ID NO: 17800 - RNA, 17 nt, Artificial Sequence
  Synthetic
gguucggguggcacggu

SEQ ID NO: 17801 - RNA, 17 nt, Artificial Sequence
  Synthetic
gccgcgcggcccggguu

SEQ ID NO: 17802 - RNA, 17 nt, Artificial Sequence
  Synthetic
gggcgacgguccggguu

SEQ ID NO: 17803 - RNA, 20 nt, Artificial Sequence
  Synthetic
gccggcggcggcgcgaccaa

SEQ ID NO: 17804 - RNA, 20 nt, Artificial Sequence
  Synthetic
gggcgacgggaucgugcgaa

SEQ ID NO: 17805 - RNA, 20 nt, Artificial Sequence
  Synthetic
ggaucuccggauccagccga

SEQ ID NO: 17806 - RNA, 20 nt, Artificial Sequence
  Synthetic
guccgcggcaggcucgucga

SEQ ID NO: 17807 - RNA, 20 nt, Artificial Sequence
  Synthetic
gucgcgauggcggacgagga

SEQ ID NO: 17808 - RNA, 20 nt, Artificial Sequence
  Synthetic
gucgacgagccugccgcgga

SEQ ID NO: 17809 - RNA, 20 nt, Artificial Sequence
  Synthetic
gcggagaggcgaaaagacac

SEQ ID NO: 17810 - RNA, 20 nt, Artificial Sequence
  Synthetic
ggcacacgcacgcaccgcac

SEQ ID NO: 17811 - RNA, 20 nt, Artificial Sequence
  Synthetic
gcgcauaaugcgguuccacc

SEQ ID NO: 17812 - RNA, 20 nt, Artificial Sequence
  Synthetic
gcggagacgaccggcggccc

SEQ ID NO: 17813 - RNA, 20 nt, Artificial Sequence
  Synthetic
gggcggaaccccggcgagcc

SEQ ID NO: 17814 - RNA, 20 nt, Artificial Sequence
  Synthetic
gaagcggaagccgcccgcgc

SEQ ID NO: 17815 - RNA, 20 nt, Artificial Sequence
  Synthetic
gcgcuaaugagaugccgcgc

SEQ ID NO: 17816 - RNA, 20 nt, Artificial Sequence
  Synthetic
gagggucucauuagcaucgc

SEQ ID NO: 17817 - RNA, 20 nt, Artificial Sequence
  Synthetic
gcuaaugagacccucgucgc

SEQ ID NO: 17818 - RNA, 20 nt, Artificial Sequence
  Synthetic
gagacgacgccguccgcggc

SEQ ID NO: 17819 - RNA, 20 nt, Artificial Sequence
  Synthetic
ggacgcgcgggcgucggggc

SEQ ID NO: 17820 - RNA, 20 nt, Artificial Sequence
  Synthetic
guucggguggcacggugggc

SEQ ID NO: 17821 - RNA, 20 nt, Artificial Sequence
  Synthetic
gucggcuggauccggagauc

SEQ ID NO: 17822 - RNA, 20 nt, Artificial Sequence
  Synthetic
ggcgguccgucggcuggauc

SEQ ID NO: 17823 - RNA, 20 nt, Artificial Sequence
  Synthetic
gccucgucuucguucuccuc

SEQ ID NO: 17824 - RNA, 20 nt, Artificial Sequence
  Synthetic
gccuggcugauauaguccuc

SEQ ID NO: 17825 - RNA, 20 nt, Artificial Sequence
  Synthetic
gaccggcggccccggaucuc

SEQ ID NO: 17826 - RNA, 20 nt, Artificial Sequence
  Synthetic
gacgaggcggccccggcguc

SEQ ID NO: 17827 - RNA, 20 nt, Artificial Sequence
  Synthetic
gacgcggacgcgcgggcguc

SEQ ID NO: 17828 - RNA, 20 nt, Artificial Sequence
  Synthetic
gcacacgcacgcaccgcacg

SEQ ID NO: 17829 - RNA, 20 nt, Artificial Sequence
  Synthetic
gagcgagcccgcccgcgacg

SEQ ID NO: 17830 - RNA, 20 nt, Artificial Sequence
  Synthetic
gacggccuccccggacgccg

SEQ ID NO: 17831 - RNA, 20 nt, Artificial Sequence
  Synthetic
ggccgucgacgagccugccg

SEQ ID NO: 17832 - RNA, 20 nt, Artificial Sequence
  Synthetic
gcgaucguccacacggagcg

SEQ ID NO: 17833 - RNA, 20 nt, Artificial Sequence
  Synthetic
gacgacgacgcagggccgcg

SEQ ID NO: 17834 - RNA, 20 nt, Artificial Sequence
  Synthetic
gauauaguccucggggcgcg

SEQ ID NO: 17835 - RNA, 20 nt, Artificial Sequence
  Synthetic
gacgcgcgggcgucggggcg

SEQ ID NO: 17836 - RNA, 20 nt, Artificial Sequence
  Synthetic
gccuccgaccggggugugcg

SEQ ID NO: 17837 - RNA, 20 nt, Artificial Sequence
  Synthetic
gccgggguuccgcccccagg

SEQ ID NO: 17838 - RNA, 20 nt, Artificial Sequence
  Synthetic
gggacgucuccgggccgcgg

SEQ ID NO: 17839 - RNA, 20 nt, Artificial Sequence
  Synthetic
ggucucauuagcaucgcggg

SEQ ID NO: 17840 - RNA, 20 nt, Artificial Sequence
  Synthetic
gccauaaucggcgcgcaugg

SEQ ID NO: 17841 - RNA, 20 nt, Artificial Sequence
  Synthetic
gccgaucggguagauccugg

SEQ ID NO: 17842 - RNA, 20 nt, Artificial Sequence
  Synthetic
gggcggggccgcgcauaaug

SEQ ID NO: 17843 - RNA, 20 nt, Artificial Sequence
  Synthetic
gcauaaugcgguuccaccug

SEQ ID NO: 17844 - RNA, 20 nt, Artificial Sequence
  Synthetic
gucgguagccgcgcuccgug

SEQ ID NO: 17845 - RNA, 20 nt, Artificial Sequence
  Synthetic
gucguucuccucgccauaau

SEQ ID NO: 17846 - RNA, 20 nt, Artificial Sequence
  Synthetic
gccgccaggaucuacccgau

SEQ ID NO: 17847 - RNA, 20 nt, Artificial Sequence
  Synthetic
guagauccuggcggccgcgu

SEQ ID NO: 17848 - RNA, 20 nt, Artificial Sequence
  Synthetic
ggacgcggacgcgcgggcgu

SEQ ID NO: 17849 - RNA, 20 nt, Artificial Sequence
  Synthetic
ggacgccggggccgccucgu

SEQ ID NO: 17850 - RNA, 20 nt, Artificial Sequence
  Synthetic
gcggggcgacgguccggguu

SEQ ID NO: 17851 - RNA, 17 nt, Artificial Sequence
  Synthetic
cgacgggaucgugcgaa

SEQ ID NO: 17852 - RNA, 17 nt, Artificial Sequence
  Synthetic
cggggcgaucguccaca

SEQ ID NO: 17853 - RNA, 17 nt, Artificial Sequence
  Synthetic
ccaacgggccgccgcca

SEQ ID NO: 17854 - RNA, 17 nt, Artificial Sequence
  Synthetic
acgacgacgacgacgca

SEQ ID NO: 17855 - RNA, 17 nt, Artificial Sequence
  Synthetic
cccggguucggguggca

SEQ ID NO: 17856 - RNA, 17 nt, Artificial Sequence
  Synthetic
ucuccggauccagccga

SEQ ID NO: 17857 - RNA, 17 nt, Artificial Sequence
  Synthetic
ccccccccggagcgcga

SEQ ID NO: 17858 - RNA, 17 nt, Artificial Sequence
  Synthetic
cggggccgaggucgcga

SEQ ID NO: 17859 - RNA, 17 nt, Artificial Sequence
  Synthetic
cgcuccggggggggcga

SEQ ID NO: 17860 - RNA, 17 nt, Artificial Sequence
  Synthetic
cgcggcaggcucgucga

SEQ ID NO: 17861 - RNA, 17 nt, Artificial Sequence
  Synthetic
uaaucggcgcgcaugga

SEQ ID NO: 17862 - RNA, 17 nt, Artificial Sequence
  Synthetic
uccaugcgcgccgauua

SEQ ID NO: 17863 - RNA, 17 nt, Artificial Sequence
  Synthetic
acacgcacgcaccgcac

SEQ ID NO: 17864 - RNA, 17 nt, Artificial Sequence
  Synthetic
accgugccacccgaacc

SEQ ID NO: 17865 - RNA, 17 nt, Artificial Sequence
  Synthetic
ugccgacgaggcggccc

SEQ ID NO: 17866 - RNA, 17 nt, Artificial Sequence
  Synthetic
cucgucgacggccuccc

SEQ ID NO: 17867 - RNA, 17 nt, Artificial Sequence
  Synthetic
cgaggacuauaucagcc

SEQ ID NO: 17868 - RNA, 17 nt, Artificial Sequence
  Synthetic
cggaaccccggcgagcc

SEQ ID NO: 17869 - RNA, 17 nt, Artificial Sequence
  Synthetic
cuaccgacgcggccgcc

SEQ ID NO: 17870 - RNA, 17 nt, Artificial Sequence
  Synthetic
acgaucgccccgucgcc

SEQ ID NO: 17871 - RNA, 17 nt, Artificial Sequence
  Synthetic
cggcggagaaggcgagc

SEQ ID NO: 17872 - RNA, 17 nt, Artificial Sequence
  Synthetic
cgacgacgcagggccgc

SEQ ID NO: 17873 - RNA, 17 nt, Artificial Sequence
  Synthetic
cggagauccggggccgc

SEQ ID NO: 17874 - RNA, 17 nt, Artificial Sequence
  Synthetic
ucauuagcgcccggcgc

SEQ ID NO: 17875 - RNA, 17 nt, Artificial Sequence
  Synthetic
aaugagacccucgucgc

SEQ ID NO: 17876 - RNA, 17 nt, Artificial Sequence
  Synthetic
acgacgccguccgcggc

SEQ ID NO: 17877 - RNA, 17 nt, Artificial Sequence
  Synthetic
agacccucgucgcgggc

SEQ ID NO: 17878 - RNA, 17 nt, Artificial Sequence
  Synthetic
cuccgaccggggugugc

SEQ ID NO: 17879 - RNA, 17 nt, Artificial Sequence
  Synthetic
ucgucuucguucuccuc

SEQ ID NO: 17880 - RNA, 17 nt, Artificial Sequence
  Synthetic
aggacgggggacgucuc

SEQ ID NO: 17881 - RNA, 17 nt, Artificial Sequence
  Synthetic
agcaucgcgggcggaag

SEQ ID NO: 17882 - RNA, 17 nt, Artificial Sequence
  Synthetic
acccgaucggcgcggag

SEQ ID NO: 17883 - RNA, 17 nt, Artificial Sequence
  Synthetic
aaucggcgcgcauggag

SEQ ID NO: 17884 - RNA, 17 nt, Artificial Sequence
  Synthetic
cgaugccgaugccgacg

SEQ ID NO: 17885 - RNA, 17 nt, Artificial Sequence
  Synthetic
cgagcccgcccgcgacg

SEQ ID NO: 17886 - RNA, 17 nt, Artificial Sequence
  Synthetic
ucgcgaccucggccccg

SEQ ID NO: 17887 - RNA, 17 nt, Artificial Sequence
  Synthetic
acggcgucgucucgccg

SEQ ID NO: 17888 - RNA, 17 nt, Artificial Sequence
  Synthetic
acgacgacgcagggccg

SEQ ID NO: 17889 - RNA, 17 nt, Artificial Sequence
  Synthetic
cgucgacgagccugccg

SEQ ID NO: 17890 - RNA, 17 nt, Artificial Sequence
  Synthetic
cgagacgacgccguccg

SEQ ID NO: 17891 - RNA, 17 nt, Artificial Sequence
  Synthetic
ccgcgcguccgcguccg

SEQ ID NO: 17892 - RNA, 17 nt, Artificial Sequence
  Synthetic
cgcauggaggggguccg

SEQ ID NO: 17893 - RNA, 17 nt, Artificial Sequence
  Synthetic
aucguccacacggagcg

SEQ ID NO: 17894 - RNA, 17 nt, Artificial Sequence
  Synthetic
ccacggacgcggacgcg

SEQ ID NO: 17895 - RNA, 17 nt, Artificial Sequence
  Synthetic
accgucgccccgccgcg

SEQ ID NO: 17896 - RNA, 17 nt, Artificial Sequence
  Synthetic
aguccucggggcgcgcg

SEQ ID NO: 17897 - RNA, 17 nt, Artificial Sequence
  Synthetic
auaguccucggggcgcg

SEQ ID NO: 17898 - RNA, 17 nt, Artificial Sequence
  Synthetic
cccggagcgcgacggcg

SEQ ID NO: 17899 - RNA, 17 nt, Artificial Sequence
  Synthetic
cucauuagcgcccggcg

SEQ ID NO: 17900 - RNA, 17 nt, Artificial Sequence
  Synthetic
uggaaccgcauuaugcg

SEQ ID NO: 17901 - RNA, 17 nt, Artificial Sequence
  Synthetic
uccgaccggggugugcg

SEQ ID NO: 17902 - RNA, 17 nt, Artificial Sequence
  Synthetic
uaaugagacccucgucg

SEQ ID NO: 17903 - RNA, 17 nt, Artificial Sequence
  Synthetic
ugccgaugccgacgagg

SEQ ID NO: 17904 - RNA, 17 nt, Artificial Sequence
  Synthetic
aucggcgcgcauggagg

SEQ ID NO: 17905 - RNA, 17 nt, Artificial Sequence
  Synthetic
acgcacgcaccgcacgg

SEQ ID NO: 17906 - RNA, 17 nt, Artificial Sequence
  Synthetic
acgucuccgggccgcgg

SEQ ID NO: 17907 - RNA, 17 nt, Artificial Sequence
  Synthetic
cgcacgcaccgcacggg

SEQ ID NO: 17908 - RNA, 17 nt, Artificial Sequence
  Synthetic
cgccgucgcgcuccggg

SEQ ID NO: 17909 - RNA, 17 nt, Artificial Sequence
  Synthetic
augagaugccgcgcggg

SEQ ID NO: 17910 - RNA, 17 nt, Artificial Sequence
  Synthetic
uuagcgcccggcgcggg

SEQ ID NO: 17911 - RNA, 17 nt, Artificial Sequence
  Synthetic
cucauuagcaucgcggg

SEQ ID NO: 17912 - RNA, 17 nt, Artificial Sequence
  Synthetic
acgguccggguucgggg

SEQ ID NO: 17913 - RNA, 17 nt, Artificial Sequence
  Synthetic
auaaucggcgcgcaugg

SEQ ID NO: 17914 - RNA, 17 nt, Artificial Sequence
  Synthetic
cgcguccgcguccgugg

SEQ ID NO: 17915 - RNA, 17 nt, Artificial Sequence
  Synthetic
cggggccgcgcauaaug

SEQ ID NO: 17916 - RNA, 17 nt, Artificial Sequence
  Synthetic
uaaugcgguuccaccug

SEQ ID NO: 17917 - RNA, 17 nt, Artificial Sequence
  Synthetic
ccuccgaccggggugug

SEQ ID NO: 17918 - RNA, 17 nt, Artificial Sequence
  Synthetic
cucgucggcaucggcau

SEQ ID NO: 17919 - RNA, 17 nt, Artificial Sequence
  Synthetic
cgccucuccgcgccgau

SEQ ID NO: 17920 - RNA, 17 nt, Artificial Sequence
  Synthetic
auaaugcgguuccaccu

SEQ ID NO: 17921 - RNA, 17 nt, Artificial Sequence
  Synthetic
ccguggcggcggcccgu

SEQ ID NO: 17922 - RNA, 17 nt, Artificial Sequence
  Synthetic
cgcggacgcgcgggcgu

SEQ ID NO: 17923 - RNA, 17 nt, Artificial Sequence
  Synthetic
aucggcggcggcgucgu

SEQ ID NO: 17924 - RNA, 17 nt, Artificial Sequence
  Synthetic
cccccgcacaccccggu

SEQ ID NO: 17925 - RNA, 17 nt, Artificial Sequence
  Synthetic
cgguccggguucggggu

SEQ ID NO: 17926 - RNA, 20 nt, Artificial Sequence
  Synthetic
cgacggggcgaucguccaca

SEQ ID NO: 17927 - RNA, 20 nt, Artificial Sequence
  Synthetic
cgaccaacgggccgccgcca

SEQ ID NO: 17928 - RNA, 20 nt, Artificial Sequence
  Synthetic
aggcacacgcacgcaccgca

SEQ ID NO: 17929 - RNA, 20 nt, Artificial Sequence
  Synthetic
cucgccauaaucggcgcgca

SEQ ID NO: 17930 - RNA, 20 nt, Artificial Sequence
  Synthetic
agcgagcccgcccgcgacga

SEQ ID NO: 17931 - RNA, 20 nt, Artificial Sequence
  Synthetic
ucgccccccccggagcgcga

SEQ ID NO: 17932 - RNA, 20 nt, Artificial Sequence
  Synthetic
ccgcggggccgaggucgcga

SEQ ID NO: 17933 - RNA, 20 nt, Artificial Sequence
  Synthetic
ccauaaucggcgcgcaugga

SEQ ID NO: 17934 - RNA, 20 nt, Artificial Sequence
  Synthetic
cccuccaugcgcgccgauua

SEQ ID NO: 17935 - RNA, 20 nt, Artificial Sequence
  Synthetic
ccggcggcggcgcgaccaac

SEQ ID NO: 17936 - RNA, 20 nt, Artificial Sequence
  Synthetic
cgcgcuccggggggggcgac

SEQ ID NO: 17937 - RNA, 20 nt, Artificial Sequence
  Synthetic
ucgcgauggcggacgaggac

SEQ ID NO: 17938 - RNA, 20 nt, Artificial Sequence
  Synthetic
cccaccgugccacccgaacc

SEQ ID NO: 17939 - RNA, 20 nt, Artificial Sequence
  Synthetic
ccaccgugccacccgaaccc

SEQ ID NO: 17940 - RNA, 20 nt, Artificial Sequence
  Synthetic
cacgaucccgucgccccccc

SEQ ID NO: 17941 - RNA, 20 nt, Artificial Sequence
  Synthetic
cgaugccgacgaggcggccc

SEQ ID NO: 17942 - RNA, 20 nt, Artificial Sequence
  Synthetic
aggcucgucgacggccuccc

SEQ ID NO: 17943 - RNA, 20 nt, Artificial Sequence
  Synthetic
cgacggccuccccggacgcc

SEQ ID NO: 17944 - RNA, 20 nt, Artificial Sequence
  Synthetic
aagcggaagccgcccgcgcc

SEQ ID NO: 17945 - RNA, 20 nt, Artificial Sequence
  Synthetic
cgcgccgaucggguagaucc

SEQ ID NO: 17946 - RNA, 20 nt, Artificial Sequence
  Synthetic
cuuccgcgccgucgcgcucc

SEQ ID NO: 17947 - RNA, 20 nt, Artificial Sequence
  Synthetic
cgaggacgggggacgucucc

SEQ ID NO: 17948 - RNA, 20 nt, Artificial Sequence
  Synthetic
cguccaccaucgaggccagc

SEQ ID NO: 17949 - RNA, 20 nt, Artificial Sequence
  Synthetic
cgucgucucgccgcggcagc

SEQ ID NO: 17950 - RNA, 20 nt, Artificial Sequence
  Synthetic
ucgacggccuccccggacgc

SEQ ID NO: 17951 - RNA, 20 nt, Artificial Sequence
  Synthetic
cccguuggucgcgccgccgc

SEQ ID NO: 17952 - RNA, 20 nt, Artificial Sequence
  Synthetic
cgacgacgacgcagggccgc

SEQ ID NO: 17953 - RNA, 20 nt, Artificial Sequence
  Synthetic
auccggagauccggggccgc

SEQ ID NO: 17954 - RNA, 20 nt, Artificial Sequence
  Synthetic
cgccacggacgcggacgcgc

SEQ ID NO: 17955 - RNA, 20 nt, Artificial Sequence
  Synthetic
auauaguccucggggcgcgc

SEQ ID NO: 17956 - RNA, 20 nt, Artificial Sequence
  Synthetic
aucucauuagcgcccggcgc

SEQ ID NO: 17957 - RNA, 20 nt, Artificial Sequence
  Synthetic
augagacccucgucgcgggc

SEQ ID NO: 17958 - RNA, 20 nt, Artificial Sequence
  Synthetic
cgccuccgaccggggugugc

SEQ ID NO: 17959 - RNA, 20 nt, Artificial Sequence
  Synthetic
uucgccucuccgcgccgauc

SEQ ID NO: 17960 - RNA, 20 nt, Artificial Sequence
  Synthetic
ucuuccgcgccgucgcgcuc

SEQ ID NO: 17961 - RNA, 20 nt, Artificial Sequence
  Synthetic
acgaggacgggggacgucuc

SEQ ID NO: 17962 - RNA, 20 nt, Artificial Sequence
  Synthetic
cgcgcggcggggcgacgguc

SEQ ID NO: 17963 - RNA, 20 nt, Artificial Sequence
  Synthetic
cgacggcgcggaagaagaag

SEQ ID NO: 17964 - RNA, 20 nt, Artificial Sequence
  Synthetic
auuagcaucgcgggcggaag

SEQ ID NO: 17965 - RNA, 20 nt, Artificial Sequence
  Synthetic
ucuacccgaucggcgcggag

SEQ ID NO: 17966 - RNA, 20 nt, Artificial Sequence
  Synthetic
cauaaucggcgcgcauggag

SEQ ID NO: 17967 - RNA, 20 nt, Artificial Sequence
  Synthetic
acggagcgcggcuaccgacg

SEQ ID NO: 17968 - RNA, 20 nt, Artificial Sequence
  Synthetic
cgccgaugccgaugccgacg

SEQ ID NO: 17969 - RNA, 20 nt, Artificial Sequence
  Synthetic
acgggccgccgccacggacg

SEQ ID NO: 17970 - RNA, 20 nt, Artificial Sequence
  Synthetic
cgaggucgcgauggcggacg

SEQ ID NO: 17971 - RNA, 20 nt, Artificial Sequence
  Synthetic
ccaucgcgaccucggccccg

SEQ ID NO: 17972 - RNA, 20 nt, Artificial Sequence
  Synthetic
cccgcucgccuucuccgccg

SEQ ID NO: 17973 - RNA, 20 nt, Artificial Sequence
  Synthetic
cggacggcgucgucucgccg

SEQ ID NO: 17974 - RNA, 20 nt, Artificial Sequence
  Synthetic
acgacgacgacgcagggccg

SEQ ID NO: 17975 - RNA, 20 nt, Artificial Sequence
  Synthetic
cgggggacgucuccgggccg

SEQ ID NO: 17976 - RNA, 20 nt, Artificial Sequence
  Synthetic
cggcuggauccggagauccg

SEQ ID NO: 17977 - RNA, 20 nt, Artificial Sequence
  Synthetic
uuccgcgccgucgcgcuccg

SEQ ID NO: 17978 - RNA, 20 nt, Artificial Sequence
  Synthetic
cggcgagacgacgccguccg

SEQ ID NO: 17979 - RNA, 20 nt, Artificial Sequence
  Synthetic
cgcccgcgcguccgcguccg

SEQ ID NO: 17980 - RNA, 20 nt, Artificial Sequence
  Synthetic
cggaccgucgccccgccgcg

SEQ ID NO: 17981 - RNA, 20 nt, Artificial Sequence
  Synthetic
uauaguccucggggcgcgcg

SEQ ID NO: 17982 - RNA, 20 nt, Artificial Sequence
  Synthetic
ccccccggagcgcgacggcg

SEQ ID NO: 17983 - RNA, 20 nt, Artificial Sequence
  Synthetic
caggaucuacccgaucggcg

SEQ ID NO: 17984 - RNA, 20 nt, Artificial Sequence
  Synthetic
aaccccggcgagccggggcg

SEQ ID NO: 17985 - RNA, 20 nt, Artificial Sequence
  Synthetic
caugcgcgccgauuauggcg

SEQ ID NO: 17986 - RNA, 20 nt, Artificial Sequence
  Synthetic
agguggaaccgcauuaugcg

SEQ ID NO: 17987 - RNA, 20 nt, Artificial Sequence
  Synthetic
aacggccucguccaccaucg

SEQ ID NO: 17988 - RNA, 20 nt, Artificial Sequence
  Synthetic
cgagggucucauuagcaucg

SEQ ID NO: 17989 - RNA, 20 nt, Artificial Sequence
  Synthetic
ccuggcugauauaguccucg

SEQ ID NO: 17990 - RNA, 20 nt, Artificial Sequence
  Synthetic
acgcggacgcgcgggcgucg

SEQ ID NO: 17991 - RNA, 20 nt, Artificial Sequence
  Synthetic
ugcuaaugagacccucgucg

SEQ ID NO: 17992 - RNA, 20 nt, Artificial Sequence
  Synthetic
cgaugccgaugccgacgagg

SEQ ID NO: 17993 - RNA, 20 nt, Artificial Sequence
  Synthetic
auaaucggcgcgcauggagg

SEQ ID NO: 17994 - RNA, 20 nt, Artificial Sequence
  Synthetic
cccggguucggguggcacgg

SEQ ID NO: 17995 - RNA, 20 nt, Artificial Sequence
  Synthetic
uccgcgccgucgcgcuccgg

SEQ ID NO: 17996 - RNA, 20 nt, Artificial Sequence
  Synthetic
cgcauggaggggguccgcgg

SEQ ID NO: 17997 - RNA, 20 nt, Artificial Sequence
  Synthetic
ccuccgaccggggugugcgg

SEQ ID NO: 17998 - RNA, 20 nt, Artificial Sequence
  Synthetic
cucgucggcaucggcaucgg

SEQ ID NO: 17999 - RNA, 20 nt, Artificial Sequence
  Synthetic
acacgcacgcaccgcacggg

SEQ ID NO: 18000 - RNA, 20 nt, Artificial Sequence
  Synthetic
cuaaugagaugccgcgcggg

SEQ ID NO: 18001 - RNA, 20 nt, Artificial Sequence
  Synthetic
aaugagacccucgucgcggg

SEQ ID NO: 18002 - RNA, 20 nt, Artificial Sequence
  Synthetic
cuccgaccggggugugcggg

SEQ ID NO: 18003 - RNA, 20 nt, Artificial Sequence
  Synthetic
cacgcacgcaccgcacgggg

SEQ ID NO: 18004 - RNA, 20 nt, Artificial Sequence
  Synthetic
aaugcgguuccaccuggggg

SEQ ID NO: 18005 - RNA, 20 nt, Artificial Sequence
  Synthetic
cggggccgaggucgcgaugg

SEQ ID NO: 18006 - RNA, 20 nt, Artificial Sequence
  Synthetic
ccgcgcguccgcguccgugg

SEQ ID NO: 18007 - RNA, 20 nt, Artificial Sequence
  Synthetic
cgccucgucggcaucggcau

SEQ ID NO: 18008 - RNA, 20 nt, Artificial Sequence
  Synthetic
cggggccgccucgucggcau

SEQ ID NO: 18009 - RNA, 20 nt, Artificial Sequence
  Synthetic
uuucgccucuccgcgccgau

SEQ ID NO: 18010 - RNA, 20 nt, Artificial Sequence
  Synthetic
cgcauaaugcgguuccaccu

SEQ ID NO: 18011 - RNA, 20 nt, Artificial Sequence
  Synthetic
cucguccgccaucgcgaccu

SEQ ID NO: 18012 - RNA, 20 nt, Artificial Sequence
  Synthetic
cgccuggcugauauaguccu

SEQ ID NO: 18013 - RNA, 20 nt, Artificial Sequence
  Synthetic
ucuucuucaggggcggcagu

SEQ ID NO: 18014 - RNA, 20 nt, Artificial Sequence
  Synthetic
cguccguggcggcggcccgu

SEQ ID NO: 18015 - RNA, 20 nt, Artificial Sequence
  Synthetic
cggggugggcggcgguccgu

SEQ ID NO: 18016 - RNA, 20 nt, Artificial Sequence
  Synthetic
ccggguucggguggcacggu

SEQ ID NO: 18017 - RNA, 17 nt, Artificial Sequence
  Synthetic
ggcggcggcgcgaccaa

SEQ ID NO: 18018 - RNA, 17 nt, Artificial Sequence
  Synthetic
gcgcggggcggggggaa

SEQ ID NO: 18019 - RNA, 17 nt, Artificial Sequence
  Synthetic
gggguccgcggcggaga

SEQ ID NO: 18020 - RNA, 17 nt, Artificial Sequence
  Synthetic
gccgcgcggcggggcga

SEQ ID NO: 18021 - RNA, 17 nt, Artificial Sequence
  Synthetic
ggcccugcuggccucga

SEQ ID NO: 18022 - RNA, 17 nt, Artificial Sequence
  Synthetic
gagaggcgaaaagacac

SEQ ID NO: 18023 - RNA, 17 nt, Artificial Sequence
  Synthetic
gccgcggcggagacgac

SEQ ID NO: 18024 - RNA, 17 nt, Artificial Sequence
  Synthetic
gcuccggggggggcgac

SEQ ID NO: 18025 - RNA, 17 nt, Artificial Sequence
  Synthetic
gccgcccaccccgaacc

SEQ ID NO: 18026 - RNA, 17 nt, Artificial Sequence
  Synthetic
gccgggguuccgccccc

SEQ ID NO: 18027 - RNA, 17 nt, Artificial Sequence
  Synthetic
gccccgccgcgcggccc

SEQ ID NO: 18028 - RNA, 17 nt, Artificial Sequence
  Synthetic
ggcaucucauuagcgcc

SEQ ID NO: 18029 - RNA, 17 nt, Artificial Sequence
  Synthetic
gacgacgacgacgacgc

SEQ ID NO: 18030 - RNA, 17 nt, Artificial Sequence
  Synthetic
gccgcgccccggcucgc

SEQ ID NO: 18031 - RNA, 17 nt, Artificial Sequence
  Synthetic
gcggcagcuggcccugc

SEQ ID NO: 18032 - RNA, 17 nt, Artificial Sequence
  Synthetic
ggcuggauccggagauc

SEQ ID NO: 18033 - RNA, 17 nt, Artificial Sequence
  Synthetic
gaggcggccccggcguc

SEQ ID NO: 18034 - RNA, 17 nt, Artificial Sequence
  Synthetic
gcggcggggcgacgguc

SEQ ID NO: 18035 - RNA, 17 nt, Artificial Sequence
  Synthetic
gcggcggagaaggcgag

SEQ ID NO: 18036 - RNA, 17 nt, Artificial Sequence
  Synthetic
ggaggagaacgaagacg

SEQ ID NO: 18037 - RNA, 17 nt, Artificial Sequence
  Synthetic
gggaaaggaggaggacg

SEQ ID NO: 18038 - RNA, 17 nt, Artificial Sequence
  Synthetic
ggccucgaugguggacg

SEQ ID NO: 18039 - RNA, 17 nt, Artificial Sequence
  Synthetic
ggccuccccggacgccg

SEQ ID NO: 18040 - RNA, 17 nt, Artificial Sequence
  Synthetic
gccggucgucuccgccg

SEQ ID NO: 18041 - RNA, 17 nt, Artificial Sequence
  Synthetic
gcagggccgcggggccg

SEQ ID NO: 18042 - RNA, 17 nt, Artificial Sequence
  Synthetic
ggcggccccggcguccg

SEQ ID NO: 18043 - RNA, 17 nt, Artificial Sequence
  Synthetic
gcgcgggcgucggggcg

SEQ ID NO: 18044 - RNA, 17 nt, Artificial Sequence
  Synthetic
gggguuccgcccccagg

SEQ ID NO: 18045 - RNA, 17 nt, Artificial Sequence
  Synthetic
ggcggggggaaaggagg

SEQ ID NO: 18046 - RNA, 17 nt, Artificial Sequence
  Synthetic
ggaggaggacgcggagg

SEQ ID NO: 18047 - RNA, 17 nt, Artificial Sequence
  Synthetic
guggcacggugggccgg

SEQ ID NO: 18048 - RNA, 17 nt, Artificial Sequence
  Synthetic
ggcgagccggggcgcgg

SEQ ID NO: 18049 - RNA, 17 nt, Artificial Sequence
  Synthetic
gcgggcggagccggcgg

SEQ ID NO: 18050 - RNA, 17 nt, Artificial Sequence
  Synthetic
ggcaucggcaucggcgg

SEQ ID NO: 18051 - RNA, 17 nt, Artificial Sequence
  Synthetic
ggguucggggugggcgg

SEQ ID NO: 18052 - RNA, 17 nt, Artificial Sequence
  Synthetic
guccgcguccguggcgg

SEQ ID NO: 18053 - RNA, 17 nt, Artificial Sequence
  Synthetic
gucggcaucggcaucgg

SEQ ID NO: 18054 - RNA, 17 nt, Artificial Sequence
  Synthetic
ggggcgcgcggggcggg

SEQ ID NO: 18055 - RNA, 17 nt, Artificial Sequence
  Synthetic
gcacgcaccgcacgggg

SEQ ID NO: 18056 - RNA, 17 nt, Artificial Sequence
  Synthetic
ggccccggcguccgggg

SEQ ID NO: 18057 - RNA, 17 nt, Artificial Sequence
  Synthetic
gaccggggugugcgggg

SEQ ID NO: 18058 - RNA, 17 nt, Artificial Sequence
  Synthetic
gcggcaguggggggggg

SEQ ID NO: 18059 - RNA, 17 nt, Artificial Sequence
  Synthetic
ggggcggcagugggggg

SEQ ID NO: 18060 - RNA, 17 nt, Artificial Sequence
  Synthetic
ggccgaggucgcgaugg

SEQ ID NO: 18061 - RNA, 17 nt, Artificial Sequence
  Synthetic
gaucggguagauccugg

SEQ ID NO: 18062 - RNA, 17 nt, Artificial Sequence
  Synthetic
gguagccgcgcuccgug

SEQ ID NO: 18063 - RNA, 20 nt, Artificial Sequence
  Synthetic
ggcgcgcggggcggggggaa

SEQ ID NO: 18064 - RNA, 20 nt, Artificial Sequence
  Synthetic
guccaccaucgaggccagca

SEQ ID NO: 18065 - RNA, 20 nt, Artificial Sequence
  Synthetic
ggucuucuucuucuucuuca

SEQ ID NO: 18066 - RNA, 20 nt, Artificial Sequence
  Synthetic
gaggggguccgcggcggaga

SEQ ID NO: 18067 - RNA, 20 nt, Artificial Sequence
  Synthetic
ggacuauaucagccaggcga

SEQ ID NO: 18068 - RNA, 20 nt, Artificial Sequence
  Synthetic
gcuggcccugcuggccucga

SEQ ID NO: 18069 - RNA, 20 nt, Artificial Sequence
  Synthetic
gacuauaucagccaggcgac

SEQ ID NO: 18070 - RNA, 20 nt, Artificial Sequence
  Synthetic
gucgccccgccgcgcggccc

SEQ ID NO: 18071 - RNA, 20 nt, Artificial Sequence
  Synthetic
gcgcggcggggcgacggucc

SEQ ID NO: 18072 - RNA, 20 nt, Artificial Sequence
  Synthetic
gcucgcuccccugcccuucc

SEQ ID NO: 18073 - RNA, 20 nt, Artificial Sequence
  Synthetic
ggggcggaaccccggcgagc

SEQ ID NO: 18074 - RNA, 20 nt, Artificial Sequence
  Synthetic
gaagacgacgacgacgacgc

SEQ ID NO: 18075 - RNA, 20 nt, Artificial Sequence
  Synthetic
gccgccgcgccccggcucgc

SEQ ID NO: 18076 - RNA, 20 nt, Artificial Sequence
  Synthetic
gugggcggcgguccgucggc

SEQ ID NO: 18077 - RNA, 20 nt, Artificial Sequence
  Synthetic
guccucggggcgcgcggggc

SEQ ID NO: 18078 - RNA, 20 nt, Artificial Sequence
  Synthetic
gccgcggcagcuggcccugc

SEQ ID NO: 18079 - RNA, 20 nt, Artificial Sequence
  Synthetic
ggcucgcuccccugcccuuc

SEQ ID NO: 18080 - RNA, 20 nt, Artificial Sequence
  Synthetic
gggucuucuucuucuucuuc

SEQ ID NO: 18081 - RNA, 20 nt, Artificial Sequence
  Synthetic
gucuucuucuucuucuucag

SEQ ID NO: 18082 - RNA, 20 nt, Artificial Sequence
  Synthetic
gccggaggagaacgaagacg

SEQ ID NO: 18083 - RNA, 20 nt, Artificial Sequence
  Synthetic
ggggggaaaggaggaggacg

SEQ ID NO: 18084 - RNA, 20 nt, Artificial Sequence
  Synthetic
gcuggccucgaugguggacg

SEQ ID NO: 18085 - RNA, 20 nt, Artificial Sequence
  Synthetic
ggcggaaccccggcgagccg

SEQ ID NO: 18086 - RNA, 20 nt, Artificial Sequence
  Synthetic
gccgccggucgucuccgccg

SEQ ID NO: 18087 - RNA, 20 nt, Artificial Sequence
  Synthetic
gacgcagggccgcggggccg

SEQ ID NO: 18088 - RNA, 20 nt, Artificial Sequence
  Synthetic
gccagcagggccagcugccg

SEQ ID NO: 18089 - RNA, 20 nt, Artificial Sequence
  Synthetic
gcgcgcauggaggggguccg

SEQ ID NO: 18090 - RNA, 20 nt, Artificial Sequence
  Synthetic
ggcgcuaaugagaugccgcg

SEQ ID NO: 18091 - RNA, 20 nt, Artificial Sequence
  Synthetic
ggggcgacgguccggguucg

SEQ ID NO: 18092 - RNA, 20 nt, Artificial Sequence
  Synthetic
gcgcggggcggggggaaagg

SEQ ID NO: 18093 - RNA, 20 nt, Artificial Sequence
  Synthetic
gcgauggcggacgaggacgg

SEQ ID NO: 18094 - RNA, 20 nt, Artificial Sequence
  Synthetic
gccgcggcggagacgaccgg

SEQ ID NO: 18095 - RNA, 20 nt, Artificial Sequence
  Synthetic
gggaaaggaggaggacgcgg

SEQ ID NO: 18096 - RNA, 20 nt, Artificial Sequence
  Synthetic
gucggcaucggcaucggcgg

SEQ ID NO: 18097 - RNA, 20 nt, Artificial Sequence
  Synthetic
ggcggccccggcguccgggg

SEQ ID NO: 18098 - RNA, 20 nt, Artificial Sequence
  Synthetic
gcgacgguccggguucgggg

SEQ ID NO: 18099 - RNA, 20 nt, Artificial Sequence
  Synthetic
gcgccgucgcgcuccggggg

SEQ ID NO: 18100 - RNA, 20 nt, Artificial Sequence
  Synthetic
ggggcggcaguggggggggg

SEQ ID NO: 18101 - RNA, 20 nt, Artificial Sequence
  Synthetic
ggcccugcuggccucgaugg

SEQ ID NO: 18102 - RNA, 20 nt, Artificial Sequence
  Synthetic
ggcaucggcggcggcgucgu

SEQ ID NO: 18103 - RNA, 17 nt, Artificial Sequence
  Synthetic
caccaucgaggccagca

SEQ ID NO: 18104 - RNA, 17 nt, Artificial Sequence
  Synthetic
cacacgcacgcaccgca

SEQ ID NO: 18105 - RNA, 17 nt, Artificial Sequence
  Synthetic
cuucuucuucuucuuca

SEQ ID NO: 18106 - RNA, 17 nt, Artificial Sequence
  Synthetic
cuauaucagccaggcga

SEQ ID NO: 18107 - RNA, 17 nt, Artificial Sequence
  Synthetic
uauaucagccaggcgac

SEQ ID NO: 18108 - RNA, 17 nt, Artificial Sequence
  Synthetic
cgauggcggacgaggac

SEQ ID NO: 18109 - RNA, 17 nt, Artificial Sequence
  Synthetic
cauaaugcgguuccacc

SEQ ID NO: 18110 - RNA, 17 nt, Artificial Sequence
  Synthetic
ccgugccacccgaaccc

SEQ ID NO: 18111 - RNA, 17 nt, Artificial Sequence
  Synthetic
accugggggcggaaccc

SEQ ID NO: 18112 - RNA, 17 nt, Artificial Sequence
  Synthetic
cccccccccgcacaccc

SEQ ID NO: 18113 - RNA, 17 nt, Artificial Sequence
  Synthetic
ucgacgccgccgcgccc

SEQ ID NO: 18114 - RNA, 17 nt, Artificial Sequence
  Synthetic
cggccuccccggacgcc

SEQ ID NO: 18115 - RNA, 17 nt, Artificial Sequence
  Synthetic
cggaagccgcccgcgcc

SEQ ID NO: 18116 - RNA, 17 nt, Artificial Sequence
  Synthetic
ccgcgccccggcucgcc

SEQ ID NO: 18117 - RNA, 17 nt, Artificial Sequence
  Synthetic
ucgucuccgccgcggcc

SEQ ID NO: 18118 - RNA, 17 nt, Artificial Sequence
  Synthetic
cgccccgccgcgcggcc

SEQ ID NO: 18119 - RNA, 17 nt, Artificial Sequence
  Synthetic
ccgcgccgucgcgcucc

SEQ ID NO: 18120 - RNA, 17 nt, Artificial Sequence
  Synthetic
aggcggccccggcgucc

SEQ ID NO: 18121 - RNA, 17 nt, Artificial Sequence
  Synthetic
cggcggggcgacggucc

SEQ ID NO: 18122 - RNA, 17 nt, Artificial Sequence
  Synthetic
cgcuccccugcccuucc

SEQ ID NO: 18123 - RNA, 17 nt, Artificial Sequence
  Synthetic
ccaccaucgaggccagc

SEQ ID NO: 18124 - RNA, 17 nt, Artificial Sequence
  Synthetic
cgucucgccgcggcagc

SEQ ID NO: 18125 - RNA, 17 nt, Artificial Sequence
  Synthetic
ugccgcgcgggcggagc

SEQ ID NO: 18126 - RNA, 17 nt, Artificial Sequence
  Synthetic
acggccuccccggacgc

SEQ ID NO: 18127 - RNA, 17 nt, Artificial Sequence
  Synthetic
cacggacgcggacgcgc

SEQ ID NO: 18128 - RNA, 17 nt, Artificial Sequence
  Synthetic
cuaaugagaugccgcgc

SEQ ID NO: 18129 - RNA, 17 nt, Artificial Sequence
  Synthetic
uaguccucggggcgcgc

SEQ ID NO: 18130 - RNA, 17 nt, Artificial Sequence
  Synthetic
aacccgggccgcgcggc

SEQ ID NO: 18131 - RNA, 17 nt, Artificial Sequence
  Synthetic
cucggggcgcgcggggc

SEQ ID NO: 18132 - RNA, 17 nt, Artificial Sequence
  Synthetic
cgcgcgggcgucggggc

SEQ ID NO: 18133 - RNA, 17 nt, Artificial Sequence
  Synthetic
cggguggcacggugggc

SEQ ID NO: 18134 - RNA, 17 nt, Artificial Sequence
  Synthetic
uggcugauauaguccuc

SEQ ID NO: 18135 - RNA, 17 nt, Artificial Sequence
  Synthetic
uccgcgccgucgcgcuc

SEQ ID NO: 18136 - RNA, 17 nt, Artificial Sequence
  Synthetic
cggcggccccggaucuc

SEQ ID NO: 18137 - RNA, 17 nt, Artificial Sequence
  Synthetic
ucgcuccccugcccuuc

SEQ ID NO: 18138 - RNA, 17 nt, Artificial Sequence
  Synthetic
ucuucuucuucuucuuc

SEQ ID NO: 18139 - RNA, 17 nt, Artificial Sequence
  Synthetic
ccgcgcggcccggguuc

SEQ ID NO: 18140 - RNA, 17 nt, Artificial Sequence
  Synthetic
cggcgcggaagaagaag

SEQ ID NO: 18141 - RNA, 17 nt, Artificial Sequence
  Synthetic
uucuucaggggcggcag

SEQ ID NO: 18142 - RNA, 17 nt, Artificial Sequence
  Synthetic
uucuucuucuucuucag

SEQ ID NO: 18143 - RNA, 17 nt, Artificial Sequence
  Synthetic
cacgcacgcaccgcacg

SEQ ID NO: 18144 - RNA, 17 nt, Artificial Sequence
  Synthetic
auaucagccaggcgacg

SEQ ID NO: 18145 - RNA, 17 nt, Artificial Sequence
  Synthetic
ccgccccgcgcgccccg

SEQ ID NO: 18146 - RNA, 17 nt, Artificial Sequence
  Synthetic
cgcgccccggcucgccg

SEQ ID NO: 18147 - RNA, 17 nt, Artificial Sequence
  Synthetic
agcagggccagcugccg

SEQ ID NO: 18148 - RNA, 17 nt, Artificial Sequence
  Synthetic
cuggauccggagauccg

SEQ ID NO: 18149 - RNA, 17 nt, Artificial Sequence
  Synthetic
cgcgccgucgcgcuccg

SEQ ID NO: 18150 - RNA, 17 nt, Artificial Sequence
  Synthetic
cgccggcuccgcccgcg

SEQ ID NO: 18151 - RNA, 17 nt, Artificial Sequence
  Synthetic
cccgaacccgggccgcg

SEQ ID NO: 18152 - RNA, 17 nt, Artificial Sequence
  Synthetic
acccgggccgcgcggcg

SEQ ID NO: 18153 - RNA, 17 nt, Artificial Sequence
  Synthetic
cccggcgagccggggcg

SEQ ID NO: 18154 - RNA, 17 nt, Artificial Sequence
  Synthetic
ucggggcgcgcggggcg

SEQ ID NO: 18155 - RNA, 17 nt, Artificial Sequence
  Synthetic
cggacgcgcgggcgucg

SEQ ID NO: 18156 - RNA, 17 nt, Artificial Sequence
  Synthetic
cggggcggggggaaagg

SEQ ID NO: 18157 - RNA, 17 nt, Artificial Sequence
  Synthetic
auggcggacgaggacgg

SEQ ID NO: 18158 - RNA, 17 nt, Artificial Sequence
  Synthetic
cgcgcgggcggagccgg

SEQ ID NO: 18159 - RNA, 17 nt, Artificial Sequence
  Synthetic
aaaggaggaggacgcgg

SEQ ID NO: 18160 - RNA, 17 nt, Artificial Sequence
  Synthetic
auggaggggguccgcgg

SEQ ID NO: 18161 - RNA, 17 nt, Artificial Sequence
  Synthetic
cggggcgcgcggggcgg

SEQ ID NO: 18162 - RNA, 17 nt, Artificial Sequence
  Synthetic
ccgaccggggugugcgg

SEQ ID NO: 18163 - RNA, 17 nt, Artificial Sequence
  Synthetic
ccgcacaccccggucgg

SEQ ID NO: 18164 - RNA, 17 nt, Artificial Sequence
  Synthetic
cgaccggggugugcggg

SEQ ID NO: 18165 - RNA, 17 nt, Artificial Sequence
  Synthetic
cgcggcccggguucggg

SEQ ID NO: 18166 - RNA, 17 nt, Artificial Sequence
  Synthetic
uucuucuucuucagggg

SEQ ID NO: 18167 - RNA, 17 nt, Artificial Sequence
  Synthetic
ccucggggcgcgcgggg

SEQ ID NO: 18168 - RNA, 17 nt, Artificial Sequence
  Synthetic
acgcgcgggcgucgggg

SEQ ID NO: 18169 - RNA, 17 nt, Artificial Sequence
  Synthetic
ccgucgcgcuccggggg

SEQ ID NO: 18170 - RNA, 17 nt, Artificial Sequence
  Synthetic
accggggugugcggggg

SEQ ID NO: 18171 - RNA, 17 nt, Artificial Sequence
  Synthetic
ccggggugugcgggggg

SEQ ID NO: 18172 - RNA, 17 nt, Artificial Sequence
  Synthetic
aggggcggcaguggggg

SEQ ID NO: 18173 - RNA, 17 nt, Artificial Sequence
  Synthetic
caggggcggcagugggg

SEQ ID NO: 18174 - RNA, 17 nt, Artificial Sequence
  Synthetic
ucaggggcggcaguggg

SEQ ID NO: 18175 - RNA, 17 nt, Artificial Sequence
  Synthetic
uccggguucgggguggg

SEQ ID NO: 18176 - RNA, 17 nt, Artificial Sequence
  Synthetic
ccugcuggccucgaugg

SEQ ID NO: 18177 - RNA, 17 nt, Artificial Sequence
  Synthetic
aaugcgguuccaccugg

SEQ ID NO: 18178 - RNA, 17 nt, Artificial Sequence
  Synthetic
uucaggggcggcagugg

SEQ ID NO: 18179 - RNA, 17 nt, Artificial Sequence
  Synthetic
cuucaggggcggcagug

SEQ ID NO: 18180 - RNA, 17 nt, Artificial Sequence
  Synthetic
ucucucucccccccgug

SEQ ID NO: 18181 - RNA, 17 nt, Artificial Sequence
  Synthetic
cuggcugauauaguccu

SEQ ID NO: 18182 - RNA, 17 nt, Artificial Sequence
  Synthetic
ucuucaggggcggcagu

SEQ ID NO: 18183 - RNA, 17 nt, Artificial Sequence
  Synthetic
cgccggggccgccucgu

SEQ ID NO: 18184 - RNA, 17 nt, Artificial Sequence
  Synthetic
caguggggggggguggu

SEQ ID NO: 18185 - RNA, 20 nt, Artificial Sequence
  Synthetic
aagacgacgacgacgacgca

SEQ ID NO: 18186 - RNA, 20 nt, Artificial Sequence
  Synthetic
cggcccggguucggguggca

SEQ ID NO: 18187 - RNA, 20 nt, Artificial Sequence
  Synthetic
cgggccgcgcggcggggcga

SEQ ID NO: 18188 - RNA, 20 nt, Artificial Sequence
  Synthetic
ucgcgcuccggggggggcga

SEQ ID NO: 18189 - RNA, 20 nt, Artificial Sequence
  Synthetic
cgggccgcggcggagacgac

SEQ ID NO: 18190 - RNA, 20 nt, Artificial Sequence
  Synthetic
accgccgcccaccccgaacc

SEQ ID NO: 18191 - RNA, 20 nt, Artificial Sequence
  Synthetic
uccaccugggggcggaaccc

SEQ ID NO: 18192 - RNA, 20 nt, Artificial Sequence
  Synthetic
agacccccccccgcacaccc

SEQ ID NO: 18193 - RNA, 20 nt, Artificial Sequence
  Synthetic
cucgccgggguuccgccccc

SEQ ID NO: 18194 - RNA, 20 nt, Artificial Sequence
  Synthetic
cgaucgacgccgccgcgccc

SEQ ID NO: 18195 - RNA, 20 nt, Artificial Sequence
  Synthetic
ccccgaggacuauaucagcc

SEQ ID NO: 18196 - RNA, 20 nt, Artificial Sequence
  Synthetic
cggcuaccgacgcggccgcc

SEQ ID NO: 18197 - RNA, 20 nt, Artificial Sequence
  Synthetic
cgcggcaucucauuagcgcc

SEQ ID NO: 18198 - RNA, 20 nt, Artificial Sequence
  Synthetic
ccgccgcgccccggcucgcc

SEQ ID NO: 18199 - RNA, 20 nt, Artificial Sequence
  Synthetic
uggacgaucgccccgucgcc

SEQ ID NO: 18200 - RNA, 20 nt, Artificial Sequence
  Synthetic
cggucgucuccgccgcggcc

SEQ ID NO: 18201 - RNA, 20 nt, Artificial Sequence
  Synthetic
cgucgccccgccgcgcggcc

SEQ ID NO: 18202 - RNA, 20 nt, Artificial Sequence
  Synthetic
ucggcuggauccggagaucc

SEQ ID NO: 18203 - RNA, 20 nt, Artificial Sequence
  Synthetic
acgaggcggccccggcgucc

SEQ ID NO: 18204 - RNA, 20 nt, Artificial Sequence
  Synthetic
ccgcggcggagaaggcgagc

SEQ ID NO: 18205 - RNA, 20 nt, Artificial Sequence
  Synthetic
agaugccgcgcgggcggagc

SEQ ID NO: 18206 - RNA, 20 nt, Artificial Sequence
  Synthetic
ccgaacccgggccgcgcggc

SEQ ID NO: 18207 - RNA, 20 nt, Artificial Sequence
  Synthetic
ccgccgcgcggcccggguuc

SEQ ID NO: 18208 - RNA, 20 nt, Artificial Sequence
  Synthetic
cggggcgacgguccggguuc

SEQ ID NO: 18209 - RNA, 20 nt, Artificial Sequence
  Synthetic
uucuucuucaggggcggcag

SEQ ID NO: 18210 - RNA, 20 nt, Artificial Sequence
  Synthetic
uccgcggcggagaaggcgag

SEQ ID NO: 18211 - RNA, 20 nt, Artificial Sequence
  Synthetic
acuauaucagccaggcgacg

SEQ ID NO: 18212 - RNA, 20 nt, Artificial Sequence
  Synthetic
cgcgauggcggacgaggacg

SEQ ID NO: 18213 - RNA, 20 nt, Artificial Sequence
  Synthetic
cccccgccccgcgcgccccg

SEQ ID NO: 18214 - RNA, 20 nt, Artificial Sequence
  Synthetic
cgccgcgccccggcucgccg

SEQ ID NO: 18215 - RNA, 20 nt, Artificial Sequence
  Synthetic
cgaggcggccccggcguccg

SEQ ID NO: 18216 - RNA, 20 nt, Artificial Sequence
  Synthetic
ccgccacggacgcggacgcg

SEQ ID NO: 18217 - RNA, 20 nt, Artificial Sequence
  Synthetic
cgccgccggcuccgcccgcg

SEQ ID NO: 18218 - RNA, 20 nt, Artificial Sequence
  Synthetic
ccacccgaacccgggccgcg

SEQ ID NO: 18219 - RNA, 20 nt, Artificial Sequence
  Synthetic
caucucauuagcgcccggcg

SEQ ID NO: 18220 - RNA, 20 nt, Artificial Sequence
  Synthetic
cgaacccgggccgcgcggcg

SEQ ID NO: 18221 - RNA, 20 nt, Artificial Sequence
  Synthetic
uccucggggcgcgcggggcg

SEQ ID NO: 18222 - RNA, 20 nt, Artificial Sequence
  Synthetic
cggggcggggggaaaggagg

SEQ ID NO: 18223 - RNA, 20 nt, Artificial Sequence
  Synthetic
aaaggaggaggacgcggagg

SEQ ID NO: 18224 - RNA, 20 nt, Artificial Sequence
  Synthetic
cacacgcacgcaccgcacgg

SEQ ID NO: 18225 - RNA, 20 nt, Artificial Sequence
  Synthetic
ugccgcgcgggcggagccgg

SEQ ID NO: 18226 - RNA, 20 nt, Artificial Sequence
  Synthetic
cggguggcacggugggccgg

SEQ ID NO: 18227 - RNA, 20 nt, Artificial Sequence
  Synthetic
cccgaacccgggccgcgcgg

SEQ ID NO: 18228 - RNA, 20 nt, Artificial Sequence
  Synthetic
cccggcgagccggggcgcgg

SEQ ID NO: 18229 - RNA, 20 nt, Artificial Sequence
  Synthetic
cgcgcgggcggagccggcgg

SEQ ID NO: 18230 - RNA, 20 nt, Artificial Sequence
  Synthetic
ccucggggcgcgcggggcgg

SEQ ID NO: 18231 - RNA, 20 nt, Artificial Sequence
  Synthetic
uccggguucggggugggcgg

SEQ ID NO: 18232 - RNA, 20 nt, Artificial Sequence
  Synthetic
cgcguccgcguccguggcgg

SEQ ID NO: 18233 - RNA, 20 nt, Artificial Sequence
  Synthetic
cccccgcacaccccggucgg

SEQ ID NO: 18234 - RNA, 20 nt, Artificial Sequence
  Synthetic
ccgcgccgucgcgcuccggg

SEQ ID NO: 18235 - RNA, 20 nt, Artificial Sequence
  Synthetic
ucauuagcgcccggcgcggg

SEQ ID NO: 18236 - RNA, 20 nt, Artificial Sequence
  Synthetic
cucggggcgcgcggggcggg

SEQ ID NO: 18237 - RNA, 20 nt, Artificial Sequence
  Synthetic
ccgcgcggcccggguucggg

SEQ ID NO: 18238 - RNA, 20 nt, Artificial Sequence
  Synthetic
uucuucuucuucuucagggg

SEQ ID NO: 18239 - RNA, 20 nt, Artificial Sequence
  Synthetic
cgcgccgucgcgcuccgggg

SEQ ID NO: 18240 - RNA, 20 nt, Artificial Sequence
  Synthetic
aguccucggggcgcgcgggg

SEQ ID NO: 18241 - RNA, 20 nt, Artificial Sequence
  Synthetic
uccgaccggggugugcgggg

SEQ ID NO: 18242 - RNA, 20 nt, Artificial Sequence
  Synthetic
cggacgcgcgggcgucgggg

SEQ ID NO: 18243 - RNA, 20 nt, Artificial Sequence
  Synthetic
ccgaccggggugugcggggg

SEQ ID NO: 18244 - RNA, 20 nt, Artificial Sequence
  Synthetic
cgaccggggugugcgggggg

SEQ ID NO: 18245 - RNA, 20 nt, Artificial Sequence
  Synthetic
ucaggggcggcagugggggg

SEQ ID NO: 18246 - RNA, 20 nt, Artificial Sequence
  Synthetic
uucaggggcggcaguggggg

SEQ ID NO: 18247 - RNA, 20 nt, Artificial Sequence
  Synthetic
cuucaggggcggcagugggg

SEQ ID NO: 18248 - RNA, 20 nt, Artificial Sequence
  Synthetic
ucuucaggggcggcaguggg

SEQ ID NO: 18249 - RNA, 20 nt, Artificial Sequence
  Synthetic
cgguccggguucgggguggg

SEQ ID NO: 18250 - RNA, 20 nt, Artificial Sequence
  Synthetic
cauaaugcgguuccaccugg

SEQ ID NO: 18251 - RNA, 20 nt, Artificial Sequence
  Synthetic
uucuucaggggcggcagugg

SEQ ID NO: 18252 - RNA, 20 nt, Artificial Sequence
  Synthetic
cuucuucaggggcggcagug

SEQ ID NO: 18253 - RNA, 20 nt, Artificial Sequence
  Synthetic
cagucucucucccccccgug

SEQ ID NO: 18254 - RNA, 20 nt, Artificial Sequence
  Synthetic
ccccccccgcacaccccggu

SEQ ID NO: 18255 - RNA, 20 nt, Artificial Sequence
  Synthetic
cgacgguccggguucggggu

SEQ ID NO: 18256 - RNA, 20 nt, Artificial Sequence
  Synthetic
cggcaguggggggggguggu

SEQ ID NO: 18257 - RNA, 20 nt, Artificial Sequence
  Synthetic
cccgccgcgcggcccggguu

SEQ ID NO: 18258 - RNA, 17 nt, Artificial Sequence
  Synthetic
ggcggcuccgccccaaa

SEQ ID NO: 18259 - RNA, 17 nt, Artificial Sequence
  Synthetic
gcgggcuccgccccaaa

SEQ ID NO: 18260 - RNA, 17 nt, Artificial Sequence
  Synthetic
cccccgccggccccaaa

SEQ ID NO: 18261 - RNA, 17 nt, Artificial Sequence
  Synthetic
uuccucgcgcacauaaa

SEQ ID NO: 18262 - RNA, 17 nt, Artificial Sequence
  Synthetic
agccgcccgcggaccaa

SEQ ID NO: 18263 - RNA, 17 nt, Artificial Sequence
  Synthetic
gggcggcuccgccccaa

SEQ ID NO: 18264 - RNA, 17 nt, Artificial Sequence
  Synthetic
cgcgggcuccgccccaa

SEQ ID NO: 18265 - RNA, 17 nt, Artificial Sequence
  Synthetic
gcccccgccggccccaa

SEQ ID NO: 18266 - RNA, 17 nt, Artificial Sequence
  Synthetic
gggccggcgggggccaa

SEQ ID NO: 18267 - RNA, 17 nt, Artificial Sequence
  Synthetic
uuuaugugcgcgaggaa

SEQ ID NO: 18268 - RNA, 17 nt, Artificial Sequence
  Synthetic
guuccucgcgcacauaa

SEQ ID NO: 18269 - RNA, 17 nt, Artificial Sequence
  Synthetic
cggucgccgccgcacca

SEQ ID NO: 18270 - RNA, 17 nt, Artificial Sequence
  Synthetic
ggcguacccggacccca

SEQ ID NO: 18271 - RNA, 17 nt, Artificial Sequence
  Synthetic
ccggccgagcccgccca

SEQ ID NO: 18272 - RNA, 17 nt, Artificial Sequence
  Synthetic
cggcgacaggcuggcca

SEQ ID NO: 18273 - RNA, 17 nt, Artificial Sequence
  Synthetic
aagggggcggggccgca

SEQ ID NO: 18274 - RNA, 17 nt, Artificial Sequence
  Synthetic
gacgcgggccccgggca

SEQ ID NO: 18275 - RNA, 17 nt, Artificial Sequence
  Synthetic
cucgucguccgcgccga

SEQ ID NO: 18276 - RNA, 17 nt, Artificial Sequence
  Synthetic
ggcgggggugcccgcga

SEQ ID NO: 18277 - RNA, 17 nt, Artificial Sequence
  Synthetic
cccgaggcgggcccgga

SEQ ID NO: 18278 - RNA, 17 nt, Artificial Sequence
  Synthetic
cgcggcggagaccggga

SEQ ID NO: 18279 - RNA, 17 nt, Artificial Sequence
  Synthetic
uaguauauauauuauua

SEQ ID NO: 18280 - RNA, 17 nt, Artificial Sequence
  Synthetic
gccgcccgcggaccaac

SEQ ID NO: 18281 - RNA, 17 nt, Artificial Sequence
  Synthetic
ggccggcgggggccaac

SEQ ID NO: 18282 - RNA, 17 nt, Artificial Sequence
  Synthetic
ccgcaccaggggcacac

SEQ ID NO: 18283 - RNA, 17 nt, Artificial Sequence
  Synthetic
gggcaaagugcgagcac

SEQ ID NO: 18284 - RNA, 17 nt, Artificial Sequence
  Synthetic
ggcugcgcggcggagac

SEQ ID NO: 18285 - RNA, 17 nt, Artificial Sequence
  Synthetic
ccgggggucgcggcgac

SEQ ID NO: 18286 - RNA, 17 nt, Artificial Sequence
  Synthetic
ccuggugcggcggcgac

SEQ ID NO: 18287 - RNA, 17 nt, Artificial Sequence
  Synthetic
ccgaggcgggcccggac

SEQ ID NO: 18288 - RNA, 17 nt, Artificial Sequence
  Synthetic
ccgcuggguccgcggac

SEQ ID NO: 18289 - RNA, 17 nt, Artificial Sequence
  Synthetic
ccggucgccgccgcacc

SEQ ID NO: 18290 - RNA, 17 nt, Artificial Sequence
  Synthetic
gcugcgcggcggagacc

SEQ ID NO: 18291 - RNA, 17 nt, Artificial Sequence
  Synthetic
cuggugcggcggcgacc

SEQ ID NO: 18292 - RNA, 17 nt, Artificial Sequence
  Synthetic
gguccgcggggcguacc

SEQ ID NO: 18293 - RNA, 17 nt, Artificial Sequence
  Synthetic
ccugucgccgcgacccc

SEQ ID NO: 18294 - RNA, 17 nt, Artificial Sequence
  Synthetic
gccggggcgccgccccc

SEQ ID NO: 18295 - RNA, 17 nt, Artificial Sequence
  Synthetic
ggccggggcgccgcccc

SEQ ID NO: 18296 - RNA, 17 nt, Artificial Sequence
  Synthetic
gugcccgcgagggcccc

SEQ ID NO: 18297 - RNA, 17 nt, Artificial Sequence
  Synthetic
gggaugacgcgggcccc

SEQ ID NO: 18298 - RNA, 17 nt, Artificial Sequence
  Synthetic
cgcagccggugugcccc

SEQ ID NO: 18299 - RNA, 17 nt, Artificial Sequence
  Synthetic
cccggccgagcccgccc

SEQ ID NO: 18300 - RNA, 17 nt, Artificial Sequence
  Synthetic
cagggccgagcccgccc

SEQ ID NO: 18301 - RNA, 17 nt, Artificial Sequence
  Synthetic
ccccgggggcggcgccc

SEQ ID NO: 18302 - RNA, 17 nt, Artificial Sequence
  Synthetic
cggggcgggcucggccc

SEQ ID NO: 18303 - RNA, 17 nt, Artificial Sequence
  Synthetic
ggugcccgcgagggccc

SEQ ID NO: 18304 - RNA, 17 nt, Artificial Sequence
  Synthetic
cgggaugacgcgggccc

SEQ ID NO: 18305 - RNA, 17 nt, Artificial Sequence
  Synthetic
gcacuggcgcccugccc

SEQ ID NO: 18306 - RNA, 17 nt, Artificial Sequence
  Synthetic
gcgcuggcgcccugccc

SEQ ID NO: 18307 - RNA, 17 nt, Artificial Sequence
  Synthetic
ccgccuggagcgccgcc

SEQ ID NO: 18308 - RNA, 17 nt, Artificial Sequence
  Synthetic
ggcgaccgcgggccgcc

SEQ ID NO: 18309 - RNA, 17 nt, Artificial Sequence
  Synthetic
ggugucggcggggcgcc

SEQ ID NO: 18310 - RNA, 17 nt, Artificial Sequence
  Synthetic
ccgagcccgccccggcc

SEQ ID NO: 18311 - RNA, 17 nt, Artificial Sequence
  Synthetic
ccugggcgggcucggcc

SEQ ID NO: 18312 - RNA, 17 nt, Artificial Sequence
  Synthetic
ccgcggggguccgggcc

SEQ ID NO: 18313 - RNA, 17 nt, Artificial Sequence
  Synthetic
ccaccgccgcgcgggcc

SEQ ID NO: 18314 - RNA, 17 nt, Artificial Sequence
  Synthetic
ccgccccgaggcgggcc

SEQ ID NO: 18315 - RNA, 17 nt, Artificial Sequence
  Synthetic
agcacuggcgcccugcc

SEQ ID NO: 18316 - RNA, 17 nt, Artificial Sequence
  Synthetic
agcgcuggcgcccugcc

SEQ ID NO: 18317 - RNA, 17 nt, Artificial Sequence
  Synthetic
gggcccggcggcgcucc

SEQ ID NO: 18318 - RNA, 17 nt, Artificial Sequence
  Synthetic
cggcccgccccccgucc

SEQ ID NO: 18319 - RNA, 17 nt, Artificial Sequence
  Synthetic
ugccgccgcugccgucc

SEQ ID NO: 18320 - RNA, 17 nt, Artificial Sequence
  Synthetic
auaaagggccggcgucc

SEQ ID NO: 18321 - RNA, 17 nt, Artificial Sequence
  Synthetic
ggucgccgcgggggucc

SEQ ID NO: 18322 - RNA, 17 nt, Artificial Sequence
  Synthetic
ggcuggccauggggucc

SEQ ID NO: 18323 - RNA, 17 nt, Artificial Sequence
  Synthetic
ggucuccgccgcgcagc

SEQ ID NO: 18324 - RNA, 17 nt, Artificial Sequence
  Synthetic
gacgacgaccgcgacgc

SEQ ID NO: 18325 - RNA, 17 nt, Artificial Sequence
  Synthetic
ggcggcgaccgggacgc

SEQ ID NO: 18326 - RNA, 17 nt, Artificial Sequence
  Synthetic
agcccgcgggaugacgc

SEQ ID NO: 18327 - RNA, 17 nt, Artificial Sequence
  Synthetic
acccccgcggcgaccgc

SEQ ID NO: 18328 - RNA, 17 nt, Artificial Sequence
  Synthetic
gccggcgcgccccccgc

SEQ ID NO: 18329 - RNA, 17 nt, Artificial Sequence
  Synthetic
cucccguuggcccccgc

SEQ ID NO: 18330 - RNA, 17 nt, Artificial Sequence
  Synthetic
cucggggcggagcccgc

SEQ ID NO: 18331 - RNA, 17 nt, Artificial Sequence
  Synthetic
uuuggggcggagcccgc

SEQ ID NO: 18332 - RNA, 17 nt, Artificial Sequence
  Synthetic
ggcccgcgucaucccgc

SEQ ID NO: 18333 - RNA, 17 nt, Artificial Sequence
  Synthetic
gccgcagaccacgccgc

SEQ ID NO: 18334 - RNA, 17 nt, Artificial Sequence
  Synthetic
accaccaccaccgccgc

SEQ ID NO: 18335 - RNA, 17 nt, Artificial Sequence
  Synthetic
gccgccuggagcgccgc

SEQ ID NO: 18336 - RNA, 17 nt, Artificial Sequence
  Synthetic
cggcccgcggucgccgc

SEQ ID NO: 18337 - RNA, 17 nt, Artificial Sequence
  Synthetic
accgcgacgcgggccgc

SEQ ID NO: 18338 - RNA, 17 nt, Artificial Sequence
  Synthetic
aaagggggcggggccgc

SEQ ID NO: 18339 - RNA, 17 nt, Artificial Sequence
  Synthetic
cgacguccgcgguccgc

SEQ ID NO: 18340 - RNA, 17 nt, Artificial Sequence
  Synthetic
ucgccccguugguccgc

SEQ ID NO: 18341 - RNA, 17 nt, Artificial Sequence
  Synthetic
cagaggcggccgagcgc

SEQ ID NO: 18342 - RNA, 17 nt, Artificial Sequence
  Synthetic
gggcaaagugcgagcgc

SEQ ID NO: 18343 - RNA, 17 nt, Artificial Sequence
  Synthetic
ggggccaacgggagcgc

SEQ ID NO: 18344 - RNA, 17 nt, Artificial Sequence
  Synthetic
gccggccaccgccgcgc

SEQ ID NO: 18345 - RNA, 17 nt, Artificial Sequence
  Synthetic
gccggcggggggcgcgc

SEQ ID NO: 18346 - RNA, 17 nt, Artificial Sequence
  Synthetic
ggcguggucugcggcgc

SEQ ID NO: 18347 - RNA, 17 nt, Artificial Sequence
  Synthetic
uggugucggcggggcgc

SEQ ID NO: 18348 - RNA, 17 nt, Artificial Sequence
  Synthetic
ggcgcuggcgggggcgc

SEQ ID NO: 18349 - RNA, 17 nt, Artificial Sequence
  Synthetic
caacggggcgaccucgc

SEQ ID NO: 18350 - RNA, 17 nt, Artificial Sequence
  Synthetic
gcccccggggcccucgc

SEQ ID NO: 18351 - RNA, 17 nt, Artificial Sequence
  Synthetic
gggucgcggcgacaggc

SEQ ID NO: 18352 - RNA, 17 nt, Artificial Sequence
  Synthetic
gggcuccgccccgaggc

SEQ ID NO: 18353 - RNA, 17 nt, Artificial Sequence
  Synthetic
gcggacgacgaggaggc

SEQ ID NO: 18354 - RNA, 17 nt, Artificial Sequence
  Synthetic
ggcggccgagcgccggc

SEQ ID NO: 18355 - RNA, 17 nt, Artificial Sequence
  Synthetic
gccccuuuggggccggc

SEQ ID NO: 18356 - RNA, 17 nt, Artificial Sequence
  Synthetic
cccugggcgggcucggc

SEQ ID NO: 18357 - RNA, 17 nt, Artificial Sequence
  Synthetic
guggugguggugucggc

SEQ ID NO: 18358 - RNA, 17 nt, Artificial Sequence
  Synthetic
ucgcgcacauaaagggc

SEQ ID NO: 18359 - RNA, 17 nt, Artificial Sequence
  Synthetic
ugacgcgggccccgggc

SEQ ID NO: 18360 - RNA, 17 nt, Artificial Sequence
  Synthetic
gccgcggggguccgggc

SEQ ID NO: 18361 - RNA, 17 nt, Artificial Sequence
  Synthetic
cagaccacgccgcgggc

SEQ ID NO: 18362 - RNA, 17 nt, Artificial Sequence
  Synthetic
gccggccccaaaggggc

SEQ ID NO: 18363 - RNA, 17 nt, Artificial Sequence
  Synthetic
gggguccgggccggggc

SEQ ID NO: 18364 - RNA, 17 nt, Artificial Sequence
  Synthetic
caacgggagcgcggggc

SEQ ID NO: 18365 - RNA, 17 nt, Artificial Sequence
  Synthetic
uccgccccaaagggggc

SEQ ID NO: 18366 - RNA, 17 nt, Artificial Sequence
  Synthetic
gggcccggacggggggc

SEQ ID NO: 18367 - RNA, 17 nt, Artificial Sequence
  Synthetic
gccggccccuuuggggc

SEQ ID NO: 18368 - RNA, 17 nt, Artificial Sequence
  Synthetic
cgggcucggcccugggc

SEQ ID NO: 18369 - RNA, 17 nt, Artificial Sequence
  Synthetic
uggucugcggcgcuggc

SEQ ID NO: 18370 - RNA, 17 nt, Artificial Sequence
  Synthetic
gcccgcgcggcgguggc

SEQ ID NO: 18371 - RNA, 17 nt, Artificial Sequence
  Synthetic
ucgugguaaugagaugc

SEQ ID NO: 18372 - RNA, 17 nt, Artificial Sequence
  Synthetic
ucugacucaucaaaauc

SEQ ID NO: 18373 - RNA, 17 nt, Artificial Sequence
  Synthetic
cgccgacgacgaggauc

SEQ ID NO: 18374 - RNA, 17 nt, Artificial Sequence
  Synthetic
ccguccgggcccgccuc

SEQ ID NO: 18375 - RNA, 17 nt, Artificial Sequence
  Synthetic
accgcggacgucgucuc

SEQ ID NO: 18376 - RNA, 17 nt, Artificial Sequence
  Synthetic
acggcccgccccccguc

SEQ ID NO: 18377 - RNA, 17 nt, Artificial Sequence
  Synthetic
cggucgccgcggggguc

SEQ ID NO: 18378 - RNA, 17 nt, Artificial Sequence
  Synthetic
aggcuggccaugggguc

SEQ ID NO: 18379 - RNA, 17 nt, Artificial Sequence
  Synthetic
gcggcuccgccccaaag

SEQ ID NO: 18380 - RNA, 17 nt, Artificial Sequence
  Synthetic
cgggcuccgccccaaag

SEQ ID NO: 18381 - RNA, 17 nt, Artificial Sequence
  Synthetic
ccccgccggccccaaag

SEQ ID NO: 18382 - RNA, 17 nt, Artificial Sequence
  Synthetic
ggucgccgccgcaccag

SEQ ID NO: 18383 - RNA, 17 nt, Artificial Sequence
  Synthetic
ccgguccgcggacccag

SEQ ID NO: 18384 - RNA, 17 nt, Artificial Sequence
  Synthetic
ggagaccgggacggcag

SEQ ID NO: 18385 - RNA, 17 nt, Artificial Sequence
  Synthetic
ggauuuugaugagucag

SEQ ID NO: 18386 - RNA, 17 nt, Artificial Sequence
  Synthetic
ccgcccgcggaccaacg

SEQ ID NO: 18387 - RNA, 17 nt, Artificial Sequence
  Synthetic
ggaggcggaugcagacg

SEQ ID NO: 18388 - RNA, 17 nt, Artificial Sequence
  Synthetic
gucgucgucgucagacg

SEQ ID NO: 18389 - RNA, 17 nt, Artificial Sequence
  Synthetic
ggaggacgccgacgacg

SEQ ID NO: 18390 - RNA, 17 nt, Artificial Sequence
  Synthetic
ccucggcgcggacgacg

SEQ ID NO: 18391 - RNA, 17 nt, Artificial Sequence
  Synthetic
ugacgacgaccgcgacg

SEQ ID NO: 18392 - RNA, 17 nt, Artificial Sequence
  Synthetic
cgaggcgggcccggacg

SEQ ID NO: 18393 - RNA, 17 nt, Artificial Sequence
  Synthetic
gagcccgcgggaugacg

SEQ ID NO: 18394 - RNA, 17 nt, Artificial Sequence
  Synthetic
gacccccgcggcgaccg

SEQ ID NO: 18395 - RNA, 17 nt, Artificial Sequence
  Synthetic
guacgccccgcggaccg

SEQ ID NO: 18396 - RNA, 17 nt, Artificial Sequence
  Synthetic
cccggcccggacccccg

SEQ ID NO: 18397 - RNA, 17 nt, Artificial Sequence
  Synthetic
ccggggcgccgcccccg

SEQ ID NO: 18398 - RNA, 17 nt, Artificial Sequence
  Synthetic
gguccggguacgccccg

SEQ ID NO: 18399 - RNA, 17 nt, Artificial Sequence
  Synthetic
ccgcgggcuccgccccg

SEQ ID NO: 18400 - RNA, 17 nt, Artificial Sequence
  Synthetic
ugcccgcgagggccccg

SEQ ID NO: 18401 - RNA, 17 nt, Artificial Sequence
  Synthetic
ccucggggcggagcccg

SEQ ID NO: 18402 - RNA, 17 nt, Artificial Sequence
  Synthetic
cuuuggggcggagcccg

SEQ ID NO: 18403 - RNA, 17 nt, Artificial Sequence
  Synthetic
gccgagggucccgcccg

SEQ ID NO: 18404 - RNA, 17 nt, Artificial Sequence
  Synthetic
uggggcggagccgcccg

SEQ ID NO: 18405 - RNA, 17 nt, Artificial Sequence
  Synthetic
gcgcuccaggcggcccg

SEQ ID NO: 18406 - RNA, 17 nt, Artificial Sequence
  Synthetic
cacuggcgcccugcccg

SEQ ID NO: 18407 - RNA, 17 nt, Artificial Sequence
  Synthetic
cgcuggcgcccugcccg

SEQ ID NO: 18408 - RNA, 17 nt, Artificial Sequence
  Synthetic
gggcccgcgucaucccg

SEQ ID NO: 18409 - RNA, 17 nt, Artificial Sequence
  Synthetic
cgccgcagaccacgccg

SEQ ID NO: 18410 - RNA, 17 nt, Artificial Sequence
  Synthetic
ccucgucguccgcgccg

SEQ ID NO: 18411 - RNA, 17 nt, Artificial Sequence
  Synthetic
gugucggcggggcgccg

SEQ ID NO: 18412 - RNA, 17 nt, Artificial Sequence
  Synthetic
gcggcccgcggucgccg

SEQ ID NO: 18413 - RNA, 17 nt, Artificial Sequence
  Synthetic
cugggcgggcucggccg

SEQ ID NO: 18414 - RNA, 17 nt, Artificial Sequence
  Synthetic
cgcggggguccgggccg

SEQ ID NO: 18415 - RNA, 17 nt, Artificial Sequence
  Synthetic
accggagacgacguccg

SEQ ID NO: 18416 - RNA, 17 nt, Artificial Sequence
  Synthetic
acgucgucuccgguccg

SEQ ID NO: 18417 - RNA, 17 nt, Artificial Sequence
  Synthetic
acgacguccgcgguccg

SEQ ID NO: 18418 - RNA, 17 nt, Artificial Sequence
  Synthetic
gcgggccgcuggguccg

SEQ ID NO: 18419 - RNA, 17 nt, Artificial Sequence
  Synthetic
gucgccccguugguccg

SEQ ID NO: 18420 - RNA, 17 nt, Artificial Sequence
  Synthetic
gggggccaacgggagcg

SEQ ID NO: 18421 - RNA, 17 nt, Artificial Sequence
  Synthetic
gcgccgccgggcccgcg

SEQ ID NO: 18422 - RNA, 17 nt, Artificial Sequence
  Synthetic
aggcgggggugcccgcg

SEQ ID NO: 18423 - RNA, 17 nt, Artificial Sequence
  Synthetic
ggccggccaccgccgcg

SEQ ID NO: 18424 - RNA, 17 nt, Artificial Sequence
  Synthetic
ggcccgcggucgccgcg

SEQ ID NO: 18425 - RNA, 17 nt, Artificial Sequence
  Synthetic
gacguccgcgguccgcg

SEQ ID NO: 18426 - RNA, 17 nt, Artificial Sequence
  Synthetic
gggccaacgggagcgcg

SEQ ID NO: 18427 - RNA, 17 nt, Artificial Sequence
  Synthetic
ggcccuuuaugugcgcg

SEQ ID NO: 18428 - RNA, 17 nt, Artificial Sequence
  Synthetic
cggacgacgaggaggcg

SEQ ID NO: 18429 - RNA, 17 nt, Artificial Sequence
  Synthetic
gcggccgagcgccggcg

SEQ ID NO: 18430 - RNA, 17 nt, Artificial Sequence
  Synthetic
ccccaaaggggccggcg

SEQ ID NO: 18431 - RNA, 17 nt, Artificial Sequence
  Synthetic
ccccuuuggggccggcg

SEQ ID NO: 18432 - RNA, 17 nt, Artificial Sequence
  Synthetic
gggucccgcccgcggcg

SEQ ID NO: 18433 - RNA, 17 nt, Artificial Sequence
  Synthetic
gggcgggacccucggcg

SEQ ID NO: 18434 - RNA, 17 nt, Artificial Sequence
  Synthetic
uggugguggugucggcg

SEQ ID NO: 18435 - RNA, 17 nt, Artificial Sequence
  Synthetic
ccgccccaaagggggcg

SEQ ID NO: 18436 - RNA, 17 nt, Artificial Sequence
  Synthetic
cggcgcuggcgggggcg

SEQ ID NO: 18437 - RNA, 17 nt, Artificial Sequence
  Synthetic
ggucugcggcgcuggcg

SEQ ID NO: 18438 - RNA, 17 nt, Artificial Sequence
  Synthetic
ggggcacaccggcugcg

SEQ ID NO: 18439 - RNA, 17 nt, Artificial Sequence
  Synthetic
cgcccccggggcccucg

SEQ ID NO: 18440 - RNA, 17 nt, Artificial Sequence
  Synthetic
cguccgggcccgccucg

SEQ ID NO: 18441 - RNA, 17 nt, Artificial Sequence
  Synthetic
cccagcggcccgcgucg

SEQ ID NO: 18442 - RNA, 17 nt, Artificial Sequence
  Synthetic
cggggcgccgggggucg

SEQ ID NO: 18443 - RNA, 17 nt, Artificial Sequence
  Synthetic
cggcuccgccccaaagg

SEQ ID NO: 18444 - RNA, 17 nt, Artificial Sequence
  Synthetic
gggcuccgccccaaagg

SEQ ID NO: 18445 - RNA, 17 nt, Artificial Sequence
  Synthetic
cccggcggcgcuccagg

SEQ ID NO: 18446 - RNA, 17 nt, Artificial Sequence
  Synthetic
uuuugaugagucagagg

SEQ ID NO: 18447 - RNA, 17 nt, Artificial Sequence
  Synthetic
ggcggaugcagacgagg

SEQ ID NO: 18448 - RNA, 17 nt, Artificial Sequence
  Synthetic
gucgucgucagacgagg

SEQ ID NO: 18449 - RNA, 17 nt, Artificial Sequence
  Synthetic
cggcgcggacgacgagg

SEQ ID NO: 18450 - RNA, 17 nt, Artificial Sequence
  Synthetic
cgggcuccgccccgagg

SEQ ID NO: 18451 - RNA, 17 nt, Artificial Sequence
  Synthetic
ggaugcagacgaggagg

SEQ ID NO: 18452 - RNA, 17 nt, Artificial Sequence
  Synthetic
gucgucagacgaggagg

SEQ ID NO: 18453 - RNA, 17 nt, Artificial Sequence
  Synthetic
cgcggacgacgaggagg

SEQ ID NO: 18454 - RNA, 17 nt, Artificial Sequence
  Synthetic
ugcagacgaggaggagg

SEQ ID NO: 18455 - RNA, 17 nt, Artificial Sequence
  Synthetic
agacgaggaggaggagg

SEQ ID NO: 18456 - RNA, 17 nt, Artificial Sequence
  Synthetic
ggaggcggaggaggagg

SEQ ID NO: 18457 - RNA, 17 nt, Artificial Sequence
  Synthetic
ggaggaggcggaggagg

SEQ ID NO: 18458 - RNA, 17 nt, Artificial Sequence
  Synthetic
ggaggaggaggcggagg

SEQ ID NO: 18459 - RNA, 17 nt, Artificial Sequence
  Synthetic
gaggcgggcccggacgg

SEQ ID NO: 18460 - RNA, 17 nt, Artificial Sequence
  Synthetic
gcccgcgagggccccgg

SEQ ID NO: 18461 - RNA, 17 nt, Artificial Sequence
  Synthetic
ccgccgcgcgggcccgg

SEQ ID NO: 18462 - RNA, 17 nt, Artificial Sequence
  Synthetic
aggcggccgagcgccgg

SEQ ID NO: 18463 - RNA, 17 nt, Artificial Sequence
  Synthetic
ggcggggggcgcgccgg

SEQ ID NO: 18464 - RNA, 17 nt, Artificial Sequence
  Synthetic
ugucggcggggcgccgg

SEQ ID NO: 18465 - RNA, 17 nt, Artificial Sequence
  Synthetic
ggccccuuuggggccgg

SEQ ID NO: 18466 - RNA, 17 nt, Artificial Sequence
  Synthetic
gaccgggacggcagcgg

SEQ ID NO: 18467 - RNA, 17 nt, Artificial Sequence
  Synthetic
gcccgcggucgccgcgg

SEQ ID NO: 18468 - RNA, 17 nt, Artificial Sequence
  Synthetic
ccgccgggcccgcgcgg

SEQ ID NO: 18469 - RNA, 17 nt, Artificial Sequence
  Synthetic
gcacaccggcugcgcgg

SEQ ID NO: 18470 - RNA, 17 nt, Artificial Sequence
  Synthetic
ggacgacgaggaggcgg

SEQ ID NO: 18471 - RNA, 17 nt, Artificial Sequence
  Synthetic
cgaggaggaggaggcgg

SEQ ID NO: 18472 - RNA, 17 nt, Artificial Sequence
  Synthetic
ggcggaggaggaggcgg

SEQ ID NO: 18473 - RNA, 17 nt, Artificial Sequence
  Synthetic
cggccgagcgccggcgg

SEQ ID NO: 18474 - RNA, 17 nt, Artificial Sequence
  Synthetic
ggggggcgcgccggcgg

SEQ ID NO: 18475 - RNA, 17 nt, Artificial Sequence
  Synthetic
cccuuuggggccggcgg

SEQ ID NO: 18476 - RNA, 17 nt, Artificial Sequence
  Synthetic
ccgggcccgcgcggcgg

SEQ ID NO: 18477 - RNA, 17 nt, Artificial Sequence
  Synthetic
gggcgcgccggcggcgg

SEQ ID NO: 18478 - RNA, 17 nt, Artificial Sequence
  Synthetic
gucugcggcgcuggcgg

SEQ ID NO: 18479 - RNA, 17 nt, Artificial Sequence
  Synthetic
gugugccccuggugcgg

SEQ ID NO: 18480 - RNA, 17 nt, Artificial Sequence
  Synthetic
gguggugguggugucgg

SEQ ID NO: 18481 - RNA, 17 nt, Artificial Sequence
  Synthetic
aggcgggcccggacggg

SEQ ID NO: 18482 - RNA, 17 nt, Artificial Sequence
  Synthetic
gcagaccacgccgcggg

SEQ ID NO: 18483 - RNA, 17 nt, Artificial Sequence
  Synthetic
ccccguugguccgcggg

SEQ ID NO: 18484 - RNA, 17 nt, Artificial Sequence
  Synthetic
gcuggcgggggcgcggg

SEQ ID NO: 18485 - RNA, 17 nt, Artificial Sequence
  Synthetic
ggccgagcgccggcggg

SEQ ID NO: 18486 - RNA, 17 nt, Artificial Sequence
  Synthetic
ggggguccgggccgggg

SEQ ID NO: 18487 - RNA, 17 nt, Artificial Sequence
  Synthetic
ccgggcccgccucgggg

SEQ ID NO: 18488 - RNA, 17 nt, Artificial Sequence
  Synthetic
cuccgccccaaaggggg

SEQ ID NO: 18489 - RNA, 17 nt, Artificial Sequence
  Synthetic
cgcgagggccccggggg

SEQ ID NO: 18490 - RNA, 17 nt, Artificial Sequence
  Synthetic
cgggcccggacgggggg

SEQ ID NO: 18491 - RNA, 17 nt, Artificial Sequence
  Synthetic
ccccgcccccuuugggg

SEQ ID NO: 18492 - RNA, 17 nt, Artificial Sequence
  Synthetic
gcgggcucggcccuggg

SEQ ID NO: 18493 - RNA, 17 nt, Artificial Sequence
  Synthetic
guggucugcggcgcugg

SEQ ID NO: 18494 - RNA, 17 nt, Artificial Sequence
  Synthetic
cgcgccggcggcggugg

SEQ ID NO: 18495 - RNA, 17 nt, Artificial Sequence
  Synthetic
gccggcggcgguggugg

SEQ ID NO: 18496 - RNA, 17 nt, Artificial Sequence
  Synthetic
ggcggcggugguggugg

SEQ ID NO: 18497 - RNA, 17 nt, Artificial Sequence
  Synthetic
ggcgguggugguggugg

SEQ ID NO: 18498 - RNA, 17 nt, Artificial Sequence
  Synthetic
ggugguggugguggugg

SEQ ID NO: 18499 - RNA, 17 nt, Artificial Sequence
  Synthetic
gcgacaggcuggccaug

SEQ ID NO: 18500 - RNA, 17 nt, Artificial Sequence
  Synthetic
ucacuucuuuuacccug

SEQ ID NO: 18501 - RNA, 17 nt, Artificial Sequence
  Synthetic
gcccgcggcguggucug

SEQ ID NO: 18502 - RNA, 17 nt, Artificial Sequence
  Synthetic
ccggugugccccuggug

SEQ ID NO: 18503 - RNA, 17 nt, Artificial Sequence
  Synthetic
cggccccgcccccuuug

SEQ ID NO: 18504 - RNA, 17 nt, Artificial Sequence
  Synthetic
ccucgccggccccuuug

SEQ ID NO: 18505 - RNA, 17 nt, Artificial Sequence
  Synthetic
ggcgacaggcuggccau

SEQ ID NO: 18506 - RNA, 17 nt, Artificial Sequence
  Synthetic
gccgcgggcgggacccu

SEQ ID NO: 18507 - RNA, 17 nt, Artificial Sequence
  Synthetic
ggggcgggcucggcccu

SEQ ID NO: 18508 - RNA, 17 nt, Artificial Sequence
  Synthetic
cccguccgggcccgccu

SEQ ID NO: 18509 - RNA, 17 nt, Artificial Sequence
  Synthetic
ccgcgacgcgggccgcu

SEQ ID NO: 18510 - RNA, 17 nt, Artificial Sequence
  Synthetic
cgccccccgccggcgcu

SEQ ID NO: 18511 - RNA, 17 nt, Artificial Sequence
  Synthetic
ccgggccggggcgggcu

SEQ ID NO: 18512 - RNA, 17 nt, Artificial Sequence
  Synthetic
ucggcccugggcgggcu

SEQ ID NO: 18513 - RNA, 17 nt, Artificial Sequence
  Synthetic
cggcgaggucgccccgu

SEQ ID NO: 18514 - RNA, 17 nt, Artificial Sequence
  Synthetic
cggccccgcgcucccgu

SEQ ID NO: 18515 - RNA, 17 nt, Artificial Sequence
  Synthetic
auccggauccucgucgu

SEQ ID NO: 18516 - RNA, 17 nt, Artificial Sequence
  Synthetic
ggugguggugguggugu

SEQ ID NO: 18517 - RNA, 17 nt, Artificial Sequence
  Synthetic
auaauauauauacuauu

SEQ ID NO: 18518 - RNA, 17 nt, Artificial Sequence
  Synthetic
auaguauauauauuauu

SEQ ID NO: 18519 - RNA, 17 nt, Artificial Sequence
  Synthetic
ugcggccccgcccccuu

SEQ ID NO: 18520 - RNA, 17 nt, Artificial Sequence
  Synthetic
gaccucgccggccccuu

SEQ ID NO: 18521 - RNA, 17 nt, Artificial Sequence
  Synthetic
gcggccccgcccccuuu

SEQ ID NO: 18522 - RNA, 17 nt, Artificial Sequence
  Synthetic
accucgccggccccuuu

SEQ ID NO: 18523 - RNA, 20 nt, Artificial Sequence
  Synthetic
gcgggcggcuccgccccaaa

SEQ ID NO: 18524 - RNA, 20 nt, Artificial Sequence
  Synthetic
cccgcgggcuccgccccaaa

SEQ ID NO: 18525 - RNA, 20 nt, Artificial Sequence
  Synthetic
uggcccccgccggccccaaa

SEQ ID NO: 18526 - RNA, 20 nt, Artificial Sequence
  Synthetic
ccguuccucgcgcacauaaa

SEQ ID NO: 18527 - RNA, 20 nt, Artificial Sequence
  Synthetic
cggagccgcccgcggaccaa

SEQ ID NO: 18528 - RNA, 20 nt, Artificial Sequence
  Synthetic
cgcgggcggcuccgccccaa

SEQ ID NO: 18529 - RNA, 20 nt, Artificial Sequence
  Synthetic
ucccgcgggcuccgccccaa

SEQ ID NO: 18530 - RNA, 20 nt, Artificial Sequence
  Synthetic
uuggcccccgccggccccaa

SEQ ID NO: 18531 - RNA, 20 nt, Artificial Sequence
  Synthetic
uuggggccggcgggggccaa

SEQ ID NO: 18532 - RNA, 20 nt, Artificial Sequence
  Synthetic
cccuuuaugugcgcgaggaa

SEQ ID NO: 18533 - RNA, 20 nt, Artificial Sequence
  Synthetic
gccguuccucgcgcacauaa

SEQ ID NO: 18534 - RNA, 20 nt, Artificial Sequence
  Synthetic
ucccggucgccgccgcacca

SEQ ID NO: 18535 - RNA, 20 nt, Artificial Sequence
  Synthetic
cggggcguacccggacccca

SEQ ID NO: 18536 - RNA, 20 nt, Artificial Sequence
  Synthetic
gccccggccgagcccgccca

SEQ ID NO: 18537 - RNA, 20 nt, Artificial Sequence
  Synthetic
ucgcggcgacaggcuggcca

SEQ ID NO: 18538 - RNA, 20 nt, Artificial Sequence
  Synthetic
ccaaagggggcggggccgca

SEQ ID NO: 18539 - RNA, 20 nt, Artificial Sequence
  Synthetic
gaugacgcgggccccgggca

SEQ ID NO: 18540 - RNA, 20 nt, Artificial Sequence
  Synthetic
cuccucgucguccgcgccga

SEQ ID NO: 18541 - RNA, 20 nt, Artificial Sequence
  Synthetic
ggaggcgggggugcccgcga

SEQ ID NO: 18542 - RNA, 20 nt, Artificial Sequence
  Synthetic
cgccccgaggcgggcccgga

SEQ ID NO: 18543 - RNA, 20 nt, Artificial Sequence
  Synthetic
cugcgcggcggagaccggga

SEQ ID NO: 18544 - RNA, 20 nt, Artificial Sequence
  Synthetic
uaauaguauauauauuauua

SEQ ID NO: 18545 - RNA, 20 nt, Artificial Sequence
  Synthetic
ggagccgcccgcggaccaac

SEQ ID NO: 18546 - RNA, 20 nt, Artificial Sequence
  Synthetic
uggggccggcgggggccaac

SEQ ID NO: 18547 - RNA, 20 nt, Artificial Sequence
  Synthetic
ccgccgcaccaggggcacac

SEQ ID NO: 18548 - RNA, 20 nt, Artificial Sequence
  Synthetic
uuagggcaaagugcgagcac

SEQ ID NO: 18549 - RNA, 20 nt, Artificial Sequence
  Synthetic
accggcugcgcggcggagac

SEQ ID NO: 18550 - RNA, 20 nt, Artificial Sequence
  Synthetic
gcgccgggggucgcggcgac

SEQ ID NO: 18551 - RNA, 20 nt, Artificial Sequence
  Synthetic
gccccuggugcggcggcgac

SEQ ID NO: 18552 - RNA, 20 nt, Artificial Sequence
  Synthetic
gccccgaggcgggcccggac

SEQ ID NO: 18553 - RNA, 20 nt, Artificial Sequence
  Synthetic
gggccgcuggguccgcggac

SEQ ID NO: 18554 - RNA, 20 nt, Artificial Sequence
  Synthetic
gucccggucgccgccgcacc

SEQ ID NO: 18555 - RNA, 20 nt, Artificial Sequence
  Synthetic
ccggcugcgcggcggagacc

SEQ ID NO: 18556 - RNA, 20 nt, Artificial Sequence
  Synthetic
ccccuggugcggcggcgacc

SEQ ID NO: 18557 - RNA, 20 nt, Artificial Sequence
  Synthetic
cgcgguccgcggggcguacc

SEQ ID NO: 18558 - RNA, 20 nt, Artificial Sequence
  Synthetic
cagccugucgccgcgacccc

SEQ ID NO: 18559 - RNA, 20 nt, Artificial Sequence
  Synthetic
ucggccggggcgccgccccc

SEQ ID NO: 18560 - RNA, 20 nt, Artificial Sequence
  Synthetic
cucggccggggcgccgcccc

SEQ ID NO: 18561 - RNA, 20 nt, Artificial Sequence
  Synthetic
ggggugcccgcgagggcccc

SEQ ID NO: 18562 - RNA, 20 nt, Artificial Sequence
  Synthetic
cgcgggaugacgcgggcccc

SEQ ID NO: 18563 - RNA, 20 nt, Artificial Sequence
  Synthetic
ccgcgcagccggugugcccc

SEQ ID NO: 18564 - RNA, 20 nt, Artificial Sequence
  Synthetic
cgccccggccgagcccgccc

SEQ ID NO: 18565 - RNA, 20 nt, Artificial Sequence
  Synthetic
gcccagggccgagcccgccc

SEQ ID NO: 18566 - RNA, 20 nt, Artificial Sequence
  Synthetic
gggccccgggggcggcgccc

SEQ ID NO: 18567 - RNA, 20 nt, Artificial Sequence
  Synthetic
ggccggggcgggcucggccc

SEQ ID NO: 18568 - RNA, 20 nt, Artificial Sequence
  Synthetic
gggggugcccgcgagggccc

SEQ ID NO: 18569 - RNA, 20 nt, Artificial Sequence
  Synthetic
ccgcgggaugacgcgggccc

SEQ ID NO: 18570 - RNA, 20 nt, Artificial Sequence
  Synthetic
cgagcacuggcgcccugccc

SEQ ID NO: 18571 - RNA, 20 nt, Artificial Sequence
  Synthetic
cgagcgcuggcgcccugccc

SEQ ID NO: 18572 - RNA, 20 nt, Artificial Sequence
  Synthetic
gggccgccuggagcgccgcc

SEQ ID NO: 18573 - RNA, 20 nt, Artificial Sequence
  Synthetic
cgcggcgaccgcgggccgcc

SEQ ID NO: 18574 - RNA, 20 nt, Artificial Sequence
  Synthetic
gguggugucggcggggcgcc

SEQ ID NO: 18575 - RNA, 20 nt, Artificial Sequence
  Synthetic
gggccgagcccgccccggcc

SEQ ID NO: 18576 - RNA, 20 nt, Artificial Sequence
  Synthetic
ggcccugggcgggcucggcc

SEQ ID NO: 18577 - RNA, 20 nt, Artificial Sequence
  Synthetic
ucgccgcggggguccgggcc

SEQ ID NO: 18578 - RNA, 20 nt, Artificial Sequence
  Synthetic
cggccaccgccgcgcgggcc

SEQ ID NO: 18579 - RNA, 20 nt, Artificial Sequence
  Synthetic
gcuccgccccgaggcgggcc

SEQ ID NO: 18580 - RNA, 20 nt, Artificial Sequence
  Synthetic
gcgagcacuggcgcccugcc

SEQ ID NO: 18581 - RNA, 20 nt, Artificial Sequence
  Synthetic
gcgagcgcuggcgcccugcc

SEQ ID NO: 18582 - RNA, 20 nt, Artificial Sequence
  Synthetic
cgcgggcccggcggcgcucc

SEQ ID NO: 18583 - RNA, 20 nt, Artificial Sequence
  Synthetic
gaacggcccgccccccgucc

SEQ ID NO: 18584 - RNA, 20 nt, Artificial Sequence
  Synthetic
cacauaaagggccggcgucc

SEQ ID NO: 18585 - RNA, 20 nt, Artificial Sequence
  Synthetic
cgcggucgccgcgggggucc

SEQ ID NO: 18586 - RNA, 20 nt, Artificial Sequence
  Synthetic
acaggcuggccauggggucc

SEQ ID NO: 18587 - RNA, 20 nt, Artificial Sequence
  Synthetic
cccggucuccgccgcgcagc

SEQ ID NO: 18588 - RNA, 20 nt, Artificial Sequence
  Synthetic
gaugacgacgaccgcgacgc

SEQ ID NO: 18589 - RNA, 20 nt, Artificial Sequence
  Synthetic
ugcggcggcgaccgggacgc

SEQ ID NO: 18590 - RNA, 20 nt, Artificial Sequence
  Synthetic
cggagcccgcgggaugacgc

SEQ ID NO: 18591 - RNA, 20 nt, Artificial Sequence
  Synthetic
cggacccccgcggcgaccgc

SEQ ID NO: 18592 - RNA, 20 nt, Artificial Sequence
  Synthetic
gccgccggcgcgccccccgc

SEQ ID NO: 18593 - RNA, 20 nt, Artificial Sequence
  Synthetic
gcgcucccguuggcccccgc

SEQ ID NO: 18594 - RNA, 20 nt, Artificial Sequence
  Synthetic
cgccucggggcggagcccgc

SEQ ID NO: 18595 - RNA, 20 nt, Artificial Sequence
  Synthetic
cccuuuggggcggagcccgc

SEQ ID NO: 18596 - RNA, 20 nt, Artificial Sequence
  Synthetic
cggggcccgcgucaucccgc

SEQ ID NO: 18597 - RNA, 20 nt, Artificial Sequence
  Synthetic
agcgccgcagaccacgccgc

SEQ ID NO: 18598 - RNA, 20 nt, Artificial Sequence
  Synthetic
accaccaccaccaccgccgc

SEQ ID NO: 18599 - RNA, 20 nt, Artificial Sequence
  Synthetic
cgggccgccuggagcgccgc

SEQ ID NO: 18600 - RNA, 20 nt, Artificial Sequence
  Synthetic
aggcggcccgcggucgccgc

SEQ ID NO: 18601 - RNA, 20 nt, Artificial Sequence
  Synthetic
acgaccgcgacgcgggccgc

SEQ ID NO: 18602 - RNA, 20 nt, Artificial Sequence
  Synthetic
cccaaagggggcggggccgc

SEQ ID NO: 18603 - RNA, 20 nt, Artificial Sequence
  Synthetic
agacgacguccgcgguccgc

SEQ ID NO: 18604 - RNA, 20 nt, Artificial Sequence
  Synthetic
aggucgccccguugguccgc

SEQ ID NO: 18605 - RNA, 20 nt, Artificial Sequence
  Synthetic
agucagaggcggccgagcgc

SEQ ID NO: 18606 - RNA, 20 nt, Artificial Sequence
  Synthetic
uuagggcaaagugcgagcgc

SEQ ID NO: 18607 - RNA, 20 nt, Artificial Sequence
  Synthetic
gcgggggccaacgggagcgc

SEQ ID NO: 18608 - RNA, 20 nt, Artificial Sequence
  Synthetic
agcgccggcggggggcgcgc

SEQ ID NO: 18609 - RNA, 20 nt, Artificial Sequence
  Synthetic
cgcggcguggucugcggcgc

SEQ ID NO: 18610 - RNA, 20 nt, Artificial Sequence
  Synthetic
ugguggugucggcggggcgc

SEQ ID NO: 18611 - RNA, 20 nt, Artificial Sequence
  Synthetic
ugcggcgcuggcgggggcgc

SEQ ID NO: 18612 - RNA, 20 nt, Artificial Sequence
  Synthetic
gaccaacggggcgaccucgc

SEQ ID NO: 18613 - RNA, 20 nt, Artificial Sequence
  Synthetic
gccgcccccggggcccucgc

SEQ ID NO: 18614 - RNA, 20 nt, Artificial Sequence
  Synthetic
cgggggucgcggcgacaggc

SEQ ID NO: 18615 - RNA, 20 nt, Artificial Sequence
  Synthetic
cgcgggcuccgccccgaggc

SEQ ID NO: 18616 - RNA, 20 nt, Artificial Sequence
  Synthetic
ggcgcggacgacgaggaggc

SEQ ID NO: 18617 - RNA, 20 nt, Artificial Sequence
  Synthetic
agaggcggccgagcgccggc

SEQ ID NO: 18618 - RNA, 20 nt, Artificial Sequence
  Synthetic
ccggccccuuuggggccggc

SEQ ID NO: 18619 - RNA, 20 nt, Artificial Sequence
  Synthetic
cggcccugggcgggcucggc

SEQ ID NO: 18620 - RNA, 20 nt, Artificial Sequence
  Synthetic
gugguggugguggugucggc

SEQ ID NO: 18621 - RNA, 20 nt, Artificial Sequence
  Synthetic
uccucgcgcacauaaagggc

SEQ ID NO: 18622 - RNA, 20 nt, Artificial Sequence
  Synthetic
ggaugacgcgggccccgggc

SEQ ID NO: 18623 - RNA, 20 nt, Artificial Sequence
  Synthetic
gucgccgcggggguccgggc

SEQ ID NO: 18624 - RNA, 20 nt, Artificial Sequence
  Synthetic
ccgcagaccacgccgcgggc

SEQ ID NO: 18625 - RNA, 20 nt, Artificial Sequence
  Synthetic
cccgccggccccaaaggggc

SEQ ID NO: 18626 - RNA, 20 nt, Artificial Sequence
  Synthetic
gcggggguccgggccggggc

SEQ ID NO: 18627 - RNA, 20 nt, Artificial Sequence
  Synthetic
ggccaacgggagcgcggggc

SEQ ID NO: 18628 - RNA, 20 nt, Artificial Sequence
  Synthetic
ggcuccgccccaaagggggc

SEQ ID NO: 18629 - RNA, 20 nt, Artificial Sequence
  Synthetic
ggcgggcccggacggggggc

SEQ ID NO: 18630 - RNA, 20 nt, Artificial Sequence
  Synthetic
cucgccggccccuuuggggc

SEQ ID NO: 18631 - RNA, 20 nt, Artificial Sequence
  Synthetic
gggcgggcucggcccugggc

SEQ ID NO: 18632 - RNA, 20 nt, Artificial Sequence
  Synthetic
gcguggucugcggcgcuggc

SEQ ID NO: 18633 - RNA, 20 nt, Artificial Sequence
  Synthetic
cgggcccgcgcggcgguggc

SEQ ID NO: 18634 - RNA, 20 nt, Artificial Sequence
  Synthetic
gccucugacucaucaaaauc

SEQ ID NO: 18635 - RNA, 20 nt, Artificial Sequence
  Synthetic
ggacgccgacgacgaggauc

SEQ ID NO: 18636 - RNA, 20 nt, Artificial Sequence
  Synthetic
cccccguccgggcccgccuc

SEQ ID NO: 18637 - RNA, 20 nt, Artificial Sequence
  Synthetic
cggaccgcggacgucgucuc

SEQ ID NO: 18638 - RNA, 20 nt, Artificial Sequence
  Synthetic
ggaacggcccgccccccguc

SEQ ID NO: 18639 - RNA, 20 nt, Artificial Sequence
  Synthetic
ccgcggucgccgcggggguc

SEQ ID NO: 18640 - RNA, 20 nt, Artificial Sequence
  Synthetic
gacaggcuggccaugggguc

SEQ ID NO: 18641 - RNA, 20 nt, Artificial Sequence
  Synthetic
cgggcggcuccgccccaaag

SEQ ID NO: 18642 - RNA, 20 nt, Artificial Sequence
  Synthetic
ccgcgggcuccgccccaaag

SEQ ID NO: 18643 - RNA, 20 nt, Artificial Sequence
  Synthetic
ggcccccgccggccccaaag

SEQ ID NO: 18644 - RNA, 20 nt, Artificial Sequence
  Synthetic
cccggucgccgccgcaccag

SEQ ID NO: 18645 - RNA, 20 nt, Artificial Sequence
  Synthetic
ucuccgguccgcggacccag

SEQ ID NO: 18646 - RNA, 20 nt, Artificial Sequence
  Synthetic
ggcggagaccgggacggcag

SEQ ID NO: 18647 - RNA, 20 nt, Artificial Sequence
  Synthetic
uccggauuuugaugagucag

SEQ ID NO: 18648 - RNA, 20 nt, Artificial Sequence
  Synthetic
gagccgcccgcggaccaacg

SEQ ID NO: 18649 - RNA, 20 nt, Artificial Sequence
  Synthetic
cgaggaggcggaugcagacg

SEQ ID NO: 18650 - RNA, 20 nt, Artificial Sequence
  Synthetic
gucgucgucgucgucagacg

SEQ ID NO: 18651 - RNA, 20 nt, Artificial Sequence
  Synthetic
ggcggaggacgccgacgacg

SEQ ID NO: 18652 - RNA, 20 nt, Artificial Sequence
  Synthetic
gacccucggcgcggacgacg

SEQ ID NO: 18653 - RNA, 20 nt, Artificial Sequence
  Synthetic
cgaugacgacgaccgcgacg

SEQ ID NO: 18654 - RNA, 20 nt, Artificial Sequence
  Synthetic
ccccgaggcgggcccggacg

SEQ ID NO: 18655 - RNA, 20 nt, Artificial Sequence
  Synthetic
gcggagcccgcgggaugacg

SEQ ID NO: 18656 - RNA, 20 nt, Artificial Sequence
  Synthetic
ccggacccccgcggcgaccg

SEQ ID NO: 18657 - RNA, 20 nt, Artificial Sequence
  Synthetic
cggguacgccccgcggaccg

SEQ ID NO: 18658 - RNA, 20 nt, Artificial Sequence
  Synthetic
cgccccggcccggacccccg

SEQ ID NO: 18659 - RNA, 20 nt, Artificial Sequence
  Synthetic
cggccggggcgccgcccccg

SEQ ID NO: 18660 - RNA, 20 nt, Artificial Sequence
  Synthetic
ugggguccggguacgccccg

SEQ ID NO: 18661 - RNA, 20 nt, Artificial Sequence
  Synthetic
aucccgcgggcuccgccccg

SEQ ID NO: 18662 - RNA, 20 nt, Artificial Sequence
  Synthetic
gggugcccgcgagggccccg

SEQ ID NO: 18663 - RNA, 20 nt, Artificial Sequence
  Synthetic
ccgccucggggcggagcccg

SEQ ID NO: 18664 - RNA, 20 nt, Artificial Sequence
  Synthetic
ccccuuuggggcggagcccg

SEQ ID NO: 18665 - RNA, 20 nt, Artificial Sequence
  Synthetic
cgcgccgagggucccgcccg

SEQ ID NO: 18666 - RNA, 20 nt, Artificial Sequence
  Synthetic
cuuuggggcggagccgcccg

SEQ ID NO: 18667 - RNA, 20 nt, Artificial Sequence
  Synthetic
gcggcgcuccaggcggcccg

SEQ ID NO: 18668 - RNA, 20 nt, Artificial Sequence
  Synthetic
gagcacuggcgcccugcccg

SEQ ID NO: 18669 - RNA, 20 nt, Artificial Sequence
  Synthetic
gagcgcuggcgcccugcccg

SEQ ID NO: 18670 - RNA, 20 nt, Artificial Sequence
  Synthetic
ccggggcccgcgucaucccg

SEQ ID NO: 18671 - RNA, 20 nt, Artificial Sequence
  Synthetic
cagcgccgcagaccacgccg

SEQ ID NO: 18672 - RNA, 20 nt, Artificial Sequence
  Synthetic
ccuccucgucguccgcgccg

SEQ ID NO: 18673 - RNA, 20 nt, Artificial Sequence
  Synthetic
guggugucggcggggcgccg

SEQ ID NO: 18674 - RNA, 20 nt, Artificial Sequence
  Synthetic
caggcggcccgcggucgccg

SEQ ID NO: 18675 - RNA, 20 nt, Artificial Sequence
  Synthetic
gcccugggcgggcucggccg

SEQ ID NO: 18676 - RNA, 20 nt, Artificial Sequence
  Synthetic
cgccgcggggguccgggccg

SEQ ID NO: 18677 - RNA, 20 nt, Artificial Sequence
  Synthetic
cggaccggagacgacguccg

SEQ ID NO: 18678 - RNA, 20 nt, Artificial Sequence
  Synthetic
cggacgucgucuccgguccg

SEQ ID NO: 18679 - RNA, 20 nt, Artificial Sequence
  Synthetic
gagacgacguccgcgguccg

SEQ ID NO: 18680 - RNA, 20 nt, Artificial Sequence
  Synthetic
gacgcgggccgcuggguccg

SEQ ID NO: 18681 - RNA, 20 nt, Artificial Sequence
  Synthetic
gaggucgccccguugguccg

SEQ ID NO: 18682 - RNA, 20 nt, Artificial Sequence
  Synthetic
ggcgggggccaacgggagcg

SEQ ID NO: 18683 - RNA, 20 nt, Artificial Sequence
  Synthetic
ggagcgccgccgggcccgcg

SEQ ID NO: 18684 - RNA, 20 nt, Artificial Sequence
  Synthetic
aggaggcgggggugcccgcg

SEQ ID NO: 18685 - RNA, 20 nt, Artificial Sequence
  Synthetic
ggcggcccgcggucgccgcg

SEQ ID NO: 18686 - RNA, 20 nt, Artificial Sequence
  Synthetic
gacgacguccgcgguccgcg

SEQ ID NO: 18687 - RNA, 20 nt, Artificial Sequence
  Synthetic
cgggggccaacgggagcgcg

SEQ ID NO: 18688 - RNA, 20 nt, Artificial Sequence
  Synthetic
gccggcccuuuaugugcgcg

SEQ ID NO: 18689 - RNA, 20 nt, Artificial Sequence
  Synthetic
gcgcggacgacgaggaggcg

SEQ ID NO: 18690 - RNA, 20 nt, Artificial Sequence
  Synthetic
gaggcggccgagcgccggcg

SEQ ID NO: 18691 - RNA, 20 nt, Artificial Sequence
  Synthetic
cggccccaaaggggccggcg

SEQ ID NO: 18692 - RNA, 20 nt, Artificial Sequence
  Synthetic
cggccccuuuggggccggcg

SEQ ID NO: 18693 - RNA, 20 nt, Artificial Sequence
  Synthetic
cgagggucccgcccgcggcg

SEQ ID NO: 18694 - RNA, 20 nt, Artificial Sequence
  Synthetic
cgcgggcgggacccucggcg

SEQ ID NO: 18695 - RNA, 20 nt, Artificial Sequence
  Synthetic
ugguggugguggugucggcg

SEQ ID NO: 18696 - RNA, 20 nt, Artificial Sequence
  Synthetic
gcuccgccccaaagggggcg

SEQ ID NO: 18697 - RNA, 20 nt, Artificial Sequence
  Synthetic
cugcggcgcuggcgggggcg

SEQ ID NO: 18698 - RNA, 20 nt, Artificial Sequence
  Synthetic
cguggucugcggcgcuggcg

SEQ ID NO: 18699 - RNA, 20 nt, Artificial Sequence
  Synthetic
ccaggggcacaccggcugcg

SEQ ID NO: 18700 - RNA, 20 nt, Artificial Sequence
  Synthetic
cgccgcccccggggcccucg

SEQ ID NO: 18701 - RNA, 20 nt, Artificial Sequence
  Synthetic
ccccguccgggcccgccucg

SEQ ID NO: 18702 - RNA, 20 nt, Artificial Sequence
  Synthetic
ggacccagcggcccgcgucg

SEQ ID NO: 18703 - RNA, 20 nt, Artificial Sequence
  Synthetic
cggcggggcgccgggggucg

SEQ ID NO: 18704 - RNA, 20 nt, Artificial Sequence
  Synthetic
gggcggcuccgccccaaagg

SEQ ID NO: 18705 - RNA, 20 nt, Artificial Sequence
  Synthetic
cgcgggcuccgccccaaagg

SEQ ID NO: 18706 - RNA, 20 nt, Artificial Sequence
  Synthetic
gggcccggcggcgcuccagg

SEQ ID NO: 18707 - RNA, 20 nt, Artificial Sequence
  Synthetic
ggauuuugaugagucagagg

SEQ ID NO: 18708 - RNA, 20 nt, Artificial Sequence
  Synthetic
ggaggcggaugcagacgagg

SEQ ID NO: 18709 - RNA, 20 nt, Artificial Sequence
  Synthetic
gucgucgucgucagacgagg

SEQ ID NO: 18710 - RNA, 20 nt, Artificial Sequence
  Synthetic
ccucggcgcggacgacgagg

SEQ ID NO: 18711 - RNA, 20 nt, Artificial Sequence
  Synthetic
ccgcgggcuccgccccgagg

SEQ ID NO: 18712 - RNA, 20 nt, Artificial Sequence
  Synthetic
ggcggaugcagacgaggagg

SEQ ID NO: 18713 - RNA, 20 nt, Artificial Sequence
  Synthetic
gucgucgucagacgaggagg

SEQ ID NO: 18714 - RNA, 20 nt, Artificial Sequence
  Synthetic
cggcgcggacgacgaggagg

SEQ ID NO: 18715 - RNA, 20 nt, Artificial Sequence
  Synthetic
ggaugcagacgaggaggagg

SEQ ID NO: 18716 - RNA, 20 nt, Artificial Sequence
  Synthetic
ugcagacgaggaggaggagg

SEQ ID NO: 18717 - RNA, 20 nt, Artificial Sequence
  Synthetic
ggaggaggcggaggaggagg

SEQ ID NO: 18718 - RNA, 20 nt, Artificial Sequence
  Synthetic
ggaggaggaggcggaggagg

SEQ ID NO: 18719 - RNA, 20 nt, Artificial Sequence
  Synthetic
cgaggaggaggaggcggagg

SEQ ID NO: 18720 - RNA, 20 nt, Artificial Sequence
  Synthetic
cccgaggcgggcccggacgg

SEQ ID NO: 18721 - RNA, 20 nt, Artificial Sequence
  Synthetic
ggugcccgcgagggccccgg

SEQ ID NO: 18722 - RNA, 20 nt, Artificial Sequence
  Synthetic
ccaccgccgcgcgggcccgg

SEQ ID NO: 18723 - RNA, 20 nt, Artificial Sequence
  Synthetic
cagaggcggccgagcgccgg

SEQ ID NO: 18724 - RNA, 20 nt, Artificial Sequence
  Synthetic
gccggcggggggcgcgccgg

SEQ ID NO: 18725 - RNA, 20 nt, Artificial Sequence
  Synthetic
uggugucggcggggcgccgg

SEQ ID NO: 18726 - RNA, 20 nt, Artificial Sequence
  Synthetic
gccggccccuuuggggccgg

SEQ ID NO: 18727 - RNA, 20 nt, Artificial Sequence
  Synthetic
ggagaccgggacggcagcgg

SEQ ID NO: 18728 - RNA, 20 nt, Artificial Sequence
  Synthetic
gcggcccgcggucgccgcgg

SEQ ID NO: 18729 - RNA, 20 nt, Artificial Sequence
  Synthetic
gcgccgccgggcccgcgcgg

SEQ ID NO: 18730 - RNA, 20 nt, Artificial Sequence
  Synthetic
ggggcacaccggcugcgcgg

SEQ ID NO: 18731 - RNA, 20 nt, Artificial Sequence
  Synthetic
cgcggacgacgaggaggcgg

SEQ ID NO: 18732 - RNA, 20 nt, Artificial Sequence
  Synthetic
agacgaggaggaggaggcgg

SEQ ID NO: 18733 - RNA, 20 nt, Artificial Sequence
  Synthetic
ggaggcggaggaggaggcgg

SEQ ID NO: 18734 - RNA, 20 nt, Artificial Sequence
  Synthetic
aggcggccgagcgccggcgg

SEQ ID NO: 18735 - RNA, 20 nt, Artificial Sequence
  Synthetic
ggcggggggcgcgccggcgg

SEQ ID NO: 18736 - RNA, 20 nt, Artificial Sequence
  Synthetic
ggccccuuuggggccggcgg

SEQ ID NO: 18737 - RNA, 20 nt, Artificial Sequence
  Synthetic
ccgccgggcccgcgcggcgg

SEQ ID NO: 18738 - RNA, 20 nt, Artificial Sequence
  Synthetic
ggggggcgcgccggcggcgg

SEQ ID NO: 18739 - RNA, 20 nt, Artificial Sequence
  Synthetic
guggucugcggcgcuggcgg

SEQ ID NO: 18740 - RNA, 20 nt, Artificial Sequence
  Synthetic
ccggugugccccuggugcgg

SEQ ID NO: 18741 - RNA, 20 nt, Artificial Sequence
  Synthetic
ggugguggugguggugucgg

SEQ ID NO: 18742 - RNA, 20 nt, Artificial Sequence
  Synthetic
ccgaggcgggcccggacggg

SEQ ID NO: 18743 - RNA, 20 nt, Artificial Sequence
  Synthetic
gccgcagaccacgccgcggg

SEQ ID NO: 18744 - RNA, 20 nt, Artificial Sequence
  Synthetic
ucgccccguugguccgcggg

SEQ ID NO: 18745 - RNA, 20 nt, Artificial Sequence
  Synthetic
ggcgcuggcgggggcgcggg

SEQ ID NO: 18746 - RNA, 20 nt, Artificial Sequence
  Synthetic
ggcggccgagcgccggcggg

SEQ ID NO: 18747 - RNA, 20 nt, Artificial Sequence
  Synthetic
cgcggggguccgggccgggg

SEQ ID NO: 18748 - RNA, 20 nt, Artificial Sequence
  Synthetic
cguccgggcccgccucgggg

SEQ ID NO: 18749 - RNA, 20 nt, Artificial Sequence
  Synthetic
cggcuccgccccaaaggggg

SEQ ID NO: 18750 - RNA, 20 nt, Artificial Sequence
  Synthetic
gggcuccgccccaaaggggg

SEQ ID NO: 18751 - RNA, 20 nt, Artificial Sequence
  Synthetic
gcccgcgagggccccggggg

SEQ ID NO: 18752 - RNA, 20 nt, Artificial Sequence
  Synthetic
aggcgggcccggacgggggg

SEQ ID NO: 18753 - RNA, 20 nt, Artificial Sequence
  Synthetic
cggccccgcccccuuugggg

SEQ ID NO: 18754 - RNA, 20 nt, Artificial Sequence
  Synthetic
ggggcgggcucggcccuggg

SEQ ID NO: 18755 - RNA, 20 nt, Artificial Sequence
  Synthetic
ggcguggucugcggcgcugg

SEQ ID NO: 18756 - RNA, 20 nt, Artificial Sequence
  Synthetic
gggcgcgccggcggcggugg

SEQ ID NO: 18757 - RNA, 20 nt, Artificial Sequence
  Synthetic
cgcgccggcggcgguggugg

SEQ ID NO: 18758 - RNA, 20 nt, Artificial Sequence
  Synthetic
gccggcggcggugguggugg

SEQ ID NO: 18759 - RNA, 20 nt, Artificial Sequence
  Synthetic
ggcggcgguggugguggugg

SEQ ID NO: 18760 - RNA, 20 nt, Artificial Sequence
  Synthetic
ggcggugguggugguggugg

SEQ ID NO: 18761 - RNA, 20 nt, Artificial Sequence
  Synthetic
gcggcgacaggcuggccaug

SEQ ID NO: 18762 - RNA, 20 nt, Artificial Sequence
  Synthetic
uucucacuucuuuuacccug

SEQ ID NO: 18763 - RNA, 20 nt, Artificial Sequence
  Synthetic
cccgcccgcggcguggucug

SEQ ID NO: 18764 - RNA, 20 nt, Artificial Sequence
  Synthetic
cagccggugugccccuggug

SEQ ID NO: 18765 - RNA, 20 nt, Artificial Sequence
  Synthetic
cugcggccccgcccccuuug

SEQ ID NO: 18766 - RNA, 20 nt, Artificial Sequence
  Synthetic
cgaccucgccggccccuuug

SEQ ID NO: 18767 - RNA, 20 nt, Artificial Sequence
  Synthetic
cgcggcgacaggcuggccau

SEQ ID NO: 18768 - RNA, 20 nt, Artificial Sequence
  Synthetic
cacgccgcgggcgggacccu

SEQ ID NO: 18769 - RNA, 20 nt, Artificial Sequence
  Synthetic
gccggggcgggcucggcccu

SEQ ID NO: 18770 - RNA, 20 nt, Artificial Sequence
  Synthetic
ccccccguccgggcccgccu

SEQ ID NO: 18771 - RNA, 20 nt, Artificial Sequence
  Synthetic
cgaccgcgacgcgggccgcu

SEQ ID NO: 18772 - RNA, 20 nt, Artificial Sequence
  Synthetic
gcgcgccccccgccggcgcu

SEQ ID NO: 18773 - RNA, 20 nt, Artificial Sequence
  Synthetic
gguccgggccggggcgggcu

SEQ ID NO: 18774 - RNA, 20 nt, Artificial Sequence
  Synthetic
ggcucggcccugggcgggcu

SEQ ID NO: 18775 - RNA, 20 nt, Artificial Sequence
  Synthetic
ggccggcgaggucgccccgu

SEQ ID NO: 18776 - RNA, 20 nt, Artificial Sequence
  Synthetic
ugccggccccgcgcucccgu

SEQ ID NO: 18777 - RNA, 20 nt, Artificial Sequence
  Synthetic
aaaauccggauccucgucgu

SEQ ID NO: 18778 - RNA, 20 nt, Artificial Sequence
  Synthetic
gguggugguggugguggugu

SEQ ID NO: 18779 - RNA, 20 nt, Artificial Sequence
  Synthetic
cuaauaauauauauacuauu

SEQ ID NO: 18780 - RNA, 20 nt, Artificial Sequence
  Synthetic
cuaauaguauauauauuauu

SEQ ID NO: 18781 - RNA, 20 nt, Artificial Sequence
  Synthetic
cccugcggccccgcccccuu

SEQ ID NO: 18782 - RNA, 20 nt, Artificial Sequence
  Synthetic
ggcgaccucgccggccccuu

SEQ ID NO: 18783 - RNA, 20 nt, Artificial Sequence
  Synthetic
ccugcggccccgcccccuuu

SEQ ID NO: 18784 - RNA, 20 nt, Artificial Sequence
  Synthetic
gcgaccucgccggccccuuu

SEQ ID NO: 18785 - RNA, 23 nt, Artificial Sequence
  Synthetic
gucuuuucgccucuccgcgccga

SEQ ID NO: 18786 - RNA, 21 nt, Artificial Sequence
  Synthetic
gucgcgcuccggggggggcga

SEQ ID NO: 18787 - RNA, 24 nt, Artificial Sequence
  Synthetic
gccgucgcgcuccggggggggcga

SEQ ID NO: 18788 - RNA, 21 nt, Artificial Sequence
  Synthetic
gccauaaucggcgcgcaugga

SEQ ID NO: 18789 - RNA, 23 nt, Artificial Sequence
  Synthetic
gacgccgccgcgccccggcucgc

SEQ ID NO: 18790 - RNA, 19 nt, Artificial Sequence
  Synthetic
gugggcggcgguccgucgg

SEQ ID NO: 18791 - RNA, 20 nt, Artificial Sequence
  Synthetic
ggugggcggcgguccgucgg

SEQ ID NO: 18792 - RNA, 21 nt, Artificial Sequence
  Synthetic
gggugggcggcgguccgucgg

SEQ ID NO: 18793 - RNA, 22 nt, Artificial Sequence
  Synthetic
ggggugggcggcgguccgucgg

SEQ ID NO: 18794 - RNA, 23 nt, Artificial Sequence
  Synthetic
gccuccgaccggggugugcgggg

SEQ ID NO: 18795 - RNA, 21 nt, Artificial Sequence
  Synthetic
gccgcgcggcggggcgacggu

SEQ ID NO: 18796 - RNA, 22 nt, Artificial Sequence
  Synthetic
ggccgcgcggcggggcgacggu

SEQ ID NO: 18797 - RNA, 23 nt, Artificial Sequence
  Synthetic
gggccgcgcggcggggcgacggu

SEQ ID NO: 18798 - RNA, 18 nt, Artificial Sequence
  Synthetic
ggggcgacgguccggguu

SEQ ID NO: 18799 - RNA, 20 nt, Artificial Sequence
  Synthetic
gcggggcgacgguccggguu

SEQ ID NO: 18800 - RNA, 21 nt, Artificial Sequence
  Synthetic
ggcggggcgacgguccggguu

SEQ ID NO: 18801 - RNA, 23 nt, Artificial Sequence
  Synthetic
gcggcggggcgacgguccggguu

SEQ ID NO: 18802 - RNA, 21 nt, Artificial Sequence
  Synthetic
gggagcgagcccgcccgcgac

SEQ ID NO: 18803 - RNA, 22 nt, Artificial Sequence
  Synthetic
ggggagcgagcccgcccgcgac

SEQ ID NO: 18804 - RNA, 19 nt, Artificial Sequence
  Synthetic
gcggagacgaccggcggcc

SEQ ID NO: 18805 - RNA, 20 nt, Artificial Sequence
  Synthetic
ggcggagacgaccggcggcc

SEQ ID NO: 18806 - RNA, 22 nt, Artificial Sequence
  Synthetic
gcggcggagacgaccggcggcc

SEQ ID NO: 18807 - RNA, 22 nt, Artificial Sequence
  Synthetic
gcgcggcuaccgacgcggccgc

SEQ ID NO: 18808 - RNA, 24 nt, Artificial Sequence
  Synthetic
gagcgcggcuaccgacgcggccgc

SEQ ID NO: 18809 - RNA, 18 nt, Artificial Sequence
  Synthetic
gucgccccgccgcgcggc

SEQ ID NO: 18810 - RNA, 22 nt, Artificial Sequence
  Synthetic
gaccgucgccccgccgcgcggc

SEQ ID NO: 18811 - RNA, 23 nt, Artificial Sequence
  Synthetic
ggaccgucgccccgccgcgcggc

SEQ ID NO: 18812 - RNA, 19 nt, Artificial Sequence
  Synthetic
gaccggcggccccggaucu

SEQ ID NO: 18813 - RNA, 22 nt, Artificial Sequence
  Synthetic
gacgaccggcggccccggaucu

SEQ ID NO: 18814 - RNA, 24 nt, Artificial Sequence
  Synthetic
gagacgaccggcggccccggaucu

SEQ ID NO: 18815 - RNA, 21 nt, Artificial Sequence
  Synthetic
gccccgccgcgcggcccgggu

SEQ ID NO: 18816 - RNA, 24 nt, Artificial Sequence
  Synthetic
gucgccccgccgcgcggcccgggu

SEQ ID NO: 18817 - RNA, 18 nt, Artificial Sequence
  Synthetic
uucgccucuccgcgccga

SEQ ID NO: 18818 - RNA, 19 nt, Artificial Sequence
  Synthetic
uuucgccucuccgcgccga

SEQ ID NO: 18819 - RNA, 20 nt, Artificial Sequence
  Synthetic
uuuucgccucuccgcgccga

SEQ ID NO: 18820 - RNA, 21 nt, Artificial Sequence
  Synthetic
cuuuucgccucuccgcgccga

SEQ ID NO: 18821 - RNA, 22 nt, Artificial Sequence
  Synthetic
ucuuuucgccucuccgcgccga

SEQ ID NO: 18822 - RNA, 24 nt, Artificial Sequence
  Synthetic
ugucuuuucgccucuccgcgccga

SEQ ID NO: 18823 - RNA, 22 nt, Artificial Sequence
  Synthetic
cgucgcgcuccggggggggcga

SEQ ID NO: 18824 - RNA, 23 nt, Artificial Sequence
  Synthetic
ccgucgcgcuccggggggggcga

SEQ ID NO: 18825 - RNA, 18 nt, Artificial Sequence
  Synthetic
auaaucggcgcgcaugga

SEQ ID NO: 18826 - RNA, 19 nt, Artificial Sequence
  Synthetic
cauaaucggcgcgcaugga

SEQ ID NO: 18827 - RNA, 20 nt, Artificial Sequence
  Synthetic
ccauaaucggcgcgcaugga

SEQ ID NO: 18828 - RNA, 22 nt, Artificial Sequence
  Synthetic
cgccauaaucggcgcgcaugga

SEQ ID NO: 18829 - RNA, 23 nt, Artificial Sequence
  Synthetic
ucgccauaaucggcgcgcaugga

SEQ ID NO: 18830 - RNA, 24 nt, Artificial Sequence
  Synthetic
cucgccauaaucggcgcgcaugga

SEQ ID NO: 18831 - RNA, 21 nt, Artificial Sequence
  Synthetic
cgccgccgcgccccggcucgc

SEQ ID NO: 18832 - RNA, 22 nt, Artificial Sequence
  Synthetic
acgccgccgcgccccggcucgc

SEQ ID NO: 18833 - RNA, 24 nt, Artificial Sequence
  Synthetic
cgacgccgccgcgccccggcucgc

SEQ ID NO: 18834 - RNA, 18 nt, Artificial Sequence
  Synthetic
ugggcggcgguccgucgg

SEQ ID NO: 18835 - RNA, 23 nt, Artificial Sequence
  Synthetic
cggggugggcggcgguccgucgg

SEQ ID NO: 18836 - RNA, 24 nt, Artificial Sequence
  Synthetic
ucggggugggcggcgguccgucgg

SEQ ID NO: 18837 - RNA, 18 nt, Artificial Sequence
  Synthetic
cgaccggggugugcgggg

SEQ ID NO: 18838 - RNA, 19 nt, Artificial Sequence
  Synthetic
ccgaccggggugugcgggg

SEQ ID NO: 18839 - RNA, 20 nt, Artificial Sequence
  Synthetic
uccgaccggggugugcgggg

SEQ ID NO: 18840 - RNA, 21 nt, Artificial Sequence
  Synthetic
cuccgaccggggugugcgggg

SEQ ID NO: 18841 - RNA, 22 nt, Artificial Sequence
  Synthetic
ccuccgaccggggugugcgggg

SEQ ID NO: 18842 - RNA, 24 nt, Artificial Sequence
  Synthetic
cgccuccgaccggggugugcgggg

SEQ ID NO: 18843 - RNA, 21 nt, Artificial Sequence
  Synthetic
ucuucaggggcggcagugggg

SEQ ID NO: 18844 - RNA, 22 nt, Artificial Sequence
  Synthetic
uucuucaggggcggcagugggg

SEQ ID NO: 18845 - RNA, 23 nt, Artificial Sequence
  Synthetic
cuucuucaggggcggcagugggg

SEQ ID NO: 18846 - RNA, 24 nt, Artificial Sequence
  Synthetic
ucuucuucaggggcggcagugggg

SEQ ID NO: 18847 - RNA, 24 nt, Artificial Sequence
  Synthetic
cgggccgcgcggcggggcgacggu

SEQ ID NO: 18848 - RNA, 19 nt, Artificial Sequence
  Synthetic
cggggcgacgguccggguu

SEQ ID NO: 18849 - RNA, 22 nt, Artificial Sequence
  Synthetic
cggcggggcgacgguccggguu

SEQ ID NO: 18850 - RNA, 24 nt, Artificial Sequence
  Synthetic
cgcggcggggcgacgguccggguu

SEQ ID NO: 18851 - RNA, 23 nt, Artificial Sequence
  Synthetic
aggggagcgagcccgcccgcgac

SEQ ID NO: 18852 - RNA, 24 nt, Artificial Sequence
  Synthetic
caggggagcgagcccgcccgcgac

SEQ ID NO: 18853 - RNA, 18 nt, Artificial Sequence
  Synthetic
cggagacgaccggcggcc

SEQ ID NO: 18854 - RNA, 21 nt, Artificial Sequence
  Synthetic
cggcggagacgaccggcggcc

SEQ ID NO: 18855 - RNA, 23 nt, Artificial Sequence
  Synthetic
cgcggcggagacgaccggcggcc

SEQ ID NO: 18856 - RNA, 24 nt, Artificial Sequence
  Synthetic
ccgcggcggagacgaccggcggcc

SEQ ID NO: 18857 - RNA, 21 nt, Artificial Sequence
  Synthetic
cgcggcuaccgacgcggccgc

SEQ ID NO: 18858 - RNA, 23 nt, Artificial Sequence
  Synthetic
agcgcggcuaccgacgcggccgc

SEQ ID NO: 18859 - RNA, 19 nt, Artificial Sequence
  Synthetic
cgucgccccgccgcgcggc

SEQ ID NO: 18860 - RNA, 20 nt, Artificial Sequence
  Synthetic
ccgucgccccgccgcgcggc

SEQ ID NO: 18861 - RNA, 21 nt, Artificial Sequence
  Synthetic
accgucgccccgccgcgcggc

SEQ ID NO: 18862 - RNA, 24 nt, Artificial Sequence
  Synthetic
cggaccgucgccccgccgcgcggc

SEQ ID NO: 18863 - RNA, 18 nt, Artificial Sequence
  Synthetic
accggcggccccggaucu

SEQ ID NO: 18864 - RNA, 20 nt, Artificial Sequence
  Synthetic
cgaccggcggccccggaucu

SEQ ID NO: 18865 - RNA, 21 nt, Artificial Sequence
  Synthetic
acgaccggcggccccggaucu

SEQ ID NO: 18866 - RNA, 23 nt, Artificial Sequence
  Synthetic
agacgaccggcggccccggaucu

SEQ ID NO: 18867 - RNA, 22 nt, Artificial Sequence
  Synthetic
cgccccgccgcgcggcccgggu

SEQ ID NO: 18868 - RNA, 23 nt, Artificial Sequence
  Synthetic
ucgccccgccgcgcggcccgggu

SEQ ID NO: 18869 - RNA, 18 nt, Artificial Sequence
  Synthetic
gcgcuccggggggggcga

SEQ ID NO: 18870 - RNA, 19 nt, Artificial Sequence
  Synthetic
cgcgcuccggggggggcga

SEQ ID NO: 18871 - RNA, 20 nt, Artificial Sequence
  Synthetic
ucgcgcuccggggggggcga

SEQ ID NO: 18872 - RNA, 18 nt, Artificial Sequence
  Synthetic
cgccgcgccccggcucgc

SEQ ID NO: 18873 - RNA, 19 nt, Artificial Sequence
  Synthetic
ccgccgcgccccggcucgc

SEQ ID NO: 18874 - RNA, 20 nt, Artificial Sequence
  Synthetic
gccgccgcgccccggcucgc

SEQ ID NO: 18875 - RNA, 18 nt, Artificial Sequence
  Synthetic
ucaggggcggcagugggg

SEQ ID NO: 18876 - RNA, 19 nt, Artificial Sequence
  Synthetic
uucaggggcggcagugggg

SEQ ID NO: 18877 - RNA, 20 nt, Artificial Sequence
  Synthetic
cuucaggggcggcagugggg

SEQ ID NO: 18878 - RNA, 18 nt, Artificial Sequence
  Synthetic
gcgcggcggggcgacggu

SEQ ID NO: 18879 - RNA, 19 nt, Artificial Sequence
  Synthetic
cgcgcggcggggcgacggu

SEQ ID NO: 18880 - RNA, 20 nt, Artificial Sequence
  Synthetic
ccgcgcggcggggcgacggu

SEQ ID NO: 18881 - RNA, 18 nt, Artificial Sequence
  Synthetic
agcgagcccgcccgcgac

SEQ ID NO: 18882 - RNA, 19 nt, Artificial Sequence
  Synthetic
gagcgagcccgcccgcgac

SEQ ID NO: 18883 - RNA, 20 nt, Artificial Sequence
  Synthetic
ggagcgagcccgcccgcgac

SEQ ID NO: 18884 - RNA, 18 nt, Artificial Sequence
  Synthetic
ggcuaccgacgcggccgc

SEQ ID NO: 18885 - RNA, 19 nt, Artificial Sequence
  Synthetic
cggcuaccgacgcggccgc

SEQ ID NO: 18886 - RNA, 20 nt, Artificial Sequence
  Synthetic
gcggcuaccgacgcggccgc

SEQ ID NO: 18887 - RNA, 18 nt, Artificial Sequence
  Synthetic
ccgccgcgcggcccgggu

SEQ ID NO: 18888 - RNA, 19 nt, Artificial Sequence
  Synthetic
cccgccgcgcggcccgggu

SEQ ID NO: 18889 - RNA, 20 nt, Artificial Sequence
  Synthetic
ccccgccgcgcggcccgggu

SEQ ID NO: 18890 - RNA, 18 nt, Artificial Sequence
  Synthetic
cgcgcggggcggggggaa

SEQ ID NO: 18891 - RNA, 19 nt, Artificial Sequence
  Synthetic
gcgcgcggggcggggggaa

SEQ ID NO: 18892 - RNA, 20 nt, Artificial Sequence
  Synthetic
ggcgcgcggggcggggggaa

SEQ ID NO: 18893 - RNA, 21 nt, Artificial Sequence
  Synthetic
gggcgcgcggggcggggggaa

SEQ ID NO: 18894 - RNA, 22 nt, Artificial Sequence
  Synthetic
ggggcgcgcggggcggggggaa

SEQ ID NO: 18895 - RNA, 23 nt, Artificial Sequence
  Synthetic
cggggcgcgcggggcggggggaa

SEQ ID NO: 18896 - RNA, 24 nt, Artificial Sequence
  Synthetic
ucggggcgcgcggggcggggggaa

SEQ ID NO: 18897 - RNA, 18 nt, Artificial Sequence
  Synthetic
gaacggccucguccacca

SEQ ID NO: 18898 - RNA, 19 nt, Artificial Sequence
  Synthetic
cgaacggccucguccacca

SEQ ID NO: 18899 - RNA, 20 nt, Artificial Sequence
  Synthetic
gcgaacggccucguccacca

SEQ ID NO: 18900 - RNA, 21 nt, Artificial Sequence
  Synthetic
ugcgaacggccucguccacca

SEQ ID NO: 18901 - RNA, 22 nt, Artificial Sequence
  Synthetic
gugcgaacggccucguccacca

SEQ ID NO: 18902 - RNA, 23 nt, Artificial Sequence
  Synthetic
cgugcgaacggccucguccacca

SEQ ID NO: 18903 - RNA, 24 nt, Artificial Sequence
  Synthetic
ucgugcgaacggccucguccacca

SEQ ID NO: 18904 - RNA, 18 nt, Artificial Sequence
  Synthetic
cgccauaaucggcgcgca

SEQ ID NO: 18905 - RNA, 19 nt, Artificial Sequence
  Synthetic
ucgccauaaucggcgcgca

SEQ ID NO: 18906 - RNA, 20 nt, Artificial Sequence
  Synthetic
cucgccauaaucggcgcgca

SEQ ID NO: 18907 - RNA, 21 nt, Artificial Sequence
  Synthetic
ccucgccauaaucggcgcgca

SEQ ID NO: 18908 - RNA, 22 nt, Artificial Sequence
  Synthetic
uccucgccauaaucggcgcgca

SEQ ID NO: 18909 - RNA, 23 nt, Artificial Sequence
  Synthetic
cuccucgccauaaucggcgcgca

SEQ ID NO: 18910 - RNA, 24 nt, Artificial Sequence
  Synthetic
ucuccucgccauaaucggcgcgca

SEQ ID NO: 18911 - RNA, 18 nt, Artificial Sequence
  Synthetic
ucuucuucaggggcggca

SEQ ID NO: 18912 - RNA, 19 nt, Artificial Sequence
  Synthetic
uucuucuucaggggcggca

SEQ ID NO: 18913 - RNA, 20 nt, Artificial Sequence
  Synthetic
cuucuucuucaggggcggca

SEQ ID NO: 18914 - RNA, 21 nt, Artificial Sequence
  Synthetic
ucuucuucuucaggggcggca

SEQ ID NO: 18915 - RNA, 22 nt, Artificial Sequence
  Synthetic
uucuucuucuucaggggcggca

SEQ ID NO: 18916 - RNA, 23 nt, Artificial Sequence
  Synthetic
cuucuucuucuucaggggcggca

SEQ ID NO: 18917 - RNA, 24 nt, Artificial Sequence
  Synthetic
ucuucuucuucuucaggggcggca

SEQ ID NO: 18918 - RNA, 18 nt, Artificial Sequence
  Synthetic
ccgcggcggagaaggcga

SEQ ID NO: 18919 - RNA, 19 nt, Artificial Sequence
  Synthetic
uccgcggcggagaaggcga

SEQ ID NO: 18920 - RNA, 20 nt, Artificial Sequence
  Synthetic
guccgcggcggagaaggcga

SEQ ID NO: 18921 - RNA, 21 nt, Artificial Sequence
  Synthetic
gguccgcggcggagaaggcga

SEQ ID NO: 18922 - RNA, 22 nt, Artificial Sequence
  Synthetic
ggguccgcggcggagaaggcga

SEQ ID NO: 18923 - RNA, 23 nt, Artificial Sequence
  Synthetic
gggguccgcggcggagaaggcga

SEQ ID NO: 18924 - RNA, 24 nt, Artificial Sequence
  Synthetic
ggggguccgcggcggagaaggcga

SEQ ID NO: 18925 - RNA, 18 nt, Artificial Sequence
  Synthetic
gcgcgcggggcgggggga

SEQ ID NO: 18926 - RNA, 19 nt, Artificial Sequence
  Synthetic
ggcgcgcggggcgggggga

SEQ ID NO: 18927 - RNA, 20 nt, Artificial Sequence
  Synthetic
gggcgcgcggggcgggggga

SEQ ID NO: 18928 - RNA, 21 nt, Artificial Sequence
  Synthetic
ggggcgcgcggggcgggggga

SEQ ID NO: 18929 - RNA, 22 nt, Artificial Sequence
  Synthetic
cggggcgcgcggggcgggggga

SEQ ID NO: 18930 - RNA, 23 nt, Artificial Sequence
  Synthetic
ucggggcgcgcggggcgggggga

SEQ ID NO: 18931 - RNA, 24 nt, Artificial Sequence
  Synthetic
cucggggcgcgcggggcgggggga

SEQ ID NO: 18932 - RNA, 18 nt, Artificial Sequence
  Synthetic
cuuccgcccgcgaugcua

SEQ ID NO: 18933 - RNA, 19 nt, Artificial Sequence
  Synthetic
gcuuccgcccgcgaugcua

SEQ ID NO: 18934 - RNA, 20 nt, Artificial Sequence
  Synthetic
cgcuuccgcccgcgaugcua

SEQ ID NO: 18935 - RNA, 21 nt, Artificial Sequence
  Synthetic
ccgcuuccgcccgcgaugcua

SEQ ID NO: 18936 - RNA, 22 nt, Artificial Sequence
  Synthetic
uccgcuuccgcccgcgaugcua

SEQ ID NO: 18937 - RNA, 23 nt, Artificial Sequence
  Synthetic
uuccgcuuccgcccgcgaugcua

SEQ ID NO: 18938 - RNA, 24 nt, Artificial Sequence
  Synthetic
cuuccgcuuccgcccgcgaugcua

SEQ ID NO: 18939 - RNA, 18 nt, Artificial Sequence
  Synthetic
ccaccgugccacccgaac

SEQ ID NO: 18940 - RNA, 19 nt, Artificial Sequence
  Synthetic
cccaccgugccacccgaac

SEQ ID NO: 18941 - RNA, 20 nt, Artificial Sequence
  Synthetic
gcccaccgugccacccgaac

SEQ ID NO: 18942 - RNA, 21 nt, Artificial Sequence
  Synthetic
ggcccaccgugccacccgaac

SEQ ID NO: 18943 - RNA, 22 nt, Artificial Sequence
  Synthetic
cggcccaccgugccacccgaac

SEQ ID NO: 18944 - RNA, 23 nt, Artificial Sequence
  Synthetic
ccggcccaccgugccacccgaac

SEQ ID NO: 18945 - RNA, 24 nt, Artificial Sequence
  Synthetic
uccggcccaccgugccacccgaac

SEQ ID NO: 18946 - RNA, 18 nt, Artificial Sequence
  Synthetic
uccggcccaccgugccac

SEQ ID NO: 18947 - RNA, 19 nt, Artificial Sequence
  Synthetic
cuccggcccaccgugccac

SEQ ID NO: 18948 - RNA, 20 nt, Artificial Sequence
  Synthetic
ccuccggcccaccgugccac

SEQ ID NO: 18949 - RNA, 21 nt, Artificial Sequence
  Synthetic
uccuccggcccaccgugccac

SEQ ID NO: 18950 - RNA, 22 nt, Artificial Sequence
  Synthetic
cuccuccggcccaccgugccac

SEQ ID NO: 18951 - RNA, 23 nt, Artificial Sequence
  Synthetic
ucuccuccggcccaccgugccac

SEQ ID NO: 18952 - RNA, 24 nt, Artificial Sequence
  Synthetic
uucuccuccggcccaccgugccac

SEQ ID NO: 18953 - RNA, 18 nt, Artificial Sequence
  Synthetic
gggggaaaggaggaggac

SEQ ID NO: 18954 - RNA, 19 nt, Artificial Sequence
  Synthetic
ggggggaaaggaggaggac

SEQ ID NO: 18955 - RNA, 20 nt, Artificial Sequence
  Synthetic
cggggggaaaggaggaggac

SEQ ID NO: 18956 - RNA, 21 nt, Artificial Sequence
  Synthetic
gcggggggaaaggaggaggac

SEQ ID NO: 18957 - RNA, 22 nt, Artificial Sequence
  Synthetic
ggcggggggaaaggaggaggac

SEQ ID NO: 18958 - RNA, 23 nt, Artificial Sequence
  Synthetic
gggcggggggaaaggaggaggac

SEQ ID NO: 18959 - RNA, 24 nt, Artificial Sequence
  Synthetic
ggggcggggggaaaggaggaggac

SEQ ID NO: 18960 - RNA, 18 nt, Artificial Sequence
  Synthetic
gucgucuccgccgcggcc

SEQ ID NO: 18961 - RNA, 19 nt, Artificial Sequence
  Synthetic
ggucgucuccgccgcggcc

SEQ ID NO: 18962 - RNA, 20 nt, Artificial Sequence
  Synthetic
cggucgucuccgccgcggcc

SEQ ID NO: 18963 - RNA, 21 nt, Artificial Sequence
  Synthetic
ccggucgucuccgccgcggcc

SEQ ID NO: 18964 - RNA, 22 nt, Artificial Sequence
  Synthetic
gccggucgucuccgccgcggcc

SEQ ID NO: 18965 - RNA, 23 nt, Artificial Sequence
  Synthetic
cgccggucgucuccgccgcggcc

SEQ ID NO: 18966 - RNA, 24 nt, Artificial Sequence
  Synthetic
ccgccggucgucuccgccgcggcc

SEQ ID NO: 18967 - RNA, 18 nt, Artificial Sequence
  Synthetic
ggcucgucgacggccucc

SEQ ID NO: 18968 - RNA, 19 nt, Artificial Sequence
  Synthetic
aggcucgucgacggccucc

SEQ ID NO: 18969 - RNA, 20 nt, Artificial Sequence
  Synthetic
caggcucgucgacggccucc

SEQ ID NO: 18970 - RNA, 21 nt, Artificial Sequence
  Synthetic
gcaggcucgucgacggccucc

SEQ ID NO: 18971 - RNA, 22 nt, Artificial Sequence
  Synthetic
ggcaggcucgucgacggccucc

SEQ ID NO: 18972 - RNA, 23 nt, Artificial Sequence
  Synthetic
cggcaggcucgucgacggccucc

SEQ ID NO: 18973 - RNA, 24 nt, Artificial Sequence
  Synthetic
gcggcaggcucgucgacggccucc

SEQ ID NO: 18974 - RNA, 18 nt, Artificial Sequence
  Synthetic
uccgcgccgucgcgcucc

SEQ ID NO: 18975 - RNA, 19 nt, Artificial Sequence
  Synthetic
uuccgcgccgucgcgcucc

SEQ ID NO: 18976 - RNA, 20 nt, Artificial Sequence
  Synthetic
cuuccgcgccgucgcgcucc

SEQ ID NO: 18977 - RNA, 21 nt, Artificial Sequence
  Synthetic
ucuuccgcgccgucgcgcucc

SEQ ID NO: 18978 - RNA, 22 nt, Artificial Sequence
  Synthetic
uucuuccgcgccgucgcgcucc

SEQ ID NO: 18979 - RNA, 23 nt, Artificial Sequence
  Synthetic
cuucuuccgcgccgucgcgcucc

SEQ ID NO: 18980 - RNA, 24 nt, Artificial Sequence
  Synthetic
ucuucuuccgcgccgucgcgcucc

SEQ ID NO: 18981 - RNA, 18 nt, Artificial Sequence
  Synthetic
gccuggcugauauagucc

SEQ ID NO: 18982 - RNA, 19 nt, Artificial Sequence
  Synthetic
cgccuggcugauauagucc

SEQ ID NO: 18983 - RNA, 20 nt, Artificial Sequence
  Synthetic
ucgccuggcugauauagucc

SEQ ID NO: 18984 - RNA, 21 nt, Artificial Sequence
  Synthetic
gucgccuggcugauauagucc

SEQ ID NO: 18985 - RNA, 22 nt, Artificial Sequence
  Synthetic
cgucgccuggcugauauagucc

SEQ ID NO: 18986 - RNA, 23 nt, Artificial Sequence
  Synthetic
ccgucgccuggcugauauagucc

SEQ ID NO: 18987 - RNA, 24 nt, Artificial Sequence
  Synthetic
cccgucgccuggcugauauagucc

SEQ ID NO: 18988 - RNA, 18 nt, Artificial Sequence
  Synthetic
gacggccuccccggacgc

SEQ ID NO: 18989 - RNA, 19 nt, Artificial Sequence
  Synthetic
cgacggccuccccggacgc

SEQ ID NO: 18990 - RNA, 20 nt, Artificial Sequence
  Synthetic
ucgacggccuccccggacgc

SEQ ID NO: 18991 - RNA, 21 nt, Artificial Sequence
  Synthetic
gucgacggccuccccggacgc

SEQ ID NO: 18992 - RNA, 22 nt, Artificial Sequence
  Synthetic
cgucgacggccuccccggacgc

SEQ ID NO: 18993 - RNA, 23 nt, Artificial Sequence
  Synthetic
ucgucgacggccuccccggacgc

SEQ ID NO: 18994 - RNA, 24 nt, Artificial Sequence
  Synthetic
cucgucgacggccuccccggacgc

SEQ ID NO: 18995 - RNA, 18 nt, Artificial Sequence
  Synthetic
ucgccauaaucggcgcgc

SEQ ID NO: 18996 - RNA, 19 nt, Artificial Sequence
  Synthetic
cucgccauaaucggcgcgc

SEQ ID NO: 18997 - RNA, 20 nt, Artificial Sequence
  Synthetic
ccucgccauaaucggcgcgc

SEQ ID NO: 18998 - RNA, 21 nt, Artificial Sequence
  Synthetic
uccucgccauaaucggcgcgc

SEQ ID NO: 18999 - RNA, 22 nt, Artificial Sequence
  Synthetic
cuccucgccauaaucggcgcgc

SEQ ID NO: 19000 - RNA, 23 nt, Artificial Sequence
  Synthetic
ucuccucgccauaaucggcgcgc

SEQ ID NO: 19001 - RNA, 24 nt, Artificial Sequence
  Synthetic
uucuccucgccauaaucggcgcgc

SEQ ID NO: 19002 - RNA, 18 nt, Artificial Sequence
  Synthetic
auauaguccucggggcgc

SEQ ID NO: 19003 - RNA, 19 nt, Artificial Sequence
  Synthetic
gauauaguccucggggcgc

SEQ ID NO: 19004 - RNA, 20 nt, Artificial Sequence
  Synthetic
ugauauaguccucggggcgc

SEQ ID NO: 19005 - RNA, 21 nt, Artificial Sequence
  Synthetic
cugauauaguccucggggcgc

SEQ ID NO: 19006 - RNA, 22 nt, Artificial Sequence
  Synthetic
gcugauauaguccucggggcgc

SEQ ID NO: 19007 - RNA, 23 nt, Artificial Sequence
  Synthetic
ggcugauauaguccucggggcgc

SEQ ID NO: 19008 - RNA, 24 nt, Artificial Sequence
  Synthetic
uggcugauauaguccucggggcgc

SEQ ID NO: 19009 - RNA, 18 nt, Artificial Sequence
  Synthetic
aucucauuagcgcccggc

SEQ ID NO: 19010 - RNA, 19 nt, Artificial Sequence
  Synthetic
caucucauuagcgcccggc

SEQ ID NO: 19011 - RNA, 20 nt, Artificial Sequence
  Synthetic
gcaucucauuagcgcccggc

SEQ ID NO: 19012 - RNA, 21 nt, Artificial Sequence
  Synthetic
ggcaucucauuagcgcccggc

SEQ ID NO: 19013 - RNA, 22 nt, Artificial Sequence
  Synthetic
cggcaucucauuagcgcccggc

SEQ ID NO: 19014 - RNA, 23 nt, Artificial Sequence
  Synthetic
gcggcaucucauuagcgcccggc

SEQ ID NO: 19015 - RNA, 24 nt, Artificial Sequence
  Synthetic
cgcggcaucucauuagcgcccggc

SEQ ID NO: 19016 - RNA, 18 nt, Artificial Sequence
  Synthetic
ggucgucuccgccgcggc

SEQ ID NO: 19017 - RNA, 19 nt, Artificial Sequence
  Synthetic
cggucgucuccgccgcggc

SEQ ID NO: 19018 - RNA, 20 nt, Artificial Sequence
  Synthetic
ccggucgucuccgccgcggc

SEQ ID NO: 19019 - RNA, 21 nt, Artificial Sequence
  Synthetic
gccggucgucuccgccgcggc

SEQ ID NO: 19020 - RNA, 22 nt, Artificial Sequence
  Synthetic
cgccggucgucuccgccgcggc

SEQ ID NO: 19021 - RNA, 23 nt, Artificial Sequence
  Synthetic
ccgccggucgucuccgccgcggc

SEQ ID NO: 19022 - RNA, 24 nt, Artificial Sequence
  Synthetic
gccgccggucgucuccgccgcggc

SEQ ID NO: 19023 - RNA, 18 nt, Artificial Sequence
  Synthetic
ccucggggcgcgcggggc

SEQ ID NO: 19024 - RNA, 19 nt, Artificial Sequence
  Synthetic
uccucggggcgcgcggggc

SEQ ID NO: 19025 - RNA, 20 nt, Artificial Sequence
  Synthetic
guccucggggcgcgcggggc

SEQ ID NO: 19026 - RNA, 21 nt, Artificial Sequence
  Synthetic
aguccucggggcgcgcggggc

SEQ ID NO: 19027 - RNA, 22 nt, Artificial Sequence
  Synthetic
uaguccucggggcgcgcggggc

SEQ ID NO: 19028 - RNA, 23 nt, Artificial Sequence
  Synthetic
auaguccucggggcgcgcggggc

SEQ ID NO: 19029 - RNA, 24 nt, Artificial Sequence
  Synthetic
uauaguccucggggcgcgcggggc

SEQ ID NO: 19030 - RNA, 18 nt, Artificial Sequence
  Synthetic
ccuccgaccggggugugc

SEQ ID NO: 19031 - RNA, 19 nt, Artificial Sequence
  Synthetic
gccuccgaccggggugugc

SEQ ID NO: 19032 - RNA, 20 nt, Artificial Sequence
  Synthetic
cgccuccgaccggggugugc

SEQ ID NO: 19033 - RNA, 18 nt, Artificial Sequence
  Synthetic
cggcuggauccggagauc

SEQ ID NO: 19034 - RNA, 19 nt, Artificial Sequence
  Synthetic
ucggcuggauccggagauc

SEQ ID NO: 19035 - RNA, 20 nt, Artificial Sequence
  Synthetic
gucggcuggauccggagauc

SEQ ID NO: 19036 - RNA, 21 nt, Artificial Sequence
  Synthetic
cgucggcuggauccggagauc

SEQ ID NO: 19037 - RNA, 22 nt, Artificial Sequence
  Synthetic
ccgucggcuggauccggagauc

SEQ ID NO: 19038 - RNA, 23 nt, Artificial Sequence
  Synthetic
uccgucggcuggauccggagauc

SEQ ID NO: 19039 - RNA, 24 nt, Artificial Sequence
  Synthetic
guccgucggcuggauccggagauc

SEQ ID NO: 19040 - RNA, 18 nt, Artificial Sequence
  Synthetic
cgguccgucggcuggauc

SEQ ID NO: 19041 - RNA, 19 nt, Artificial Sequence
  Synthetic
gcgguccgucggcuggauc

SEQ ID NO: 19042 - RNA, 20 nt, Artificial Sequence
  Synthetic
ggcgguccgucggcuggauc

SEQ ID NO: 19043 - RNA, 21 nt, Artificial Sequence
  Synthetic
cggcgguccgucggcuggauc

SEQ ID NO: 19044 - RNA, 22 nt, Artificial Sequence
  Synthetic
gcggcgguccgucggcuggauc

SEQ ID NO: 19045 - RNA, 23 nt, Artificial Sequence
  Synthetic
ggcggcgguccgucggcuggauc

SEQ ID NO: 19046 - RNA, 24 nt, Artificial Sequence
  Synthetic
gggcggcgguccgucggcuggauc

SEQ ID NO: 19047 - RNA, 18 nt, Artificial Sequence
  Synthetic
uuccgcgccgucgcgcuc

SEQ ID NO: 19048 - RNA, 19 nt, Artificial Sequence
  Synthetic
cuuccgcgccgucgcgcuc

SEQ ID NO: 19049 - RNA, 20 nt, Artificial Sequence
  Synthetic
ucuuccgcgccgucgcgcuc

SEQ ID NO: 19050 - RNA, 21 nt, Artificial Sequence
  Synthetic
uucuuccgcgccgucgcgcuc

SEQ ID NO: 19051 - RNA, 22 nt, Artificial Sequence
  Synthetic
cuucuuccgcgccgucgcgcuc

SEQ ID NO: 19052 - RNA, 23 nt, Artificial Sequence
  Synthetic
ucuucuuccgcgccgucgcgcuc

SEQ ID NO: 19053 - RNA, 24 nt, Artificial Sequence
  Synthetic
uucuucuuccgcgccgucgcgcuc

SEQ ID NO: 19054 - RNA, 18 nt, Artificial Sequence
  Synthetic
gcuaaugagacccucguc

SEQ ID NO: 19055 - RNA, 19 nt, Artificial Sequence
  Synthetic
ugcuaaugagacccucguc

SEQ ID NO: 19056 - RNA, 20 nt, Artificial Sequence
  Synthetic
augcuaaugagacccucguc

SEQ ID NO: 19057 - RNA, 21 nt, Artificial Sequence
  Synthetic
gaugcuaaugagacccucguc

SEQ ID NO: 19058 - RNA, 22 nt, Artificial Sequence
  Synthetic
cgaugcuaaugagacccucguc

SEQ ID NO: 19059 - RNA, 23 nt, Artificial Sequence
  Synthetic
gcgaugcuaaugagacccucguc

SEQ ID NO: 19060 - RNA, 24 nt, Artificial Sequence
  Synthetic
cgcgaugcuaaugagacccucguc

SEQ ID NO: 19061 - RNA, 18 nt, Artificial Sequence
  Synthetic
gucuucuucuucuucuuc

SEQ ID NO: 19062 - RNA, 19 nt, Artificial Sequence
  Synthetic
ggucuucuucuucuucuuc

SEQ ID NO: 19063 - RNA, 20 nt, Artificial Sequence
  Synthetic
gggucuucuucuucuucuuc

SEQ ID NO: 19064 - RNA, 21 nt, Artificial Sequence
  Synthetic
ggggucuucuucuucuucuuc

SEQ ID NO: 19065 - RNA, 22 nt, Artificial Sequence
  Synthetic
gggggucuucuucuucuucuuc

SEQ ID NO: 19066 - RNA, 23 nt, Artificial Sequence
  Synthetic
ggggggucuucuucuucuucuuc

SEQ ID NO: 19067 - RNA, 24 nt, Artificial Sequence
  Synthetic
gggggggucuucuucuucuucuuc

SEQ ID NO: 19068 - RNA, 18 nt, Artificial Sequence
  Synthetic
cgcggggcggggggaaag

SEQ ID NO: 19069 - RNA, 19 nt, Artificial Sequence
  Synthetic
gcgcggggcggggggaaag

SEQ ID NO: 19070 - RNA, 20 nt, Artificial Sequence
  Synthetic
cgcgcggggcggggggaaag

SEQ ID NO: 19071 - RNA, 21 nt, Artificial Sequence
  Synthetic
gcgcgcggggcggggggaaag

SEQ ID NO: 19072 - RNA, 22 nt, Artificial Sequence
  Synthetic
ggcgcgcggggcggggggaaag

SEQ ID NO: 19073 - RNA, 23 nt, Artificial Sequence
  Synthetic
gggcgcgcggggcggggggaaag

SEQ ID NO: 19074 - RNA, 24 nt, Artificial Sequence
  Synthetic
ggggcgcgcggggcggggggaaag

SEQ ID NO: 19075 - RNA, 18 nt, Artificial Sequence
  Synthetic
ggguccgcggcggagaag

SEQ ID NO: 19076 - RNA, 19 nt, Artificial Sequence
  Synthetic
gggguccgcggcggagaag

SEQ ID NO: 19077 - RNA, 20 nt, Artificial Sequence
  Synthetic
ggggguccgcggcggagaag

SEQ ID NO: 19078 - RNA, 21 nt, Artificial Sequence
  Synthetic
aggggguccgcggcggagaag

SEQ ID NO: 19079 - RNA, 22 nt, Artificial Sequence
  Synthetic
gaggggguccgcggcggagaag

SEQ ID NO: 19080 - RNA, 23 nt, Artificial Sequence
  Synthetic
ggaggggguccgcggcggagaag

SEQ ID NO: 19081 - RNA, 24 nt, Artificial Sequence
  Synthetic
uggaggggguccgcggcggagaag

SEQ ID NO: 19082 - RNA, 18 nt, Artificial Sequence
  Synthetic
ccgggguuccgcccccag

SEQ ID NO: 19083 - RNA, 19 nt, Artificial Sequence
  Synthetic
gccgggguuccgcccccag

SEQ ID NO: 19084 - RNA, 20 nt, Artificial Sequence
  Synthetic
cgccgggguuccgcccccag

SEQ ID NO: 19085 - RNA, 21 nt, Artificial Sequence
  Synthetic
ucgccgggguuccgcccccag

SEQ ID NO: 19086 - RNA, 22 nt, Artificial Sequence
  Synthetic
cucgccgggguuccgcccccag

SEQ ID NO: 19087 - RNA, 23 nt, Artificial Sequence
  Synthetic
gcucgccgggguuccgcccccag

SEQ ID NO: 19088 - RNA, 24 nt, Artificial Sequence
  Synthetic
ggcucgccgggguuccgcccccag

SEQ ID NO: 19089 - RNA, 18 nt, Artificial Sequence
  Synthetic
guccaccaucgaggccag

SEQ ID NO: 19090 - RNA, 19 nt, Artificial Sequence
  Synthetic
cguccaccaucgaggccag

SEQ ID NO: 19091 - RNA, 20 nt, Artificial Sequence
  Synthetic
ucguccaccaucgaggccag

SEQ ID NO: 19092 - RNA, 21 nt, Artificial Sequence
  Synthetic
cucguccaccaucgaggccag

SEQ ID NO: 19093 - RNA, 22 nt, Artificial Sequence
  Synthetic
ccucguccaccaucgaggccag

SEQ ID NO: 19094 - RNA, 23 nt, Artificial Sequence
  Synthetic
gccucguccaccaucgaggccag

SEQ ID NO: 19095 - RNA, 24 nt, Artificial Sequence
  Synthetic
ggccucguccaccaucgaggccag

SEQ ID NO: 19096 - RNA, 18 nt, Artificial Sequence
  Synthetic
cuucuucaggggcggcag

SEQ ID NO: 19097 - RNA, 19 nt, Artificial Sequence
  Synthetic
ucuucuucaggggcggcag

SEQ ID NO: 19098 - RNA, 20 nt, Artificial Sequence
  Synthetic
uucuucuucaggggcggcag

SEQ ID NO: 19099 - RNA, 21 nt, Artificial Sequence
  Synthetic
cuucuucuucaggggcggcag

SEQ ID NO: 19100 - RNA, 22 nt, Artificial Sequence
  Synthetic
ucuucuucuucaggggcggcag

SEQ ID NO: 19101 - RNA, 23 nt, Artificial Sequence
  Synthetic
uucuucuucuucaggggcggcag

SEQ ID NO: 19102 - RNA, 24 nt, Artificial Sequence
  Synthetic
cuucuucuucuucaggggcggcag

SEQ ID NO: 19103 - RNA, 18 nt, Artificial Sequence
  Synthetic
ggggcggggggaaaggag

SEQ ID NO: 19104 - RNA, 19 nt, Artificial Sequence
  Synthetic
cggggcggggggaaaggag

SEQ ID NO: 19105 - RNA, 20 nt, Artificial Sequence
  Synthetic
gcggggcggggggaaaggag

SEQ ID NO: 19106 - RNA, 21 nt, Artificial Sequence
  Synthetic
cgcggggcggggggaaaggag

SEQ ID NO: 19107 - RNA, 22 nt, Artificial Sequence
  Synthetic
gcgcggggcggggggaaaggag

SEQ ID NO: 19108 - RNA, 23 nt, Artificial Sequence
  Synthetic
cgcgcggggcggggggaaaggag

SEQ ID NO: 19109 - RNA, 24 nt, Artificial Sequence
  Synthetic
gcgcgcggggcggggggaaaggag

SEQ ID NO: 19110 - RNA, 18 nt, Artificial Sequence
  Synthetic
aaggaggaggacgcggag

SEQ ID NO: 19111 - RNA, 19 nt, Artificial Sequence
  Synthetic
aaaggaggaggacgcggag

SEQ ID NO: 19112 - RNA, 20 nt, Artificial Sequence
  Synthetic
gaaaggaggaggacgcggag

SEQ ID NO: 19113 - RNA, 21 nt, Artificial Sequence
  Synthetic
ggaaaggaggaggacgcggag

SEQ ID NO: 19114 - RNA, 22 nt, Artificial Sequence
  Synthetic
gggaaaggaggaggacgcggag

SEQ ID NO: 19115 - RNA, 23 nt, Artificial Sequence
  Synthetic
ggggaaaggaggaggacgcggag

SEQ ID NO: 19116 - RNA, 24 nt, Artificial Sequence
  Synthetic
gggggaaaggaggaggacgcggag

SEQ ID NO: 19117 - RNA, 18 nt, Artificial Sequence
  Synthetic
ggggaaaggaggaggacg

SEQ ID NO: 19118 - RNA, 19 nt, Artificial Sequence
  Synthetic
gggggaaaggaggaggacg

SEQ ID NO: 19119 - RNA, 20 nt, Artificial Sequence
  Synthetic
ggggggaaaggaggaggacg

SEQ ID NO: 19120 - RNA, 21 nt, Artificial Sequence
  Synthetic
cggggggaaaggaggaggacg

SEQ ID NO: 19121 - RNA, 22 nt, Artificial Sequence
  Synthetic
gcggggggaaaggaggaggacg

SEQ ID NO: 19122 - RNA, 23 nt, Artificial Sequence
  Synthetic
ggcggggggaaaggaggaggacg

SEQ ID NO: 19123 - RNA, 24 nt, Artificial Sequence
  Synthetic
gggcggggggaaaggaggaggacg

SEQ ID NO: 19124 - RNA, 18 nt, Artificial Sequence
  Synthetic
cgacggccuccccggacg

SEQ ID NO: 19125 - RNA, 19 nt, Artificial Sequence
  Synthetic
ucgacggccuccccggacg

SEQ ID NO: 19126 - RNA, 20 nt, Artificial Sequence
  Synthetic
gucgacggccuccccggacg

SEQ ID NO: 19127 - RNA, 21 nt, Artificial Sequence
  Synthetic
cgucgacggccuccccggacg

SEQ ID NO: 19128 - RNA, 22 nt, Artificial Sequence
  Synthetic
ucgucgacggccuccccggacg

SEQ ID NO: 19129 - RNA, 23 nt, Artificial Sequence
  Synthetic
cucgucgacggccuccccggacg

SEQ ID NO: 19130 - RNA, 24 nt, Artificial Sequence
  Synthetic
gcucgucgacggccuccccggacg

SEQ ID NO: 19131 - RNA, 18 nt, Artificial Sequence
  Synthetic
ccgcgccgucgcgcuccg

SEQ ID NO: 19132 - RNA, 19 nt, Artificial Sequence
  Synthetic
uccgcgccgucgcgcuccg

SEQ ID NO: 19133 - RNA, 20 nt, Artificial Sequence
  Synthetic
uuccgcgccgucgcgcuccg

SEQ ID NO: 19134 - RNA, 21 nt, Artificial Sequence
  Synthetic
cuuccgcgccgucgcgcuccg

SEQ ID NO: 19135 - RNA, 22 nt, Artificial Sequence
  Synthetic
ucuuccgcgccgucgcgcuccg

SEQ ID NO: 19136 - RNA, 23 nt, Artificial Sequence
  Synthetic
uucuuccgcgccgucgcgcuccg

SEQ ID NO: 19137 - RNA, 24 nt, Artificial Sequence
  Synthetic
cuucuuccgcgccgucgcgcuccg

SEQ ID NO: 19138 - RNA, 18 nt, Artificial Sequence
  Synthetic
ggaaaggaggaggacgcg

SEQ ID NO: 19139 - RNA, 19 nt, Artificial Sequence
  Synthetic
gggaaaggaggaggacgcg

SEQ ID NO: 19140 - RNA, 20 nt, Artificial Sequence
  Synthetic
ggggaaaggaggaggacgcg

SEQ ID NO: 19141 - RNA, 21 nt, Artificial Sequence
  Synthetic
gggggaaaggaggaggacgcg

SEQ ID NO: 19142 - RNA, 22 nt, Artificial Sequence
  Synthetic
ggggggaaaggaggaggacgcg

SEQ ID NO: 19143 - RNA, 23 nt, Artificial Sequence
  Synthetic
cggggggaaaggaggaggacgcg

SEQ ID NO: 19144 - RNA, 24 nt, Artificial Sequence
  Synthetic
gcggggggaaaggaggaggacgcg

SEQ ID NO: 19145 - RNA, 18 nt, Artificial Sequence
  Synthetic
gcagggccagcugccgcg

SEQ ID NO: 19146 - RNA, 19 nt, Artificial Sequence
  Synthetic
agcagggccagcugccgcg

SEQ ID NO: 19147 - RNA, 20 nt, Artificial Sequence
  Synthetic
cagcagggccagcugccgcg

SEQ ID NO: 19148 - RNA, 21 nt, Artificial Sequence
  Synthetic
ccagcagggccagcugccgcg

SEQ ID NO: 19149 - RNA, 22 nt, Artificial Sequence
  Synthetic
gccagcagggccagcugccgcg

SEQ ID NO: 19150 - RNA, 23 nt, Artificial Sequence
  Synthetic
ggccagcagggccagcugccgcg

SEQ ID NO: 19151 - RNA, 24 nt, Artificial Sequence
  Synthetic
aggccagcagggccagcugccgcg

SEQ ID NO: 19152 - RNA, 18 nt, Artificial Sequence
  Synthetic
gcauggaggggguccgcg

SEQ ID NO: 19153 - RNA, 19 nt, Artificial Sequence
  Synthetic
cgcauggaggggguccgcg

SEQ ID NO: 19154 - RNA, 20 nt, Artificial Sequence
  Synthetic
gcgcauggaggggguccgcg

SEQ ID NO: 19155 - RNA, 21 nt, Artificial Sequence
  Synthetic
cgcgcauggaggggguccgcg

SEQ ID NO: 19156 - RNA, 22 nt, Artificial Sequence
  Synthetic
gcgcgcauggaggggguccgcg

SEQ ID NO: 19157 - RNA, 23 nt, Artificial Sequence
  Synthetic
ggcgcgcauggaggggguccgcg

SEQ ID NO: 19158 - RNA, 24 nt, Artificial Sequence
  Synthetic
cggcgcgcauggaggggguccgcg

SEQ ID NO: 19159 - RNA, 18 nt, Artificial Sequence
  Synthetic
ccgaacccgggccgcgcg

SEQ ID NO: 19160 - RNA, 19 nt, Artificial Sequence
  Synthetic
cccgaacccgggccgcgcg

SEQ ID NO: 19161 - RNA, 20 nt, Artificial Sequence
  Synthetic
acccgaacccgggccgcgcg

SEQ ID NO: 19162 - RNA, 21 nt, Artificial Sequence
  Synthetic
cacccgaacccgggccgcgcg

SEQ ID NO: 19163 - RNA, 22 nt, Artificial Sequence
  Synthetic
ccacccgaacccgggccgcgcg

SEQ ID NO: 19164 - RNA, 23 nt, Artificial Sequence
  Synthetic
gccacccgaacccgggccgcgcg

SEQ ID NO: 19165 - RNA, 24 nt, Artificial Sequence
  Synthetic
ugccacccgaacccgggccgcgcg

SEQ ID NO: 19166 - RNA, 18 nt, Artificial Sequence
  Synthetic
uauaguccucggggcgcg

SEQ ID NO: 19167 - RNA, 19 nt, Artificial Sequence
  Synthetic
auauaguccucggggcgcg

SEQ ID NO: 19168 - RNA, 20 nt, Artificial Sequence
  Synthetic
gauauaguccucggggcgcg

SEQ ID NO: 19169 - RNA, 21 nt, Artificial Sequence
  Synthetic
ugauauaguccucggggcgcg

SEQ ID NO: 19170 - RNA, 22 nt, Artificial Sequence
  Synthetic
cugauauaguccucggggcgcg

SEQ ID NO: 19171 - RNA, 23 nt, Artificial Sequence
  Synthetic
gcugauauaguccucggggcgcg

SEQ ID NO: 19172 - RNA, 24 nt, Artificial Sequence
  Synthetic
ggcugauauaguccucggggcgcg

SEQ ID NO: 19173 - RNA, 18 nt, Artificial Sequence
  Synthetic
uggaggggguccgcggcg

SEQ ID NO: 19174 - RNA, 19 nt, Artificial Sequence
  Synthetic
auggaggggguccgcggcg

SEQ ID NO: 19175 - RNA, 20 nt, Artificial Sequence
  Synthetic
cauggaggggguccgcggcg

SEQ ID NO: 19176 - RNA, 21 nt, Artificial Sequence
  Synthetic
gcauggaggggguccgcggcg

SEQ ID NO: 19177 - RNA, 22 nt, Artificial Sequence
  Synthetic
cgcauggaggggguccgcggcg

SEQ ID NO: 19178 - RNA, 23 nt, Artificial Sequence
  Synthetic
gcgcauggaggggguccgcggcg

SEQ ID NO: 19179 - RNA, 24 nt, Artificial Sequence
  Synthetic
cgcgcauggaggggguccgcggcg

SEQ ID NO: 19180 - RNA, 18 nt, Artificial Sequence
  Synthetic
cucggggcgcgcggggcg

SEQ ID NO: 19181 - RNA, 19 nt, Artificial Sequence
  Synthetic
ccucggggcgcgcggggcg

SEQ ID NO: 19182 - RNA, 20 nt, Artificial Sequence
  Synthetic
uccucggggcgcgcggggcg

SEQ ID NO: 19183 - RNA, 21 nt, Artificial Sequence
  Synthetic
guccucggggcgcgcggggcg

SEQ ID NO: 19184 - RNA, 22 nt, Artificial Sequence
  Synthetic
aguccucggggcgcgcggggcg

SEQ ID NO: 19185 - RNA, 23 nt, Artificial Sequence
  Synthetic
uaguccucggggcgcgcggggcg

SEQ ID NO: 19186 - RNA, 24 nt, Artificial Sequence
  Synthetic
auaguccucggggcgcgcggggcg

SEQ ID NO: 19187 - RNA, 18 nt, Artificial Sequence
  Synthetic
cgcgcuccggggggggcg

SEQ ID NO: 19188 - RNA, 19 nt, Artificial Sequence
  Synthetic
ucgcgcuccggggggggcg

SEQ ID NO: 19189 - RNA, 20 nt, Artificial Sequence
  Synthetic
gucgcgcuccggggggggcg

SEQ ID NO: 19190 - RNA, 21 nt, Artificial Sequence
  Synthetic
cgucgcgcuccggggggggcg

SEQ ID NO: 19191 - RNA, 22 nt, Artificial Sequence
  Synthetic
ccgucgcgcuccggggggggcg

SEQ ID NO: 19192 - RNA, 23 nt, Artificial Sequence
  Synthetic
gccgucgcgcuccggggggggcg

SEQ ID NO: 19193 - RNA, 24 nt, Artificial Sequence
  Synthetic
cgccgucgcgcuccggggggggcg

SEQ ID NO: 19194 - RNA, 18 nt, Artificial Sequence
  Synthetic
cuccgaccggggugugcg

SEQ ID NO: 19195 - RNA, 19 nt, Artificial Sequence
  Synthetic
ccuccgaccggggugugcg

SEQ ID NO: 19196 - RNA, 20 nt, Artificial Sequence
  Synthetic
gccuccgaccggggugugcg

SEQ ID NO: 19197 - RNA, 18 nt, Artificial Sequence
  Synthetic
ccgccgcgccccggcucg

SEQ ID NO: 19198 - RNA, 19 nt, Artificial Sequence
  Synthetic
gccgccgcgccccggcucg

SEQ ID NO: 19199 - RNA, 20 nt, Artificial Sequence
  Synthetic
cgccgccgcgccccggcucg

SEQ ID NO: 19200 - RNA, 21 nt, Artificial Sequence
  Synthetic
acgccgccgcgccccggcucg

SEQ ID NO: 19201 - RNA, 22 nt, Artificial Sequence
  Synthetic
gacgccgccgcgccccggcucg

SEQ ID NO: 19202 - RNA, 23 nt, Artificial Sequence
  Synthetic
cgacgccgccgcgccccggcucg

SEQ ID NO: 19203 - RNA, 24 nt, Artificial Sequence
  Synthetic
ucgacgccgccgcgccccggcucg

SEQ ID NO: 19204 - RNA, 18 nt, Artificial Sequence
  Synthetic
gcggggcggggggaaagg

SEQ ID NO: 19205 - RNA, 19 nt, Artificial Sequence
  Synthetic
cgcggggcggggggaaagg

SEQ ID NO: 19206 - RNA, 20 nt, Artificial Sequence
  Synthetic
gcgcggggcggggggaaagg

SEQ ID NO: 19207 - RNA, 21 nt, Artificial Sequence
  Synthetic
cgcgcggggcggggggaaagg

SEQ ID NO: 19208 - RNA, 22 nt, Artificial Sequence
  Synthetic
gcgcgcggggcggggggaaagg

SEQ ID NO: 19209 - RNA, 23 nt, Artificial Sequence
  Synthetic
ggcgcgcggggcggggggaaagg

SEQ ID NO: 19210 - RNA, 24 nt, Artificial Sequence
  Synthetic
gggcgcgcggggcggggggaaagg

SEQ ID NO: 19211 - RNA, 18 nt, Artificial Sequence
  Synthetic
cgggguuccgcccccagg

SEQ ID NO: 19212 - RNA, 19 nt, Artificial Sequence
  Synthetic
ccgggguuccgcccccagg

SEQ ID NO: 19213 - RNA, 20 nt, Artificial Sequence
  Synthetic
gccgggguuccgcccccagg

SEQ ID NO: 19214 - RNA, 21 nt, Artificial Sequence
  Synthetic
cgccgggguuccgcccccagg

SEQ ID NO: 19215 - RNA, 22 nt, Artificial Sequence
  Synthetic
ucgccgggguuccgcccccagg

SEQ ID NO: 19216 - RNA, 23 nt, Artificial Sequence
  Synthetic
cucgccgggguuccgcccccagg

SEQ ID NO: 19217 - RNA, 24 nt, Artificial Sequence
  Synthetic
gcucgccgggguuccgcccccagg

SEQ ID NO: 19218 - RNA, 18 nt, Artificial Sequence
  Synthetic
aggaggaggacgcggagg

SEQ ID NO: 19219 - RNA, 19 nt, Artificial Sequence
  Synthetic
aaggaggaggacgcggagg

SEQ ID NO: 19220 - RNA, 20 nt, Artificial Sequence
  Synthetic
aaaggaggaggacgcggagg

SEQ ID NO: 19221 - RNA, 21 nt, Artificial Sequence
  Synthetic
gaaaggaggaggacgcggagg

SEQ ID NO: 19222 - RNA, 22 nt, Artificial Sequence
  Synthetic
ggaaaggaggaggacgcggagg

SEQ ID NO: 19223 - RNA, 23 nt, Artificial Sequence
  Synthetic
gggaaaggaggaggacgcggagg

SEQ ID NO: 19224 - RNA, 24 nt, Artificial Sequence
  Synthetic
ggggaaaggaggaggacgcggagg

SEQ ID NO: 19225 - RNA, 18 nt, Artificial Sequence
  Synthetic
cgcgccgucgcgcuccgg

SEQ ID NO: 19226 - RNA, 19 nt, Artificial Sequence
  Synthetic
ccgcgccgucgcgcuccgg

SEQ ID NO: 19227 - RNA, 20 nt, Artificial Sequence
  Synthetic
uccgcgccgucgcgcuccgg

SEQ ID NO: 19228 - RNA, 21 nt, Artificial Sequence
  Synthetic
uuccgcgccgucgcgcuccgg

SEQ ID NO: 19229 - RNA, 22 nt, Artificial Sequence
  Synthetic
cuuccgcgccgucgcgcuccgg

SEQ ID NO: 19230 - RNA, 23 nt, Artificial Sequence
  Synthetic
ucuuccgcgccgucgcgcuccgg

SEQ ID NO: 19231 - RNA, 24 nt, Artificial Sequence
  Synthetic
uucuuccgcgccgucgcgcuccgg

SEQ ID NO: 19232 - RNA, 18 nt, Artificial Sequence
  Synthetic
gaaaggaggaggacgcgg

SEQ ID NO: 19233 - RNA, 19 nt, Artificial Sequence
  Synthetic
ggaaaggaggaggacgcgg

SEQ ID NO: 19234 - RNA, 20 nt, Artificial Sequence
  Synthetic
gggaaaggaggaggacgcgg

SEQ ID NO: 19235 - RNA, 21 nt, Artificial Sequence
  Synthetic
ggggaaaggaggaggacgcgg

SEQ ID NO: 19236 - RNA, 22 nt, Artificial Sequence
  Synthetic
gggggaaaggaggaggacgcgg

SEQ ID NO: 19237 - RNA, 23 nt, Artificial Sequence
  Synthetic
ggggggaaaggaggaggacgcgg

SEQ ID NO: 19238 - RNA, 24 nt, Artificial Sequence
  Synthetic
cggggggaaaggaggaggacgcgg

SEQ ID NO: 19239 - RNA, 18 nt, Artificial Sequence
  Synthetic
cauggaggggguccgcgg

SEQ ID NO: 19240 - RNA, 19 nt, Artificial Sequence
  Synthetic
gcauggaggggguccgcgg

SEQ ID NO: 19241 - RNA, 20 nt, Artificial Sequence
  Synthetic
cgcauggaggggguccgcgg

SEQ ID NO: 19242 - RNA, 21 nt, Artificial Sequence
  Synthetic
gcgcauggaggggguccgcgg

SEQ ID NO: 19243 - RNA, 22 nt, Artificial Sequence
  Synthetic
cgcgcauggaggggguccgcgg

SEQ ID NO: 19244 - RNA, 23 nt, Artificial Sequence
  Synthetic
gcgcgcauggaggggguccgcgg

SEQ ID NO: 19245 - RNA, 24 nt, Artificial Sequence
  Synthetic
ggcgcgcauggaggggguccgcgg

SEQ ID NO: 19246 - RNA, 18 nt, Artificial Sequence
  Synthetic
cgaacccgggccgcgcgg

SEQ ID NO: 19247 - RNA, 19 nt, Artificial Sequence
  Synthetic
ccgaacccgggccgcgcgg

SEQ ID NO: 19248 - RNA, 20 nt, Artificial Sequence
  Synthetic
cccgaacccgggccgcgcgg

SEQ ID NO: 19249 - RNA, 21 nt, Artificial Sequence
  Synthetic
acccgaacccgggccgcgcgg

SEQ ID NO: 19250 - RNA, 22 nt, Artificial Sequence
  Synthetic
cacccgaacccgggccgcgcgg

SEQ ID NO: 19251 - RNA, 23 nt, Artificial Sequence
  Synthetic
ccacccgaacccgggccgcgcgg

SEQ ID NO: 19252 - RNA, 24 nt, Artificial Sequence
  Synthetic
gccacccgaacccgggccgcgcgg

SEQ ID NO: 19253 - RNA, 18 nt, Artificial Sequence
  Synthetic
augagacccucgucgcgg

SEQ ID NO: 19254 - RNA, 19 nt, Artificial Sequence
  Synthetic
aaugagacccucgucgcgg

SEQ ID NO: 19255 - RNA, 20 nt, Artificial Sequence
  Synthetic
uaaugagacccucgucgcgg

SEQ ID NO: 19256 - RNA, 21 nt, Artificial Sequence
  Synthetic
cuaaugagacccucgucgcgg

SEQ ID NO: 19257 - RNA, 22 nt, Artificial Sequence
  Synthetic
gcuaaugagacccucgucgcgg

SEQ ID NO: 19258 - RNA, 23 nt, Artificial Sequence
  Synthetic
ugcuaaugagacccucgucgcgg

SEQ ID NO: 19259 - RNA, 24 nt, Artificial Sequence
  Synthetic
augcuaaugagacccucgucgcgg

SEQ ID NO: 19260 - RNA, 18 nt, Artificial Sequence
  Synthetic
ucggggcgcgcggggcgg

SEQ ID NO: 19261 - RNA, 19 nt, Artificial Sequence
  Synthetic
cucggggcgcgcggggcgg

SEQ ID NO: 19262 - RNA, 20 nt, Artificial Sequence
  Synthetic
ccucggggcgcgcggggcgg

SEQ ID NO: 19263 - RNA, 21 nt, Artificial Sequence
  Synthetic
uccucggggcgcgcggggcgg

SEQ ID NO: 19264 - RNA, 22 nt, Artificial Sequence
  Synthetic
guccucggggcgcgcggggcgg

SEQ ID NO: 19265 - RNA, 23 nt, Artificial Sequence
  Synthetic
aguccucggggcgcgcggggcgg

SEQ ID NO: 19266 - RNA, 24 nt, Artificial Sequence
  Synthetic
uaguccucggggcgcgcggggcgg

SEQ ID NO: 19267 - RNA, 18 nt, Artificial Sequence
  Synthetic
uccgaccggggugugcgg

SEQ ID NO: 19268 - RNA, 19 nt, Artificial Sequence
  Synthetic
cuccgaccggggugugcgg

SEQ ID NO: 19269 - RNA, 20 nt, Artificial Sequence
  Synthetic
ccuccgaccggggugugcgg

SEQ ID NO: 19270 - RNA, 18 nt, Artificial Sequence
  Synthetic
gcgccgucgcgcuccggg

SEQ ID NO: 19271 - RNA, 19 nt, Artificial Sequence
  Synthetic
cgcgccgucgcgcuccggg

SEQ ID NO: 19272 - RNA, 20 nt, Artificial Sequence
  Synthetic
ccgcgccgucgcgcuccggg

SEQ ID NO: 19273 - RNA, 21 nt, Artificial Sequence
  Synthetic
uccgcgccgucgcgcuccggg

SEQ ID NO: 19274 - RNA, 22 nt, Artificial Sequence
  Synthetic
uuccgcgccgucgcgcuccggg

SEQ ID NO: 19275 - RNA, 23 nt, Artificial Sequence
  Synthetic
cuuccgcgccgucgcgcuccggg

SEQ ID NO: 19276 - RNA, 24 nt, Artificial Sequence
  Synthetic
ucuuccgcgccgucgcgcuccggg

SEQ ID NO: 19277 - RNA, 18 nt, Artificial Sequence
  Synthetic
guccucggggcgcgcggg

SEQ ID NO: 19278 - RNA, 19 nt, Artificial Sequence
  Synthetic
aguccucggggcgcgcggg

SEQ ID NO: 19279 - RNA, 20 nt, Artificial Sequence
  Synthetic
uaguccucggggcgcgcggg

SEQ ID NO: 19280 - RNA, 21 nt, Artificial Sequence
  Synthetic
auaguccucggggcgcgcggg

SEQ ID NO: 19281 - RNA, 22 nt, Artificial Sequence
  Synthetic
uauaguccucggggcgcgcggg

SEQ ID NO: 19282 - RNA, 23 nt, Artificial Sequence
  Synthetic
auauaguccucggggcgcgcggg

SEQ ID NO: 19283 - RNA, 24 nt, Artificial Sequence
  Synthetic
gauauaguccucggggcgcgcggg

SEQ ID NO: 19284 - RNA, 18 nt, Artificial Sequence
  Synthetic
cggggcgcgcggggcggg

SEQ ID NO: 19285 - RNA, 19 nt, Artificial Sequence
  Synthetic
ucggggcgcgcggggcggg

SEQ ID NO: 19286 - RNA, 20 nt, Artificial Sequence
  Synthetic
cucggggcgcgcggggcggg

SEQ ID NO: 19287 - RNA, 21 nt, Artificial Sequence
  Synthetic
ccucggggcgcgcggggcggg

SEQ ID NO: 19288 - RNA, 22 nt, Artificial Sequence
  Synthetic
uccucggggcgcgcggggcggg

SEQ ID NO: 19289 - RNA, 23 nt, Artificial Sequence
  Synthetic
guccucggggcgcgcggggcggg

SEQ ID NO: 19290 - RNA, 24 nt, Artificial Sequence
  Synthetic
aguccucggggcgcgcggggcggg

SEQ ID NO: 19291 - RNA, 18 nt, Artificial Sequence
  Synthetic
ccgaccggggugugcggg

SEQ ID NO: 19292 - RNA, 19 nt, Artificial Sequence
  Synthetic
uccgaccggggugugcggg

SEQ ID NO: 19293 - RNA, 20 nt, Artificial Sequence
  Synthetic
cuccgaccggggugugcggg

SEQ ID NO: 19294 - RNA, 18 nt, Artificial Sequence
  Synthetic
cgacgguccggguucggg

SEQ ID NO: 19295 - RNA, 19 nt, Artificial Sequence
  Synthetic
gcgacgguccggguucggg

SEQ ID NO: 19296 - RNA, 20 nt, Artificial Sequence
  Synthetic
ggcgacgguccggguucggg

SEQ ID NO: 19297 - RNA, 21 nt, Artificial Sequence
  Synthetic
gggcgacgguccggguucggg

SEQ ID NO: 19298 - RNA, 22 nt, Artificial Sequence
  Synthetic
ggggcgacgguccggguucggg

SEQ ID NO: 19299 - RNA, 23 nt, Artificial Sequence
  Synthetic
cggggcgacgguccggguucggg

SEQ ID NO: 19300 - RNA, 24 nt, Artificial Sequence
  Synthetic
gcggggcgacgguccggguucggg

SEQ ID NO: 19301 - RNA, 18 nt, Artificial Sequence
  Synthetic
uccucggggcgcgcgggg

SEQ ID NO: 19302 - RNA, 19 nt, Artificial Sequence
  Synthetic
guccucggggcgcgcgggg

SEQ ID NO: 19303 - RNA, 20 nt, Artificial Sequence
  Synthetic
aguccucggggcgcgcgggg

SEQ ID NO: 19304 - RNA, 21 nt, Artificial Sequence
  Synthetic
uaguccucggggcgcgcgggg

SEQ ID NO: 19305 - RNA, 22 nt, Artificial Sequence
  Synthetic
auaguccucggggcgcgcgggg

SEQ ID NO: 19306 - RNA, 23 nt, Artificial Sequence
  Synthetic
uauaguccucggggcgcgcgggg

SEQ ID NO: 19307 - RNA, 24 nt, Artificial Sequence
  Synthetic
auauaguccucggggcgcgcgggg

SEQ ID NO: 19308 - RNA, 18 nt, Artificial Sequence
  Synthetic
uucaggggcggcaguggg

SEQ ID NO: 19309 - RNA, 19 nt, Artificial Sequence
  Synthetic
cuucaggggcggcaguggg

SEQ ID NO: 19310 - RNA, 20 nt, Artificial Sequence
  Synthetic
ucuucaggggcggcaguggg

SEQ ID NO: 19311 - RNA, 21 nt, Artificial Sequence
  Synthetic
uucuucaggggcggcaguggg

SEQ ID NO: 19312 - RNA, 22 nt, Artificial Sequence
  Synthetic
cuucuucaggggcggcaguggg

SEQ ID NO: 19313 - RNA, 23 nt, Artificial Sequence
  Synthetic
ucuucuucaggggcggcaguggg

SEQ ID NO: 19314 - RNA, 24 nt, Artificial Sequence
  Synthetic
uucuucuucaggggcggcaguggg

SEQ ID NO: 19315 - RNA, 18 nt, Artificial Sequence
  Synthetic
cauaaucggcgcgcaugg

SEQ ID NO: 19316 - RNA, 19 nt, Artificial Sequence
  Synthetic
ccauaaucggcgcgcaugg

SEQ ID NO: 19317 - RNA, 20 nt, Artificial Sequence
  Synthetic
gccauaaucggcgcgcaugg

SEQ ID NO: 19318 - RNA, 21 nt, Artificial Sequence
  Synthetic
cgccauaaucggcgcgcaugg

SEQ ID NO: 19319 - RNA, 22 nt, Artificial Sequence
  Synthetic
ucgccauaaucggcgcgcaugg

SEQ ID NO: 19320 - RNA, 23 nt, Artificial Sequence
  Synthetic
cucgccauaaucggcgcgcaugg

SEQ ID NO: 19321 - RNA, 24 nt, Artificial Sequence
  Synthetic
ccucgccauaaucggcgcgcaugg

SEQ ID NO: 19322 - RNA, 18 nt, Artificial Sequence
  Synthetic
cuucaggggcggcagugg

SEQ ID NO: 19323 - RNA, 19 nt, Artificial Sequence
  Synthetic
ucuucaggggcggcagugg

SEQ ID NO: 19324 - RNA, 20 nt, Artificial Sequence
  Synthetic
uucuucaggggcggcagugg

SEQ ID NO: 19325 - RNA, 21 nt, Artificial Sequence
  Synthetic
cuucuucaggggcggcagugg

SEQ ID NO: 19326 - RNA, 22 nt, Artificial Sequence
  Synthetic
ucuucuucaggggcggcagugg

SEQ ID NO: 19327 - RNA, 23 nt, Artificial Sequence
  Synthetic
uucuucuucaggggcggcagugg

SEQ ID NO: 19328 - RNA, 24 nt, Artificial Sequence
  Synthetic
cuucuucuucaggggcggcagugg

SEQ ID NO: 19329 - RNA, 18 nt, Artificial Sequence
  Synthetic
ccauaaucggcgcgcaug

SEQ ID NO: 19330 - RNA, 19 nt, Artificial Sequence
  Synthetic
gccauaaucggcgcgcaug

SEQ ID NO: 19331 - RNA, 20 nt, Artificial Sequence
  Synthetic
cgccauaaucggcgcgcaug

SEQ ID NO: 19332 - RNA, 21 nt, Artificial Sequence
  Synthetic
ucgccauaaucggcgcgcaug

SEQ ID NO: 19333 - RNA, 22 nt, Artificial Sequence
  Synthetic
cucgccauaaucggcgcgcaug

SEQ ID NO: 19334 - RNA, 23 nt, Artificial Sequence
  Synthetic
ccucgccauaaucggcgcgcaug

SEQ ID NO: 19335 - RNA, 24 nt, Artificial Sequence
  Synthetic
uccucgccauaaucggcgcgcaug

SEQ ID NO: 19336 - RNA, 18 nt, Artificial Sequence
  Synthetic
ucuucaggggcggcagug

SEQ ID NO: 19337 - RNA, 19 nt, Artificial Sequence
  Synthetic
uucuucaggggcggcagug

SEQ ID NO: 19338 - RNA, 20 nt, Artificial Sequence
  Synthetic
cuucuucaggggcggcagug

SEQ ID NO: 19339 - RNA, 21 nt, Artificial Sequence
  Synthetic
ucuucuucaggggcggcagug

SEQ ID NO: 19340 - RNA, 22 nt, Artificial Sequence
  Synthetic
uucuucuucaggggcggcagug

SEQ ID NO: 19341 - RNA, 23 nt, Artificial Sequence
  Synthetic
cuucuucuucaggggcggcagug

SEQ ID NO: 19342 - RNA, 24 nt, Artificial Sequence
  Synthetic
ucuucuucuucaggggcggcagug

SEQ ID NO: 19343 - RNA, 18 nt, Artificial Sequence
  Synthetic
ucggcuggauccggagau

SEQ ID NO: 19344 - RNA, 19 nt, Artificial Sequence
  Synthetic
gucggcuggauccggagau

SEQ ID NO: 19345 - RNA, 20 nt, Artificial Sequence
  Synthetic
cgucggcuggauccggagau

SEQ ID NO: 19346 - RNA, 21 nt, Artificial Sequence
  Synthetic
ccgucggcuggauccggagau

SEQ ID NO: 19347 - RNA, 22 nt, Artificial Sequence
  Synthetic
uccgucggcuggauccggagau

SEQ ID NO: 19348 - RNA, 23 nt, Artificial Sequence
  Synthetic
guccgucggcuggauccggagau

SEQ ID NO: 19349 - RNA, 24 nt, Artificial Sequence
  Synthetic
gguccgucggcuggauccggagau

SEQ ID NO: 19350 - RNA, 18 nt, Artificial Sequence
  Synthetic
gcgguccgucggcuggau

SEQ ID NO: 19351 - RNA, 19 nt, Artificial Sequence
  Synthetic
ggcgguccgucggcuggau

SEQ ID NO: 19352 - RNA, 20 nt, Artificial Sequence
  Synthetic
cggcgguccgucggcuggau

SEQ ID NO: 19353 - RNA, 21 nt, Artificial Sequence
  Synthetic
gcggcgguccgucggcuggau

SEQ ID NO: 19354 - RNA, 22 nt, Artificial Sequence
  Synthetic
ggcggcgguccgucggcuggau

SEQ ID NO: 19355 - RNA, 23 nt, Artificial Sequence
  Synthetic
gggcggcgguccgucggcuggau

SEQ ID NO: 19356 - RNA, 24 nt, Artificial Sequence
  Synthetic
ugggcggcgguccgucggcuggau

SEQ ID NO: 19357 - RNA, 18 nt, Artificial Sequence
  Synthetic
ccuggcugauauaguccu

SEQ ID NO: 19358 - RNA, 19 nt, Artificial Sequence
  Synthetic
gccuggcugauauaguccu

SEQ ID NO: 19359 - RNA, 20 nt, Artificial Sequence
  Synthetic
cgccuggcugauauaguccu

SEQ ID NO: 19360 - RNA, 21 nt, Artificial Sequence
  Synthetic
ucgccuggcugauauaguccu

SEQ ID NO: 19361 - RNA, 22 nt, Artificial Sequence
  Synthetic
gucgccuggcugauauaguccu

SEQ ID NO: 19362 - RNA, 23 nt, Artificial Sequence
  Synthetic
cgucgccuggcugauauaguccu

SEQ ID NO: 19363 - RNA, 24 nt, Artificial Sequence
  Synthetic
ccgucgccuggcugauauaguccu

SEQ ID NO: 19364 - RNA, 18 nt, Artificial Sequence
  Synthetic
cuuccgcgccgucgcgcu

SEQ ID NO: 19365 - RNA, 19 nt, Artificial Sequence
  Synthetic
ucuuccgcgccgucgcgcu

SEQ ID NO: 19366 - RNA, 20 nt, Artificial Sequence
  Synthetic
uucuuccgcgccgucgcgcu

SEQ ID NO: 19367 - RNA, 21 nt, Artificial Sequence
  Synthetic
cuucuuccgcgccgucgcgcu

SEQ ID NO: 19368 - RNA, 22 nt, Artificial Sequence
  Synthetic
ucuucuuccgcgccgucgcgcu

SEQ ID NO: 19369 - RNA, 23 nt, Artificial Sequence
  Synthetic
uucuucuuccgcgccgucgcgcu

SEQ ID NO: 19370 - RNA, 24 nt, Artificial Sequence
  Synthetic
cuucuucuuccgcgccgucgcgcu

SEQ ID NO: 19371 - RNA, 18 nt, Artificial Sequence
  Synthetic
uucuucaggggcggcagu

SEQ ID NO: 19372 - RNA, 19 nt, Artificial Sequence
  Synthetic
cuucuucaggggcggcagu

SEQ ID NO: 19373 - RNA, 20 nt, Artificial Sequence
  Synthetic
ucuucuucaggggcggcagu

SEQ ID NO: 19374 - RNA, 21 nt, Artificial Sequence
  Synthetic
uucuucuucaggggcggcagu

SEQ ID NO: 19375 - RNA, 22 nt, Artificial Sequence
  Synthetic
cuucuucuucaggggcggcagu

SEQ ID NO: 19376 - RNA, 23 nt, Artificial Sequence
  Synthetic
ucuucuucuucaggggcggcagu

SEQ ID NO: 19377 - RNA, 24 nt, Artificial Sequence
  Synthetic
uucuucuucuucaggggcggcagu

SEQ ID NO: 19378 - RNA, 18 nt, Artificial Sequence
  Synthetic
ucgguagccgcgcuccgu

SEQ ID NO: 19379 - RNA, 19 nt, Artificial Sequence
  Synthetic
gucgguagccgcgcuccgu

SEQ ID NO: 19380 - RNA, 20 nt, Artificial Sequence
  Synthetic
cgucgguagccgcgcuccgu

SEQ ID NO: 19381 - RNA, 21 nt, Artificial Sequence
  Synthetic
gcgucgguagccgcgcuccgu

SEQ ID NO: 19382 - RNA, 22 nt, Artificial Sequence
  Synthetic
cgcgucgguagccgcgcuccgu

SEQ ID NO: 19383 - RNA, 23 nt, Artificial Sequence
  Synthetic
ccgcgucgguagccgcgcuccgu

SEQ ID NO: 19384 - RNA, 24 nt, Artificial Sequence
  Synthetic
gccgcgucgguagccgcgcuccgu

SEQ ID NO: 19385 - RNA, 18 nt, Artificial Sequence
  Synthetic
ggggggcgacgggaucgu

SEQ ID NO: 19386 - RNA, 19 nt, Artificial Sequence
  Synthetic
gggggggcgacgggaucgu

SEQ ID NO: 19387 - RNA, 20 nt, Artificial Sequence
  Synthetic
ggggggggcgacgggaucgu

SEQ ID NO: 19388 - RNA, 21 nt, Artificial Sequence
  Synthetic
cggggggggcgacgggaucgu

SEQ ID NO: 19389 - RNA, 22 nt, Artificial Sequence
  Synthetic
ccggggggggcgacgggaucgu

SEQ ID NO: 19390 - RNA, 23 nt, Artificial Sequence
  Synthetic
uccggggggggcgacgggaucgu

SEQ ID NO: 19391 - RNA, 24 nt, Artificial Sequence
  Synthetic
cuccggggggggcgacgggaucgu

SEQ ID NO: 19392 - RNA, 18 nt, Artificial Sequence
  Synthetic
cggggcgacgguccgggu

SEQ ID NO: 19393 - RNA, 19 nt, Artificial Sequence
  Synthetic
gcggggcgacgguccgggu

SEQ ID NO: 19394 - RNA, 20 nt, Artificial Sequence
  Synthetic
ggcggggcgacgguccgggu

SEQ ID NO: 19395 - RNA, 21 nt, Artificial Sequence
  Synthetic
cggcggggcgacgguccgggu

SEQ ID NO: 19396 - RNA, 22 nt, Artificial Sequence
  Synthetic
gcggcggggcgacgguccgggu

SEQ ID NO: 19397 - RNA, 23 nt, Artificial Sequence
  Synthetic
cgcggcggggcgacgguccgggu

SEQ ID NO: 19398 - RNA, 24 nt, Artificial Sequence
  Synthetic
gcgcggcggggcgacgguccgggu

SEQ ID NO: 19399 - RNA, 18 nt, Artificial Sequence
  Synthetic
gcucgcuccccugcccuu

SEQ ID NO: 19400 - RNA, 19 nt, Artificial Sequence
  Synthetic
ggcucgcuccccugcccuu

SEQ ID NO: 19401 - RNA, 20 nt, Artificial Sequence
  Synthetic
gggcucgcuccccugcccuu

SEQ ID NO: 19402 - RNA, 21 nt, Artificial Sequence
  Synthetic
cgggcucgcuccccugcccuu

SEQ ID NO: 19403 - RNA, 22 nt, Artificial Sequence
  Synthetic
gcgggcucgcuccccugcccuu

SEQ ID NO: 19404 - RNA, 23 nt, Artificial Sequence
  Synthetic
ggcgggcucgcuccccugcccuu

SEQ ID NO: 19405 - RNA, 24 nt, Artificial Sequence
  Synthetic
gggcgggcucgcuccccugcccuu

SEQ ID NO: 19406 - RNA, 18 nt, Artificial Sequence
  Synthetic
ggucuucuucuucuucuu

SEQ ID NO: 19407 - RNA, 19 nt, Artificial Sequence
  Synthetic
gggucuucuucuucuucuu

SEQ ID NO: 19408 - RNA, 20 nt, Artificial Sequence
  Synthetic
ggggucuucuucuucuucuu

SEQ ID NO: 19409 - RNA, 21 nt, Artificial Sequence
  Synthetic
gggggucuucuucuucuucuu

SEQ ID NO: 19410 - RNA, 22 nt, Artificial Sequence
  Synthetic
ggggggucuucuucuucuucuu

SEQ ID NO: 19411 - RNA, 23 nt, Artificial Sequence
  Synthetic
gggggggucuucuucuucuucuu

SEQ ID NO: 19412 - RNA, 24 nt, Artificial Sequence
  Synthetic
ggggggggucuucuucuucuucuu

SEQ ID NO: 19413 - RNA, 18 nt, Artificial Sequence
  Synthetic
uuagcaucgcgggcggaa

SEQ ID NO: 19414 - RNA, 19 nt, Artificial Sequence
  Synthetic
auuagcaucgcgggcggaa

SEQ ID NO: 19415 - RNA, 20 nt, Artificial Sequence
  Synthetic
cauuagcaucgcgggcggaa

SEQ ID NO: 19416 - RNA, 21 nt, Artificial Sequence
  Synthetic
ucauuagcaucgcgggcggaa

SEQ ID NO: 19417 - RNA, 22 nt, Artificial Sequence
  Synthetic
cucauuagcaucgcgggcggaa

SEQ ID NO: 19418 - RNA, 23 nt, Artificial Sequence
  Synthetic
ucucauuagcaucgcgggcggaa

SEQ ID NO: 19419 - RNA, 24 nt, Artificial Sequence
  Synthetic
gucucauuagcaucgcgggcggaa

SEQ ID NO: 19420 - RNA, 18 nt, Artificial Sequence
  Synthetic
acggggcgaucguccaca

SEQ ID NO: 19421 - RNA, 19 nt, Artificial Sequence
  Synthetic
gacggggcgaucguccaca

SEQ ID NO: 19422 - RNA, 20 nt, Artificial Sequence
  Synthetic
cgacggggcgaucguccaca

SEQ ID NO: 19423 - RNA, 21 nt, Artificial Sequence
  Synthetic
gcgacggggcgaucguccaca

SEQ ID NO: 19424 - RNA, 22 nt, Artificial Sequence
  Synthetic
ggcgacggggcgaucguccaca

SEQ ID NO: 19425 - RNA, 23 nt, Artificial Sequence
  Synthetic
aggcgacggggcgaucguccaca

SEQ ID NO: 19426 - RNA, 24 nt, Artificial Sequence
  Synthetic
caggcgacggggcgaucguccaca

SEQ ID NO: 19427 - RNA, 18 nt, Artificial Sequence
  Synthetic
ccggcggcggcgcgacca

SEQ ID NO: 19428 - RNA, 19 nt, Artificial Sequence
  Synthetic
gccggcggcggcgcgacca

SEQ ID NO: 19429 - RNA, 20 nt, Artificial Sequence
  Synthetic
agccggcggcggcgcgacca

SEQ ID NO: 19430 - RNA, 21 nt, Artificial Sequence
  Synthetic
gagccggcggcggcgcgacca

SEQ ID NO: 19431 - RNA, 22 nt, Artificial Sequence
  Synthetic
ggagccggcggcggcgcgacca

SEQ ID NO: 19432 - RNA, 23 nt, Artificial Sequence
  Synthetic
cggagccggcggcggcgcgacca

SEQ ID NO: 19433 - RNA, 24 nt, Artificial Sequence
  Synthetic
gcggagccggcggcggcgcgacca

SEQ ID NO: 19434 - RNA, 18 nt, Artificial Sequence
  Synthetic
gcacacgcacgcaccgca

SEQ ID NO: 19435 - RNA, 19 nt, Artificial Sequence
  Synthetic
ggcacacgcacgcaccgca

SEQ ID NO: 19436 - RNA, 20 nt, Artificial Sequence
  Synthetic
aggcacacgcacgcaccgca

SEQ ID NO: 19437 - RNA, 21 nt, Artificial Sequence
  Synthetic
caggcacacgcacgcaccgca

SEQ ID NO: 19438 - RNA, 22 nt, Artificial Sequence
  Synthetic
acaggcacacgcacgcaccgca

SEQ ID NO: 19439 - RNA, 23 nt, Artificial Sequence
  Synthetic
cacaggcacacgcacgcaccgca

SEQ ID NO: 19440 - RNA, 24 nt, Artificial Sequence
  Synthetic
acacaggcacacgcacgcaccgca

SEQ ID NO: 19441 - RNA, 18 nt, Artificial Sequence
  Synthetic
acggugggccggaggaga

SEQ ID NO: 19442 - RNA, 19 nt, Artificial Sequence
  Synthetic
cacggugggccggaggaga

SEQ ID NO: 19443 - RNA, 20 nt, Artificial Sequence
  Synthetic
gcacggugggccggaggaga

SEQ ID NO: 19444 - RNA, 21 nt, Artificial Sequence
  Synthetic
ggcacggugggccggaggaga

SEQ ID NO: 19445 - RNA, 22 nt, Artificial Sequence
  Synthetic
uggcacggugggccggaggaga

SEQ ID NO: 19446 - RNA, 23 nt, Artificial Sequence
  Synthetic
guggcacggugggccggaggaga

SEQ ID NO: 19447 - RNA, 24 nt, Artificial Sequence
  Synthetic
gguggcacggugggccggaggaga

SEQ ID NO: 19448 - RNA, 18 nt, Artificial Sequence
  Synthetic
acuauaucagccaggcga

SEQ ID NO: 19449 - RNA, 19 nt, Artificial Sequence
  Synthetic
gacuauaucagccaggcga

SEQ ID NO: 19450 - RNA, 20 nt, Artificial Sequence
  Synthetic
ggacuauaucagccaggcga

SEQ ID NO: 19451 - RNA, 21 nt, Artificial Sequence
  Synthetic
aggacuauaucagccaggcga

SEQ ID NO: 19452 - RNA, 22 nt, Artificial Sequence
  Synthetic
gaggacuauaucagccaggcga

SEQ ID NO: 19453 - RNA, 23 nt, Artificial Sequence
  Synthetic
cgaggacuauaucagccaggcga

SEQ ID NO: 19454 - RNA, 24 nt, Artificial Sequence
  Synthetic
ccgaggacuauaucagccaggcga

SEQ ID NO: 19455 - RNA, 18 nt, Artificial Sequence
  Synthetic
cgcgauggcggacgagga

SEQ ID NO: 19456 - RNA, 19 nt, Artificial Sequence
  Synthetic
ucgcgauggcggacgagga

SEQ ID NO: 19457 - RNA, 20 nt, Artificial Sequence
  Synthetic
gucgcgauggcggacgagga

SEQ ID NO: 19458 - RNA, 21 nt, Artificial Sequence
  Synthetic
ggucgcgauggcggacgagga

SEQ ID NO: 19459 - RNA, 22 nt, Artificial Sequence
  Synthetic
aggucgcgauggcggacgagga

SEQ ID NO: 19460 - RNA, 23 nt, Artificial Sequence
  Synthetic
gaggucgcgauggcggacgagga

SEQ ID NO: 19461 - RNA, 24 nt, Artificial Sequence
  Synthetic
cgaggucgcgauggcggacgagga

SEQ ID NO: 19462 - RNA, 18 nt, Artificial Sequence
  Synthetic
cgcaccgcacggggggga

SEQ ID NO: 19463 - RNA, 19 nt, Artificial Sequence
  Synthetic
acgcaccgcacggggggga

SEQ ID NO: 19464 - RNA, 20 nt, Artificial Sequence
  Synthetic
cacgcaccgcacggggggga

SEQ ID NO: 19465 - RNA, 21 nt, Artificial Sequence
  Synthetic
gcacgcaccgcacggggggga

SEQ ID NO: 19466 - RNA, 22 nt, Artificial Sequence
  Synthetic
cgcacgcaccgcacggggggga

SEQ ID NO: 19467 - RNA, 23 nt, Artificial Sequence
  Synthetic
acgcacgcaccgcacggggggga

SEQ ID NO: 19468 - RNA, 24 nt, Artificial Sequence
  Synthetic
cacgcacgcaccgcacggggggga

SEQ ID NO: 19469 - RNA, 18 nt, Artificial Sequence
  Synthetic
cgcccgcgccgggcgcua

SEQ ID NO: 19470 - RNA, 19 nt, Artificial Sequence
  Synthetic
ccgcccgcgccgggcgcua

SEQ ID NO: 19471 - RNA, 20 nt, Artificial Sequence
  Synthetic
gccgcccgcgccgggcgcua

SEQ ID NO: 19472 - RNA, 21 nt, Artificial Sequence
  Synthetic
agccgcccgcgccgggcgcua

SEQ ID NO: 19473 - RNA, 22 nt, Artificial Sequence
  Synthetic
aagccgcccgcgccgggcgcua

SEQ ID NO: 19474 - RNA, 23 nt, Artificial Sequence
  Synthetic
gaagccgcccgcgccgggcgcua

SEQ ID NO: 19475 - RNA, 24 nt, Artificial Sequence
  Synthetic
ggaagccgcccgcgccgggcgcua

SEQ ID NO: 19476 - RNA, 18 nt, Artificial Sequence
  Synthetic
ccgccgcccaccccgaac

SEQ ID NO: 19477 - RNA, 19 nt, Artificial Sequence
  Synthetic
accgccgcccaccccgaac

SEQ ID NO: 19478 - RNA, 20 nt, Artificial Sequence
  Synthetic
gaccgccgcccaccccgaac

SEQ ID NO: 19479 - RNA, 21 nt, Artificial Sequence
  Synthetic
ggaccgccgcccaccccgaac

SEQ ID NO: 19480 - RNA, 22 nt, Artificial Sequence
  Synthetic
cggaccgccgcccaccccgaac

SEQ ID NO: 19481 - RNA, 23 nt, Artificial Sequence
  Synthetic
acggaccgccgcccaccccgaac

SEQ ID NO: 19482 - RNA, 24 nt, Artificial Sequence
  Synthetic
gacggaccgccgcccaccccgaac

SEQ ID NO: 19483 - RNA, 18 nt, Artificial Sequence
  Synthetic
gacggggcgaucguccac

SEQ ID NO: 19484 - RNA, 19 nt, Artificial Sequence
  Synthetic
cgacggggcgaucguccac

SEQ ID NO: 19485 - RNA, 20 nt, Artificial Sequence
  Synthetic
gcgacggggcgaucguccac

SEQ ID NO: 19486 - RNA, 21 nt, Artificial Sequence
  Synthetic
ggcgacggggcgaucguccac

SEQ ID NO: 19487 - RNA, 22 nt, Artificial Sequence
  Synthetic
aggcgacggggcgaucguccac

SEQ ID NO: 19488 - RNA, 23 nt, Artificial Sequence
  Synthetic
caggcgacggggcgaucguccac

SEQ ID NO: 19489 - RNA, 24 nt, Artificial Sequence
  Synthetic
ccaggcgacggggcgaucguccac

SEQ ID NO: 19490 - RNA, 18 nt, Artificial Sequence
  Synthetic
cgcauaaugcgguuccac

SEQ ID NO: 19491 - RNA, 19 nt, Artificial Sequence
  Synthetic
gcgcauaaugcgguuccac

SEQ ID NO: 19492 - RNA, 20 nt, Artificial Sequence
  Synthetic
cgcgcauaaugcgguuccac

SEQ ID NO: 19493 - RNA, 21 nt, Artificial Sequence
  Synthetic
ccgcgcauaaugcgguuccac

SEQ ID NO: 19494 - RNA, 22 nt, Artificial Sequence
  Synthetic
gccgcgcauaaugcgguuccac

SEQ ID NO: 19495 - RNA, 23 nt, Artificial Sequence
  Synthetic
ggccgcgcauaaugcgguuccac

SEQ ID NO: 19496 - RNA, 24 nt, Artificial Sequence
  Synthetic
gggccgcgcauaaugcgguuccac

SEQ ID NO: 19497 - RNA, 18 nt, Artificial Sequence
  Synthetic
cacacgcacgcaccgcac

SEQ ID NO: 19498 - RNA, 19 nt, Artificial Sequence
  Synthetic
gcacacgcacgcaccgcac

SEQ ID NO: 19499 - RNA, 20 nt, Artificial Sequence
  Synthetic
ggcacacgcacgcaccgcac

SEQ ID NO: 19500 - RNA, 21 nt, Artificial Sequence
  Synthetic
aggcacacgcacgcaccgcac

SEQ ID NO: 19501 - RNA, 22 nt, Artificial Sequence
  Synthetic
caggcacacgcacgcaccgcac

SEQ ID NO: 19502 - RNA, 23 nt, Artificial Sequence
  Synthetic
acaggcacacgcacgcaccgcac

SEQ ID NO: 19503 - RNA, 24 nt, Artificial Sequence
  Synthetic
cacaggcacacgcacgcaccgcac

SEQ ID NO: 19504 - RNA, 18 nt, Artificial Sequence
  Synthetic
gcgauggcggacgaggac

SEQ ID NO: 19505 - RNA, 19 nt, Artificial Sequence
  Synthetic
cgcgauggcggacgaggac

SEQ ID NO: 19506 - RNA, 20 nt, Artificial Sequence
  Synthetic
ucgcgauggcggacgaggac

SEQ ID NO: 19507 - RNA, 21 nt, Artificial Sequence
  Synthetic
gucgcgauggcggacgaggac

SEQ ID NO: 19508 - RNA, 22 nt, Artificial Sequence
  Synthetic
ggucgcgauggcggacgaggac

SEQ ID NO: 19509 - RNA, 23 nt, Artificial Sequence
  Synthetic
aggucgcgauggcggacgaggac

SEQ ID NO: 19510 - RNA, 24 nt, Artificial Sequence
  Synthetic
gaggucgcgauggcggacgaggac

SEQ ID NO: 19511 - RNA, 18 nt, Artificial Sequence
  Synthetic
cgggccgccgccacggac

SEQ ID NO: 19512 - RNA, 19 nt, Artificial Sequence
  Synthetic
acgggccgccgccacggac

SEQ ID NO: 19513 - RNA, 20 nt, Artificial Sequence
  Synthetic
aacgggccgccgccacggac

SEQ ID NO: 19514 - RNA, 21 nt, Artificial Sequence
  Synthetic
caacgggccgccgccacggac

SEQ ID NO: 19515 - RNA, 22 nt, Artificial Sequence
  Synthetic
ccaacgggccgccgccacggac

SEQ ID NO: 19516 - RNA, 23 nt, Artificial Sequence
  Synthetic
accaacgggccgccgccacggac

SEQ ID NO: 19517 - RNA, 24 nt, Artificial Sequence
  Synthetic
gaccaacgggccgccgccacggac

SEQ ID NO: 19518 - RNA, 18 nt, Artificial Sequence
  Synthetic
gaggucgcgauggcggac

SEQ ID NO: 19519 - RNA, 19 nt, Artificial Sequence
  Synthetic
cgaggucgcgauggcggac

SEQ ID NO: 19520 - RNA, 20 nt, Artificial Sequence
  Synthetic
ccgaggucgcgauggcggac

SEQ ID NO: 19521 - RNA, 21 nt, Artificial Sequence
  Synthetic
gccgaggucgcgauggcggac

SEQ ID NO: 19522 - RNA, 22 nt, Artificial Sequence
  Synthetic
ggccgaggucgcgauggcggac

SEQ ID NO: 19523 - RNA, 23 nt, Artificial Sequence
  Synthetic
gggccgaggucgcgauggcggac

SEQ ID NO: 19524 - RNA, 24 nt, Artificial Sequence
  Synthetic
ggggccgaggucgcgauggcggac

SEQ ID NO: 19525 - RNA, 18 nt, Artificial Sequence
  Synthetic
gacggaccgccgcccacc

SEQ ID NO: 19526 - RNA, 19 nt, Artificial Sequence
  Synthetic
cgacggaccgccgcccacc

SEQ ID NO: 19527 - RNA, 20 nt, Artificial Sequence
  Synthetic
ccgacggaccgccgcccacc

SEQ ID NO: 19528 - RNA, 21 nt, Artificial Sequence
  Synthetic
gccgacggaccgccgcccacc

SEQ ID NO: 19529 - RNA, 22 nt, Artificial Sequence
  Synthetic
agccgacggaccgccgcccacc

SEQ ID NO: 19530 - RNA, 23 nt, Artificial Sequence
  Synthetic
cagccgacggaccgccgcccacc

SEQ ID NO: 19531 - RNA, 24 nt, Artificial Sequence
  Synthetic
ccagccgacggaccgccgcccacc

SEQ ID NO: 19532 - RNA, 18 nt, Artificial Sequence
  Synthetic
gcauaaugcgguuccacc

SEQ ID NO: 19533 - RNA, 19 nt, Artificial Sequence
  Synthetic
cgcauaaugcgguuccacc

SEQ ID NO: 19534 - RNA, 20 nt, Artificial Sequence
  Synthetic
gcgcauaaugcgguuccacc

SEQ ID NO: 19535 - RNA, 21 nt, Artificial Sequence
  Synthetic
cgcgcauaaugcgguuccacc

SEQ ID NO: 19536 - RNA, 22 nt, Artificial Sequence
  Synthetic
ccgcgcauaaugcgguuccacc

SEQ ID NO: 19537 - RNA, 23 nt, Artificial Sequence
  Synthetic
gccgcgcauaaugcgguuccacc

SEQ ID NO: 19538 - RNA, 24 nt, Artificial Sequence
  Synthetic
ggccgcgcauaaugcgguuccacc

SEQ ID NO: 19539 - RNA, 18 nt, Artificial Sequence
  Synthetic
cgaucccgucgccccccc

SEQ ID NO: 19540 - RNA, 19 nt, Artificial Sequence
  Synthetic
acgaucccgucgccccccc

SEQ ID NO: 19541 - RNA, 20 nt, Artificial Sequence
  Synthetic
cacgaucccgucgccccccc

SEQ ID NO: 19542 - RNA, 21 nt, Artificial Sequence
  Synthetic
gcacgaucccgucgccccccc

SEQ ID NO: 19543 - RNA, 22 nt, Artificial Sequence
  Synthetic
cgcacgaucccgucgccccccc

SEQ ID NO: 19544 - RNA, 23 nt, Artificial Sequence
  Synthetic
ucgcacgaucccgucgccccccc

SEQ ID NO: 19545 - RNA, 24 nt, Artificial Sequence
  Synthetic
uucgcacgaucccgucgccccccc

SEQ ID NO: 19546 - RNA, 18 nt, Artificial Sequence
  Synthetic
acgaucccgucgcccccc

SEQ ID NO: 19547 - RNA, 19 nt, Artificial Sequence
  Synthetic
cacgaucccgucgcccccc

SEQ ID NO: 19548 - RNA, 20 nt, Artificial Sequence
  Synthetic
gcacgaucccgucgcccccc

SEQ ID NO: 19549 - RNA, 21 nt, Artificial Sequence
  Synthetic
cgcacgaucccgucgcccccc

SEQ ID NO: 19550 - RNA, 22 nt, Artificial Sequence
  Synthetic
ucgcacgaucccgucgcccccc

SEQ ID NO: 19551 - RNA, 23 nt, Artificial Sequence
  Synthetic
uucgcacgaucccgucgcccccc

SEQ ID NO: 19552 - RNA, 24 nt, Artificial Sequence
  Synthetic
guucgcacgaucccgucgcccccc

SEQ ID NO: 19553 - RNA, 18 nt, Artificial Sequence
  Synthetic
ccccgccccgcgcgcccc

SEQ ID NO: 19554 - RNA, 19 nt, Artificial Sequence
  Synthetic
cccccgccccgcgcgcccc

SEQ ID NO: 19555 - RNA, 20 nt, Artificial Sequence
  Synthetic
ccccccgccccgcgcgcccc

SEQ ID NO: 19556 - RNA, 21 nt, Artificial Sequence
  Synthetic
uccccccgccccgcgcgcccc

SEQ ID NO: 19557 - RNA, 22 nt, Artificial Sequence
  Synthetic
uuccccccgccccgcgcgcccc

SEQ ID NO: 19558 - RNA, 23 nt, Artificial Sequence
  Synthetic
uuuccccccgccccgcgcgcccc

SEQ ID NO: 19559 - RNA, 24 nt, Artificial Sequence
  Synthetic
cuuuccccccgccccgcgcgcccc

SEQ ID NO: 19560 - RNA, 18 nt, Artificial Sequence
  Synthetic
ccccccccacugccgccc

SEQ ID NO: 19561 - RNA, 19 nt, Artificial Sequence
  Synthetic
cccccccccacugccgccc

SEQ ID NO: 19562 - RNA, 20 nt, Artificial Sequence
  Synthetic
acccccccccacugccgccc

SEQ ID NO: 19563 - RNA, 21 nt, Artificial Sequence
  Synthetic
cacccccccccacugccgccc

SEQ ID NO: 19564 - RNA, 22 nt, Artificial Sequence
  Synthetic
ccacccccccccacugccgccc

SEQ ID NO: 19565 - RNA, 23 nt, Artificial Sequence
  Synthetic
accacccccccccacugccgccc

SEQ ID NO: 19566 - RNA, 24 nt, Artificial Sequence
  Synthetic
aaccacccccccccacugccgccc

SEQ ID NO: 19567 - RNA, 18 nt, Artificial Sequence
  Synthetic
gaccaacgggccgccgcc

SEQ ID NO: 19568 - RNA, 19 nt, Artificial Sequence
  Synthetic
cgaccaacgggccgccgcc

SEQ ID NO: 19569 - RNA, 20 nt, Artificial Sequence
  Synthetic
gcgaccaacgggccgccgcc

SEQ ID NO: 19570 - RNA, 21 nt, Artificial Sequence
  Synthetic
cgcgaccaacgggccgccgcc

SEQ ID NO: 19571 - RNA, 22 nt, Artificial Sequence
  Synthetic
gcgcgaccaacgggccgccgcc

SEQ ID NO: 19572 - RNA, 23 nt, Artificial Sequence
  Synthetic
ggcgcgaccaacgggccgccgcc

SEQ ID NO: 19573 - RNA, 24 nt, Artificial Sequence
  Synthetic
cggcgcgaccaacgggccgccgcc

SEQ ID NO: 19574 - RNA, 18 nt, Artificial Sequence
  Synthetic
ccgcucgccuucuccgcc

SEQ ID NO: 19575 - RNA, 19 nt, Artificial Sequence
  Synthetic
cccgcucgccuucuccgcc

SEQ ID NO: 19576 - RNA, 20 nt, Artificial Sequence
  Synthetic
gcccgcucgccuucuccgcc

SEQ ID NO: 19577 - RNA, 21 nt, Artificial Sequence
  Synthetic
ggcccgcucgccuucuccgcc

SEQ ID NO: 19578 - RNA, 22 nt, Artificial Sequence
  Synthetic
cggcccgcucgccuucuccgcc

SEQ ID NO: 19579 - RNA, 23 nt, Artificial Sequence
  Synthetic
gcggcccgcucgccuucuccgcc

SEQ ID NO: 19580 - RNA, 24 nt, Artificial Sequence
  Synthetic
agcggcccgcucgccuucuccgcc

SEQ ID NO: 19581 - RNA, 18 nt, Artificial Sequence
  Synthetic
ccccccgccccgcgcgcc

SEQ ID NO: 19582 - RNA, 19 nt, Artificial Sequence
  Synthetic
uccccccgccccgcgcgcc

SEQ ID NO: 19583 - RNA, 20 nt, Artificial Sequence
  Synthetic
uuccccccgccccgcgcgcc

SEQ ID NO: 19584 - RNA, 21 nt, Artificial Sequence
  Synthetic
uuuccccccgccccgcgcgcc

SEQ ID NO: 19585 - RNA, 22 nt, Artificial Sequence
  Synthetic
cuuuccccccgccccgcgcgcc

SEQ ID NO: 19586 - RNA, 23 nt, Artificial Sequence
  Synthetic
ccuuuccccccgccccgcgcgcc

SEQ ID NO: 19587 - RNA, 24 nt, Artificial Sequence
  Synthetic
uccuuuccccccgccccgcgcgcc

SEQ ID NO: 19588 - RNA, 18 nt, Artificial Sequence
  Synthetic
cgacgacgacgcagggcc

SEQ ID NO: 19589 - RNA, 19 nt, Artificial Sequence
  Synthetic
acgacgacgacgcagggcc

SEQ ID NO: 19590 - RNA, 20 nt, Artificial Sequence
  Synthetic
gacgacgacgacgcagggcc

SEQ ID NO: 19591 - RNA, 21 nt, Artificial Sequence
  Synthetic
cgacgacgacgacgcagggcc

SEQ ID NO: 19592 - RNA, 22 nt, Artificial Sequence
  Synthetic
acgacgacgacgacgcagggcc

SEQ ID NO: 19593 - RNA, 23 nt, Artificial Sequence
  Synthetic
gacgacgacgacgacgcagggcc

SEQ ID NO: 19594 - RNA, 24 nt, Artificial Sequence
  Synthetic
agacgacgacgacgacgcagggcc

SEQ ID NO: 19595 - RNA, 18 nt, Artificial Sequence
  Synthetic
gccgucgacgagccugcc

SEQ ID NO: 19596 - RNA, 19 nt, Artificial Sequence
  Synthetic
ggccgucgacgagccugcc

SEQ ID NO: 19597 - RNA, 20 nt, Artificial Sequence
  Synthetic
aggccgucgacgagccugcc

SEQ ID NO: 19598 - RNA, 21 nt, Artificial Sequence
  Synthetic
gaggccgucgacgagccugcc

SEQ ID NO: 19599 - RNA, 22 nt, Artificial Sequence
  Synthetic
ggaggccgucgacgagccugcc

SEQ ID NO: 19600 - RNA, 23 nt, Artificial Sequence
  Synthetic
gggaggccgucgacgagccugcc

SEQ ID NO: 19601 - RNA, 24 nt, Artificial Sequence
  Synthetic
ggggaggccgucgacgagccugcc

SEQ ID NO: 19602 - RNA, 18 nt, Artificial Sequence
  Synthetic
gaggcggccccggcgucc

SEQ ID NO: 19603 - RNA, 19 nt, Artificial Sequence
  Synthetic
cgaggcggccccggcgucc

SEQ ID NO: 19604 - RNA, 20 nt, Artificial Sequence
  Synthetic
acgaggcggccccggcgucc

SEQ ID NO: 19605 - RNA, 21 nt, Artificial Sequence
  Synthetic
gacgaggcggccccggcgucc

SEQ ID NO: 19606 - RNA, 22 nt, Artificial Sequence
  Synthetic
cgacgaggcggccccggcgucc

SEQ ID NO: 19607 - RNA, 23 nt, Artificial Sequence
  Synthetic
ccgacgaggcggccccggcgucc

SEQ ID NO: 19608 - RNA, 24 nt, Artificial Sequence
  Synthetic
gccgacgaggcggccccggcgucc

SEQ ID NO: 19609 - RNA, 18 nt, Artificial Sequence
  Synthetic
ggcggaaccccggcgagc

SEQ ID NO: 19610 - RNA, 19 nt, Artificial Sequence
  Synthetic
gggcggaaccccggcgagc

SEQ ID NO: 19611 - RNA, 20 nt, Artificial Sequence
  Synthetic
ggggcggaaccccggcgagc

SEQ ID NO: 19612 - RNA, 21 nt, Artificial Sequence
  Synthetic
gggggcggaaccccggcgagc

SEQ ID NO: 19613 - RNA, 22 nt, Artificial Sequence
  Synthetic
ugggggcggaaccccggcgagc

SEQ ID NO: 19614 - RNA, 23 nt, Artificial Sequence
  Synthetic
cugggggcggaaccccggcgagc

SEQ ID NO: 19615 - RNA, 24 nt, Artificial Sequence
  Synthetic
ccugggggcggaaccccggcgagc

SEQ ID NO: 19616 - RNA, 18 nt, Artificial Sequence
  Synthetic
cgccacggacgcggacgc

SEQ ID NO: 19617 - RNA, 19 nt, Artificial Sequence
  Synthetic
ccgccacggacgcggacgc

SEQ ID NO: 19618 - RNA, 20 nt, Artificial Sequence
  Synthetic
gccgccacggacgcggacgc

SEQ ID NO: 19619 - RNA, 21 nt, Artificial Sequence
  Synthetic
cgccgccacggacgcggacgc

SEQ ID NO: 19620 - RNA, 22 nt, Artificial Sequence
  Synthetic
ccgccgccacggacgcggacgc

SEQ ID NO: 19621 - RNA, 23 nt, Artificial Sequence
  Synthetic
gccgccgccacggacgcggacgc

SEQ ID NO: 19622 - RNA, 24 nt, Artificial Sequence
  Synthetic
ggccgccgccacggacgcggacgc

SEQ ID NO: 19623 - RNA, 18 nt, Artificial Sequence
  Synthetic
ggcacacgcacgcaccgc

SEQ ID NO: 19624 - RNA, 19 nt, Artificial Sequence
  Synthetic
aggcacacgcacgcaccgc

SEQ ID NO: 19625 - RNA, 20 nt, Artificial Sequence
  Synthetic
caggcacacgcacgcaccgc

SEQ ID NO: 19626 - RNA, 21 nt, Artificial Sequence
  Synthetic
acaggcacacgcacgcaccgc

SEQ ID NO: 19627 - RNA, 22 nt, Artificial Sequence
  Synthetic
cacaggcacacgcacgcaccgc

SEQ ID NO: 19628 - RNA, 23 nt, Artificial Sequence
  Synthetic
acacaggcacacgcacgcaccgc

SEQ ID NO: 19629 - RNA, 24 nt, Artificial Sequence
  Synthetic
gacacaggcacacgcacgcaccgc

SEQ ID NO: 19630 - RNA, 18 nt, Artificial Sequence
  Synthetic
gcgcuaaugagaugccgc

SEQ ID NO: 19631 - RNA, 19 nt, Artificial Sequence
  Synthetic
ggcgcuaaugagaugccgc

SEQ ID NO: 19632 - RNA, 20 nt, Artificial Sequence
  Synthetic
gggcgcuaaugagaugccgc

SEQ ID NO: 19633 - RNA, 21 nt, Artificial Sequence
  Synthetic
cgggcgcuaaugagaugccgc

SEQ ID NO: 19634 - RNA, 22 nt, Artificial Sequence
  Synthetic
ccgggcgcuaaugagaugccgc

SEQ ID NO: 19635 - RNA, 23 nt, Artificial Sequence
  Synthetic
gccgggcgcuaaugagaugccgc

SEQ ID NO: 19636 - RNA, 24 nt, Artificial Sequence
  Synthetic
cgccgggcgcuaaugagaugccgc

SEQ ID NO: 19637 - RNA, 18 nt, Artificial Sequence
  Synthetic
cccccggagcgcgacggc

SEQ ID NO: 19638 - RNA, 19 nt, Artificial Sequence
  Synthetic
ccccccggagcgcgacggc

SEQ ID NO: 19639 - RNA, 20 nt, Artificial Sequence
  Synthetic
cccccccggagcgcgacggc

SEQ ID NO: 19640 - RNA, 21 nt, Artificial Sequence
  Synthetic
ccccccccggagcgcgacggc

SEQ ID NO: 19641 - RNA, 22 nt, Artificial Sequence
  Synthetic
gccccccccggagcgcgacggc

SEQ ID NO: 19642 - RNA, 23 nt, Artificial Sequence
  Synthetic
cgccccccccggagcgcgacggc

SEQ ID NO: 19643 - RNA, 24 nt, Artificial Sequence
  Synthetic
ucgccccccccggagcgcgacggc

SEQ ID NO: 19644 - RNA, 18 nt, Artificial Sequence
  Synthetic
aggaucuacccgaucggc

SEQ ID NO: 19645 - RNA, 19 nt, Artificial Sequence
  Synthetic
caggaucuacccgaucggc

SEQ ID NO: 19646 - RNA, 20 nt, Artificial Sequence
  Synthetic
ccaggaucuacccgaucggc

SEQ ID NO: 19647 - RNA, 21 nt, Artificial Sequence
  Synthetic
gccaggaucuacccgaucggc

SEQ ID NO: 19648 - RNA, 22 nt, Artificial Sequence
  Synthetic
cgccaggaucuacccgaucggc

SEQ ID NO: 19649 - RNA, 23 nt, Artificial Sequence
  Synthetic
ccgccaggaucuacccgaucggc

SEQ ID NO: 19650 - RNA, 24 nt, Artificial Sequence
  Synthetic
gccgccaggaucuacccgaucggc

SEQ ID NO: 19651 - RNA, 18 nt, Artificial Sequence
  Synthetic
ucggguggcacggugggc

SEQ ID NO: 19652 - RNA, 19 nt, Artificial Sequence
  Synthetic
uucggguggcacggugggc

SEQ ID NO: 19653 - RNA, 20 nt, Artificial Sequence
  Synthetic
guucggguggcacggugggc

SEQ ID NO: 19654 - RNA, 21 nt, Artificial Sequence
  Synthetic
gguucggguggcacggugggc

SEQ ID NO: 19655 - RNA, 22 nt, Artificial Sequence
  Synthetic
ggguucggguggcacggugggc

SEQ ID NO: 19656 - RNA, 23 nt, Artificial Sequence
  Synthetic
cggguucggguggcacggugggc

SEQ ID NO: 19657 - RNA, 24 nt, Artificial Sequence
  Synthetic
ccggguucggguggcacggugggc

SEQ ID NO: 19658 - RNA, 18 nt, Artificial Sequence
  Synthetic
augcgcgccgauuauggc

SEQ ID NO: 19659 - RNA, 19 nt, Artificial Sequence
  Synthetic
caugcgcgccgauuauggc

SEQ ID NO: 19660 - RNA, 20 nt, Artificial Sequence
  Synthetic
ccaugcgcgccgauuauggc

SEQ ID NO: 19661 - RNA, 21 nt, Artificial Sequence
  Synthetic
uccaugcgcgccgauuauggc

SEQ ID NO: 19662 - RNA, 22 nt, Artificial Sequence
  Synthetic
cuccaugcgcgccgauuauggc

SEQ ID NO: 19663 - RNA, 23 nt, Artificial Sequence
  Synthetic
ccuccaugcgcgccgauuauggc

SEQ ID NO: 19664 - RNA, 24 nt, Artificial Sequence
  Synthetic
cccuccaugcgcgccgauuauggc

SEQ ID NO: 19665 - RNA, 18 nt, Artificial Sequence
  Synthetic
gagggucucauuagcauc

SEQ ID NO: 19666 - RNA, 19 nt, Artificial Sequence
  Synthetic
cgagggucucauuagcauc

SEQ ID NO: 19667 - RNA, 20 nt, Artificial Sequence
  Synthetic
acgagggucucauuagcauc

SEQ ID NO: 19668 - RNA, 21 nt, Artificial Sequence
  Synthetic
gacgagggucucauuagcauc

SEQ ID NO: 19669 - RNA, 22 nt, Artificial Sequence
  Synthetic
cgacgagggucucauuagcauc

SEQ ID NO: 19670 - RNA, 23 nt, Artificial Sequence
  Synthetic
gcgacgagggucucauuagcauc

SEQ ID NO: 19671 - RNA, 24 nt, Artificial Sequence
  Synthetic
cgcgacgagggucucauuagcauc

SEQ ID NO: 19672 - RNA, 18 nt, Artificial Sequence
  Synthetic
cgaggcggccccggcguc

SEQ ID NO: 19673 - RNA, 19 nt, Artificial Sequence
  Synthetic
acgaggcggccccggcguc

SEQ ID NO: 19674 - RNA, 20 nt, Artificial Sequence
  Synthetic
gacgaggcggccccggcguc

SEQ ID NO: 19675 - RNA, 21 nt, Artificial Sequence
  Synthetic
cgacgaggcggccccggcguc

SEQ ID NO: 19676 - RNA, 22 nt, Artificial Sequence
  Synthetic
ccgacgaggcggccccggcguc

SEQ ID NO: 19677 - RNA, 23 nt, Artificial Sequence
  Synthetic
gccgacgaggcggccccggcguc

SEQ ID NO: 19678 - RNA, 24 nt, Artificial Sequence
  Synthetic
ugccgacgaggcggccccggcguc

SEQ ID NO: 19679 - RNA, 18 nt, Artificial Sequence
  Synthetic
ccgccccugaagaagaag

SEQ ID NO: 19680 - RNA, 19 nt, Artificial Sequence
  Synthetic
gccgccccugaagaagaag

SEQ ID NO: 19681 - RNA, 20 nt, Artificial Sequence
  Synthetic
ugccgccccugaagaagaag

SEQ ID NO: 19682 - RNA, 21 nt, Artificial Sequence
  Synthetic
cugccgccccugaagaagaag

SEQ ID NO: 19683 - RNA, 22 nt, Artificial Sequence
  Synthetic
acugccgccccugaagaagaag

SEQ ID NO: 19684 - RNA, 23 nt, Artificial Sequence
  Synthetic
cacugccgccccugaagaagaag

SEQ ID NO: 19685 - RNA, 24 nt, Artificial Sequence
  Synthetic
ccacugccgccccugaagaagaag

SEQ ID NO: 19686 - RNA, 18 nt, Artificial Sequence
  Synthetic
gcggagcagcggaagaag

SEQ ID NO: 19687 - RNA, 19 nt, Artificial Sequence
  Synthetic
ggcggagcagcggaagaag

SEQ ID NO: 19688 - RNA, 20 nt, Artificial Sequence
  Synthetic
cggcggagcagcggaagaag

SEQ ID NO: 19689 - RNA, 21 nt, Artificial Sequence
  Synthetic
ucggcggagcagcggaagaag

SEQ ID NO: 19690 - RNA, 22 nt, Artificial Sequence
  Synthetic
gucggcggagcagcggaagaag

SEQ ID NO: 19691 - RNA, 23 nt, Artificial Sequence
  Synthetic
ugucggcggagcagcggaagaag

SEQ ID NO: 19692 - RNA, 24 nt, Artificial Sequence
  Synthetic
augucggcggagcagcggaagaag

SEQ ID NO: 19693 - RNA, 18 nt, Artificial Sequence
  Synthetic
cugccgccccugaagaag

SEQ ID NO: 19694 - RNA, 19 nt, Artificial Sequence
  Synthetic
acugccgccccugaagaag

SEQ ID NO: 19695 - RNA, 20 nt, Artificial Sequence
  Synthetic
cacugccgccccugaagaag

SEQ ID NO: 19696 - RNA, 21 nt, Artificial Sequence
  Synthetic
ccacugccgccccugaagaag

SEQ ID NO: 19697 - RNA, 22 nt, Artificial Sequence
  Synthetic
cccacugccgccccugaagaag

SEQ ID NO: 19698 - RNA, 23 nt, Artificial Sequence
  Synthetic
ccccacugccgccccugaagaag

SEQ ID NO: 19699 - RNA, 24 nt, Artificial Sequence
  Synthetic
cccccacugccgccccugaagaag

SEQ ID NO: 19700 - RNA, 18 nt, Artificial Sequence
  Synthetic
ggccggaggagaacgaag

SEQ ID NO: 19701 - RNA, 19 nt, Artificial Sequence
  Synthetic
gggccggaggagaacgaag

SEQ ID NO: 19702 - RNA, 20 nt, Artificial Sequence
  Synthetic
ugggccggaggagaacgaag

SEQ ID NO: 19703 - RNA, 21 nt, Artificial Sequence
  Synthetic
gugggccggaggagaacgaag

SEQ ID NO: 19704 - RNA, 22 nt, Artificial Sequence
  Synthetic
ggugggccggaggagaacgaag

SEQ ID NO: 19705 - RNA, 23 nt, Artificial Sequence
  Synthetic
cggugggccggaggagaacgaag

SEQ ID NO: 19706 - RNA, 24 nt, Artificial Sequence
  Synthetic
acggugggccggaggagaacgaag

SEQ ID NO: 19707 - RNA, 18 nt, Artificial Sequence
  Synthetic
ucggcggagcagcggaag

SEQ ID NO: 19708 - RNA, 19 nt, Artificial Sequence
  Synthetic
gucggcggagcagcggaag

SEQ ID NO: 19709 - RNA, 20 nt, Artificial Sequence
  Synthetic
ugucggcggagcagcggaag

SEQ ID NO: 19710 - RNA, 18 nt, Artificial Sequence
  Synthetic
agcgcgacggcgcggaag

SEQ ID NO: 19711 - RNA, 19 nt, Artificial Sequence
  Synthetic
gagcgcgacggcgcggaag

SEQ ID NO: 19712 - RNA, 20 nt, Artificial Sequence
  Synthetic
ggagcgcgacggcgcggaag

SEQ ID NO: 19713 - RNA, 21 nt, Artificial Sequence
  Synthetic
cggagcgcgacggcgcggaag

SEQ ID NO: 19714 - RNA, 22 nt, Artificial Sequence
  Synthetic
ccggagcgcgacggcgcggaag

SEQ ID NO: 19715 - RNA, 23 nt, Artificial Sequence
  Synthetic
cccggagcgcgacggcgcggaag

SEQ ID NO: 19716 - RNA, 24 nt, Artificial Sequence
  Synthetic
ccccggagcgcgacggcgcggaag

SEQ ID NO: 19717 - RNA, 18 nt, Artificial Sequence
  Synthetic
uagcaucgcgggcggaag

SEQ ID NO: 19718 - RNA, 19 nt, Artificial Sequence
  Synthetic
uuagcaucgcgggcggaag

SEQ ID NO: 19719 - RNA, 20 nt, Artificial Sequence
  Synthetic
auuagcaucgcgggcggaag

SEQ ID NO: 19720 - RNA, 21 nt, Artificial Sequence
  Synthetic
cauuagcaucgcgggcggaag

SEQ ID NO: 19721 - RNA, 22 nt, Artificial Sequence
  Synthetic
ucauuagcaucgcgggcggaag

SEQ ID NO: 19722 - RNA, 23 nt, Artificial Sequence
  Synthetic
cucauuagcaucgcgggcggaag

SEQ ID NO: 19723 - RNA, 24 nt, Artificial Sequence
  Synthetic
ucucauuagcaucgcgggcggaag

SEQ ID NO: 19724 - RNA, 18 nt, Artificial Sequence
  Synthetic
ccacugccgccccugaag

SEQ ID NO: 19725 - RNA, 19 nt, Artificial Sequence
  Synthetic
cccacugccgccccugaag

SEQ ID NO: 19726 - RNA, 20 nt, Artificial Sequence
  Synthetic
ccccacugccgccccugaag

SEQ ID NO: 19727 - RNA, 21 nt, Artificial Sequence
  Synthetic
cccccacugccgccccugaag

SEQ ID NO: 19728 - RNA, 22 nt, Artificial Sequence
  Synthetic
ccccccacugccgccccugaag

SEQ ID NO: 19729 - RNA, 23 nt, Artificial Sequence
  Synthetic
cccccccacugccgccccugaag

SEQ ID NO: 19730 - RNA, 24 nt, Artificial Sequence
  Synthetic
ccccccccacugccgccccugaag

SEQ ID NO: 19731 - RNA, 18 nt, Artificial Sequence
  Synthetic
cccgaucggcgcggagag

SEQ ID NO: 19732 - RNA, 19 nt, Artificial Sequence
  Synthetic
acccgaucggcgcggagag

SEQ ID NO: 19733 - RNA, 20 nt, Artificial Sequence
  Synthetic
uacccgaucggcgcggagag

SEQ ID NO: 19734 - RNA, 21 nt, Artificial Sequence
  Synthetic
cuacccgaucggcgcggagag

SEQ ID NO: 19735 - RNA, 22 nt, Artificial Sequence
  Synthetic
ucuacccgaucggcgcggagag

SEQ ID NO: 19736 - RNA, 23 nt, Artificial Sequence
  Synthetic
aucuacccgaucggcgcggagag

SEQ ID NO: 19737 - RNA, 24 nt, Artificial Sequence
  Synthetic
gaucuacccgaucggcgcggagag

SEQ ID NO: 19738 - RNA, 18 nt, Artificial Sequence
  Synthetic
gggcggaaccccggcgag

SEQ ID NO: 19739 - RNA, 19 nt, Artificial Sequence
  Synthetic
ggggcggaaccccggcgag

SEQ ID NO: 19740 - RNA, 20 nt, Artificial Sequence
  Synthetic
gggggcggaaccccggcgag

SEQ ID NO: 19741 - RNA, 21 nt, Artificial Sequence
  Synthetic
ugggggcggaaccccggcgag

SEQ ID NO: 19742 - RNA, 22 nt, Artificial Sequence
  Synthetic
cugggggcggaaccccggcgag

SEQ ID NO: 19743 - RNA, 23 nt, Artificial Sequence
  Synthetic
ccugggggcggaaccccggcgag

SEQ ID NO: 19744 - RNA, 24 nt, Artificial Sequence
  Synthetic
accugggggcggaaccccggcgag

SEQ ID NO: 19745 - RNA, 18 nt, Artificial Sequence
  Synthetic
cgcgccgauuauggcgag

SEQ ID NO: 19746 - RNA, 19 nt, Artificial Sequence
  Synthetic
gcgcgccgauuauggcgag

SEQ ID NO: 19747 - RNA, 20 nt, Artificial Sequence
  Synthetic
ugcgcgccgauuauggcgag

SEQ ID NO: 19748 - RNA, 21 nt, Artificial Sequence
  Synthetic
augcgcgccgauuauggcgag

SEQ ID NO: 19749 - RNA, 22 nt, Artificial Sequence
  Synthetic
caugcgcgccgauuauggcgag

SEQ ID NO: 19750 - RNA, 23 nt, Artificial Sequence
  Synthetic
ccaugcgcgccgauuauggcgag

SEQ ID NO: 19751 - RNA, 24 nt, Artificial Sequence
  Synthetic
uccaugcgcgccgauuauggcgag

SEQ ID NO: 19752 - RNA, 18 nt, Artificial Sequence
  Synthetic
uggcacggugggccggag

SEQ ID NO: 19753 - RNA, 19 nt, Artificial Sequence
  Synthetic
guggcacggugggccggag

SEQ ID NO: 19754 - RNA, 20 nt, Artificial Sequence
  Synthetic
gguggcacggugggccggag

SEQ ID NO: 19755 - RNA, 21 nt, Artificial Sequence
  Synthetic
ggguggcacggugggccggag

SEQ ID NO: 19756 - RNA, 22 nt, Artificial Sequence
  Synthetic
cggguggcacggugggccggag

SEQ ID NO: 19757 - RNA, 23 nt, Artificial Sequence
  Synthetic
ucggguggcacggugggccggag

SEQ ID NO: 19758 - RNA, 24 nt, Artificial Sequence
  Synthetic
uucggguggcacggugggccggag

SEQ ID NO: 19759 - RNA, 18 nt, Artificial Sequence
  Synthetic
acacgcacgcaccgcacg

SEQ ID NO: 19760 - RNA, 19 nt, Artificial Sequence
  Synthetic
cacacgcacgcaccgcacg

SEQ ID NO: 19761 - RNA, 20 nt, Artificial Sequence
  Synthetic
gcacacgcacgcaccgcacg

SEQ ID NO: 19762 - RNA, 21 nt, Artificial Sequence
  Synthetic
ggcacacgcacgcaccgcacg

SEQ ID NO: 19763 - RNA, 22 nt, Artificial Sequence
  Synthetic
aggcacacgcacgcaccgcacg

SEQ ID NO: 19764 - RNA, 23 nt, Artificial Sequence
  Synthetic
caggcacacgcacgcaccgcacg

SEQ ID NO: 19765 - RNA, 24 nt, Artificial Sequence
  Synthetic
acaggcacacgcacgcaccgcacg

SEQ ID NO: 19766 - RNA, 18 nt, Artificial Sequence
  Synthetic
ccggguucggguggcacg

SEQ ID NO: 19767 - RNA, 19 nt, Artificial Sequence
  Synthetic
cccggguucggguggcacg

SEQ ID NO: 19768 - RNA, 20 nt, Artificial Sequence
  Synthetic
gcccggguucggguggcacg

SEQ ID NO: 19769 - RNA, 21 nt, Artificial Sequence
  Synthetic
ggcccggguucggguggcacg

SEQ ID NO: 19770 - RNA, 22 nt, Artificial Sequence
  Synthetic
cggcccggguucggguggcacg

SEQ ID NO: 19771 - RNA, 23 nt, Artificial Sequence
  Synthetic
gcggcccggguucggguggcacg

SEQ ID NO: 19772 - RNA, 24 nt, Artificial Sequence
  Synthetic
cgcggcccggguucggguggcacg

SEQ ID NO: 19773 - RNA, 18 nt, Artificial Sequence
  Synthetic
aagacgacgacgacgacg

SEQ ID NO: 19774 - RNA, 19 nt, Artificial Sequence
  Synthetic
gaagacgacgacgacgacg

SEQ ID NO: 19775 - RNA, 20 nt, Artificial Sequence
  Synthetic
agaagacgacgacgacgacg

SEQ ID NO: 19776 - RNA, 21 nt, Artificial Sequence
  Synthetic
aagaagacgacgacgacgacg

SEQ ID NO: 19777 - RNA, 22 nt, Artificial Sequence
  Synthetic
gaagaagacgacgacgacgacg

SEQ ID NO: 19778 - RNA, 23 nt, Artificial Sequence
  Synthetic
agaagaagacgacgacgacgacg

SEQ ID NO: 19779 - RNA, 24 nt, Artificial Sequence
  Synthetic
aagaagaagacgacgacgacgacg

SEQ ID NO: 19780 - RNA, 18 nt, Artificial Sequence
  Synthetic
cgauggcggacgaggacg

SEQ ID NO: 19781 - RNA, 19 nt, Artificial Sequence
  Synthetic
gcgauggcggacgaggacg

SEQ ID NO: 19782 - RNA, 20 nt, Artificial Sequence
  Synthetic
cgcgauggcggacgaggacg

SEQ ID NO: 19783 - RNA, 21 nt, Artificial Sequence
  Synthetic
ucgcgauggcggacgaggacg

SEQ ID NO: 19784 - RNA, 22 nt, Artificial Sequence
  Synthetic
gucgcgauggcggacgaggacg

SEQ ID NO: 19785 - RNA, 23 nt, Artificial Sequence
  Synthetic
ggucgcgauggcggacgaggacg

SEQ ID NO: 19786 - RNA, 24 nt, Artificial Sequence
  Synthetic
aggucgcgauggcggacgaggacg

SEQ ID NO: 19787 - RNA, 18 nt, Artificial Sequence
  Synthetic
ccugggggcggaaccccg

SEQ ID NO: 19788 - RNA, 19 nt, Artificial Sequence
  Synthetic
accugggggcggaaccccg

SEQ ID NO: 19789 - RNA, 20 nt, Artificial Sequence
  Synthetic
caccugggggcggaaccccg

SEQ ID NO: 19790 - RNA, 21 nt, Artificial Sequence
  Synthetic
ccaccugggggcggaaccccg

SEQ ID NO: 19791 - RNA, 22 nt, Artificial Sequence
  Synthetic
uccaccugggggcggaaccccg

SEQ ID NO: 19792 - RNA, 23 nt, Artificial Sequence
  Synthetic
uuccaccugggggcggaaccccg

SEQ ID NO: 19793 - RNA, 24 nt, Artificial Sequence
  Synthetic
guuccaccugggggcggaaccccg

SEQ ID NO: 19794 - RNA, 18 nt, Artificial Sequence
  Synthetic
gaucuccggauccagccg

SEQ ID NO: 19795 - RNA, 19 nt, Artificial Sequence
  Synthetic
ggaucuccggauccagccg

SEQ ID NO: 19796 - RNA, 20 nt, Artificial Sequence
  Synthetic
cggaucuccggauccagccg

SEQ ID NO: 19797 - RNA, 21 nt, Artificial Sequence
  Synthetic
ccggaucuccggauccagccg

SEQ ID NO: 19798 - RNA, 22 nt, Artificial Sequence
  Synthetic
cccggaucuccggauccagccg

SEQ ID NO: 19799 - RNA, 23 nt, Artificial Sequence
  Synthetic
ccccggaucuccggauccagccg

SEQ ID NO: 19800 - RNA, 24 nt, Artificial Sequence
  Synthetic
gccccggaucuccggauccagccg

SEQ ID NO: 19801 - RNA, 18 nt, Artificial Sequence
  Synthetic
gacgacgacgcagggccg

SEQ ID NO: 19802 - RNA, 19 nt, Artificial Sequence
  Synthetic
cgacgacgacgcagggccg

SEQ ID NO: 19803 - RNA, 20 nt, Artificial Sequence
  Synthetic
acgacgacgacgcagggccg

SEQ ID NO: 19804 - RNA, 21 nt, Artificial Sequence
  Synthetic
gacgacgacgacgcagggccg

SEQ ID NO: 19805 - RNA, 22 nt, Artificial Sequence
  Synthetic
cgacgacgacgacgcagggccg

SEQ ID NO: 19806 - RNA, 23 nt, Artificial Sequence
  Synthetic
acgacgacgacgacgcagggccg

SEQ ID NO: 19807 - RNA, 24 nt, Artificial Sequence
  Synthetic
gacgacgacgacgacgcagggccg

SEQ ID NO: 19808 - RNA, 18 nt, Artificial Sequence
  Synthetic
ggguggcacggugggccg

SEQ ID NO: 19809 - RNA, 19 nt, Artificial Sequence
  Synthetic
cggguggcacggugggccg

SEQ ID NO: 19810 - RNA, 20 nt, Artificial Sequence
  Synthetic
ucggguggcacggugggccg

SEQ ID NO: 19811 - RNA, 21 nt, Artificial Sequence
  Synthetic
uucggguggcacggugggccg

SEQ ID NO: 19812 - RNA, 22 nt, Artificial Sequence
  Synthetic
guucggguggcacggugggccg

SEQ ID NO: 19813 - RNA, 23 nt, Artificial Sequence
  Synthetic
gguucggguggcacggugggccg

SEQ ID NO: 19814 - RNA, 24 nt, Artificial Sequence
  Synthetic
ggguucggguggcacggugggccg

SEQ ID NO: 19815 - RNA, 18 nt, Artificial Sequence
  Synthetic
ccgccgaugccgaugccg

SEQ ID NO: 19816 - RNA, 19 nt, Artificial Sequence
  Synthetic
gccgccgaugccgaugccg

SEQ ID NO: 19817 - RNA, 20 nt, Artificial Sequence
  Synthetic
cgccgccgaugccgaugccg

SEQ ID NO: 19818 - RNA, 21 nt, Artificial Sequence
  Synthetic
ccgccgccgaugccgaugccg

SEQ ID NO: 19819 - RNA, 22 nt, Artificial Sequence
  Synthetic
gccgccgccgaugccgaugccg

SEQ ID NO: 19820 - RNA, 23 nt, Artificial Sequence
  Synthetic
cgccgccgccgaugccgaugccg

SEQ ID NO: 19821 - RNA, 24 nt, Artificial Sequence
  Synthetic
acgccgccgccgaugccgaugccg

SEQ ID NO: 19822 - RNA, 18 nt, Artificial Sequence
  Synthetic
aggcggccccggcguccg

SEQ ID NO: 19823 - RNA, 19 nt, Artificial Sequence
  Synthetic
gaggcggccccggcguccg

SEQ ID NO: 19824 - RNA, 20 nt, Artificial Sequence
  Synthetic
cgaggcggccccggcguccg

SEQ ID NO: 19825 - RNA, 21 nt, Artificial Sequence
  Synthetic
acgaggcggccccggcguccg

SEQ ID NO: 19826 - RNA, 22 nt, Artificial Sequence
  Synthetic
gacgaggcggccccggcguccg

SEQ ID NO: 19827 - RNA, 23 nt, Artificial Sequence
  Synthetic
cgacgaggcggccccggcguccg

SEQ ID NO: 19828 - RNA, 24 nt, Artificial Sequence
  Synthetic
ccgacgaggcggccccggcguccg

SEQ ID NO: 19829 - RNA, 18 nt, Artificial Sequence
  Synthetic
ggagcgagcccgcccgcg

SEQ ID NO: 19830 - RNA, 19 nt, Artificial Sequence
  Synthetic
gggagcgagcccgcccgcg

SEQ ID NO: 19831 - RNA, 20 nt, Artificial Sequence
  Synthetic
ggggagcgagcccgcccgcg

SEQ ID NO: 19832 - RNA, 21 nt, Artificial Sequence
  Synthetic
aggggagcgagcccgcccgcg

SEQ ID NO: 19833 - RNA, 22 nt, Artificial Sequence
  Synthetic
caggggagcgagcccgcccgcg

SEQ ID NO: 19834 - RNA, 23 nt, Artificial Sequence
  Synthetic
gcaggggagcgagcccgcccgcg

SEQ ID NO: 19835 - RNA, 24 nt, Artificial Sequence
  Synthetic
ggcaggggagcgagcccgcccgcg

SEQ ID NO: 19836 - RNA, 18 nt, Artificial Sequence
  Synthetic
aagcggaagccgcccgcg

SEQ ID NO: 19837 - RNA, 19 nt, Artificial Sequence
  Synthetic
gaagcggaagccgcccgcg

SEQ ID NO: 19838 - RNA, 20 nt, Artificial Sequence
  Synthetic
ggaagcggaagccgcccgcg

SEQ ID NO: 19839 - RNA, 21 nt, Artificial Sequence
  Synthetic
cggaagcggaagccgcccgcg

SEQ ID NO: 19840 - RNA, 22 nt, Artificial Sequence
  Synthetic
gcggaagcggaagccgcccgcg

SEQ ID NO: 19841 - RNA, 23 nt, Artificial Sequence
  Synthetic
ggcggaagcggaagccgcccgcg

SEQ ID NO: 19842 - RNA, 24 nt, Artificial Sequence
  Synthetic
gggcggaagcggaagccgcccgcg

SEQ ID NO: 19843 - RNA, 18 nt, Artificial Sequence
  Synthetic
ggacgucuccgggccgcg

SEQ ID NO: 19844 - RNA, 19 nt, Artificial Sequence
  Synthetic
gggacgucuccgggccgcg

SEQ ID NO: 19845 - RNA, 20 nt, Artificial Sequence
  Synthetic
ggggacgucuccgggccgcg

SEQ ID NO: 19846 - RNA, 21 nt, Artificial Sequence
  Synthetic
gggggacgucuccgggccgcg

SEQ ID NO: 19847 - RNA, 22 nt, Artificial Sequence
  Synthetic
cgggggacgucuccgggccgcg

SEQ ID NO: 19848 - RNA, 23 nt, Artificial Sequence
  Synthetic
acgggggacgucuccgggccgcg

SEQ ID NO: 19849 - RNA, 24 nt, Artificial Sequence
  Synthetic
gacgggggacgucuccgggccgcg

SEQ ID NO: 19850 - RNA, 18 nt, Artificial Sequence
  Synthetic
aucuacccgaucggcgcg

SEQ ID NO: 19851 - RNA, 19 nt, Artificial Sequence
  Synthetic
gaucuacccgaucggcgcg

SEQ ID NO: 19852 - RNA, 20 nt, Artificial Sequence
  Synthetic
ggaucuacccgaucggcgcg

SEQ ID NO: 19853 - RNA, 21 nt, Artificial Sequence
  Synthetic
aggaucuacccgaucggcgcg

SEQ ID NO: 19854 - RNA, 22 nt, Artificial Sequence
  Synthetic
caggaucuacccgaucggcgcg

SEQ ID NO: 19855 - RNA, 23 nt, Artificial Sequence
  Synthetic
ccaggaucuacccgaucggcgcg

SEQ ID NO: 19856 - RNA, 24 nt, Artificial Sequence
  Synthetic
gccaggaucuacccgaucggcgcg

SEQ ID NO: 19857 - RNA, 18 nt, Artificial Sequence
  Synthetic
gacuauaucagccaggcg

SEQ ID NO: 19858 - RNA, 19 nt, Artificial Sequence
  Synthetic
ggacuauaucagccaggcg

SEQ ID NO: 19859 - RNA, 20 nt, Artificial Sequence
  Synthetic
aggacuauaucagccaggcg

SEQ ID NO: 19860 - RNA, 21 nt, Artificial Sequence
  Synthetic
gaggacuauaucagccaggcg

SEQ ID NO: 19861 - RNA, 22 nt, Artificial Sequence
  Synthetic
cgaggacuauaucagccaggcg

SEQ ID NO: 19862 - RNA, 23 nt, Artificial Sequence
  Synthetic
ccgaggacuauaucagccaggcg

SEQ ID NO: 19863 - RNA, 24 nt, Artificial Sequence
  Synthetic
cccgaggacuauaucagccaggcg

SEQ ID NO: 19864 - RNA, 18 nt, Artificial Sequence
  Synthetic
ccccggagcgcgacggcg

SEQ ID NO: 19865 - RNA, 19 nt, Artificial Sequence
  Synthetic
cccccggagcgcgacggcg

SEQ ID NO: 19866 - RNA, 20 nt, Artificial Sequence
  Synthetic
ccccccggagcgcgacggcg

SEQ ID NO: 19867 - RNA, 21 nt, Artificial Sequence
  Synthetic
cccccccggagcgcgacggcg

SEQ ID NO: 19868 - RNA, 22 nt, Artificial Sequence
  Synthetic
ccccccccggagcgcgacggcg

SEQ ID NO: 19869 - RNA, 23 nt, Artificial Sequence
  Synthetic
gccccccccggagcgcgacggcg

SEQ ID NO: 19870 - RNA, 24 nt, Artificial Sequence
  Synthetic
cgccccccccggagcgcgacggcg

SEQ ID NO: 19871 - RNA, 18 nt, Artificial Sequence
  Synthetic
ggaucuacccgaucggcg

SEQ ID NO: 19872 - RNA, 19 nt, Artificial Sequence
  Synthetic
aggaucuacccgaucggcg

SEQ ID NO: 19873 - RNA, 20 nt, Artificial Sequence
  Synthetic
caggaucuacccgaucggcg

SEQ ID NO: 19874 - RNA, 21 nt, Artificial Sequence
  Synthetic
ccaggaucuacccgaucggcg

SEQ ID NO: 19875 - RNA, 22 nt, Artificial Sequence
  Synthetic
gccaggaucuacccgaucggcg

SEQ ID NO: 19876 - RNA, 23 nt, Artificial Sequence
  Synthetic
cgccaggaucuacccgaucggcg

SEQ ID NO: 19877 - RNA, 24 nt, Artificial Sequence
  Synthetic
ccgccaggaucuacccgaucggcg

SEQ ID NO: 19878 - RNA, 18 nt, Artificial Sequence
  Synthetic
gacgcggacgcgcgggcg

SEQ ID NO: 19879 - RNA, 19 nt, Artificial Sequence
  Synthetic
ggacgcggacgcgcgggcg

SEQ ID NO: 19880 - RNA, 20 nt, Artificial Sequence
  Synthetic
cggacgcggacgcgcgggcg

SEQ ID NO: 19881 - RNA, 21 nt, Artificial Sequence
  Synthetic
acggacgcggacgcgcgggcg

SEQ ID NO: 19882 - RNA, 22 nt, Artificial Sequence
  Synthetic
cacggacgcggacgcgcgggcg

SEQ ID NO: 19883 - RNA, 23 nt, Artificial Sequence
  Synthetic
ccacggacgcggacgcgcgggcg

SEQ ID NO: 19884 - RNA, 24 nt, Artificial Sequence
  Synthetic
gccacggacgcggacgcgcgggcg

SEQ ID NO: 19885 - RNA, 18 nt, Artificial Sequence
  Synthetic
ugcgcgccgauuauggcg

SEQ ID NO: 19886 - RNA, 19 nt, Artificial Sequence
  Synthetic
augcgcgccgauuauggcg

SEQ ID NO: 19887 - RNA, 20 nt, Artificial Sequence
  Synthetic
caugcgcgccgauuauggcg

SEQ ID NO: 19888 - RNA, 21 nt, Artificial Sequence
  Synthetic
ccaugcgcgccgauuauggcg

SEQ ID NO: 19889 - RNA, 22 nt, Artificial Sequence
  Synthetic
uccaugcgcgccgauuauggcg

SEQ ID NO: 19890 - RNA, 23 nt, Artificial Sequence
  Synthetic
cuccaugcgcgccgauuauggcg

SEQ ID NO: 19891 - RNA, 24 nt, Artificial Sequence
  Synthetic
ccuccaugcgcgccgauuauggcg

SEQ ID NO: 19892 - RNA, 18 nt, Artificial Sequence
  Synthetic
cguccggggaggccgucg

SEQ ID NO: 19893 - RNA, 19 nt, Artificial Sequence
  Synthetic
gcguccggggaggccgucg

SEQ ID NO: 19894 - RNA, 20 nt, Artificial Sequence
  Synthetic
ggcguccggggaggccgucg

SEQ ID NO: 19895 - RNA, 21 nt, Artificial Sequence
  Synthetic
cggcguccggggaggccgucg

SEQ ID NO: 19896 - RNA, 22 nt, Artificial Sequence
  Synthetic
ccggcguccggggaggccgucg

SEQ ID NO: 19897 - RNA, 23 nt, Artificial Sequence
  Synthetic
cccggcguccggggaggccgucg

SEQ ID NO: 19898 - RNA, 24 nt, Artificial Sequence
  Synthetic
ccccggcguccggggaggccgucg

SEQ ID NO: 19899 - RNA, 18 nt, Artificial Sequence
  Synthetic
ucgcgauggcggacgagg

SEQ ID NO: 19900 - RNA, 19 nt, Artificial Sequence
  Synthetic
gucgcgauggcggacgagg

SEQ ID NO: 19901 - RNA, 20 nt, Artificial Sequence
  Synthetic
ggucgcgauggcggacgagg

SEQ ID NO: 19902 - RNA, 21 nt, Artificial Sequence
  Synthetic
aggucgcgauggcggacgagg

SEQ ID NO: 19903 - RNA, 22 nt, Artificial Sequence
  Synthetic
gaggucgcgauggcggacgagg

SEQ ID NO: 19904 - RNA, 23 nt, Artificial Sequence
  Synthetic
cgaggucgcgauggcggacgagg

SEQ ID NO: 19905 - RNA, 24 nt, Artificial Sequence
  Synthetic
ccgaggucgcgauggcggacgagg

SEQ ID NO: 19906 - RNA, 18 nt, Artificial Sequence
  Synthetic
cacgcacgcaccgcacgg

SEQ ID NO: 19907 - RNA, 19 nt, Artificial Sequence
  Synthetic
acacgcacgcaccgcacgg

SEQ ID NO: 19908 - RNA, 20 nt, Artificial Sequence
  Synthetic
cacacgcacgcaccgcacgg

SEQ ID NO: 19909 - RNA, 21 nt, Artificial Sequence
  Synthetic
gcacacgcacgcaccgcacgg

SEQ ID NO: 19910 - RNA, 22 nt, Artificial Sequence
  Synthetic
ggcacacgcacgcaccgcacgg

SEQ ID NO: 19911 - RNA, 23 nt, Artificial Sequence
  Synthetic
aggcacacgcacgcaccgcacgg

SEQ ID NO: 19912 - RNA, 24 nt, Artificial Sequence
  Synthetic
caggcacacgcacgcaccgcacgg

SEQ ID NO: 19913 - RNA, 18 nt, Artificial Sequence
  Synthetic
cccccccgcacaccccgg

SEQ ID NO: 19914 - RNA, 19 nt, Artificial Sequence
  Synthetic
ccccccccgcacaccccgg

SEQ ID NO: 19915 - RNA, 20 nt, Artificial Sequence
  Synthetic
cccccccccgcacaccccgg

SEQ ID NO: 19916 - RNA, 21 nt, Artificial Sequence
  Synthetic
acccccccccgcacaccccgg

SEQ ID NO: 19917 - RNA, 22 nt, Artificial Sequence
  Synthetic
gacccccccccgcacaccccgg

SEQ ID NO: 19918 - RNA, 23 nt, Artificial Sequence
  Synthetic
agacccccccccgcacaccccgg

SEQ ID NO: 19919 - RNA, 24 nt, Artificial Sequence
  Synthetic
aagacccccccccgcacaccccgg

SEQ ID NO: 19920 - RNA, 18 nt, Artificial Sequence
  Synthetic
gguggcacggugggccgg

SEQ ID NO: 19921 - RNA, 19 nt, Artificial Sequence
  Synthetic
ggguggcacggugggccgg

SEQ ID NO: 19922 - RNA, 20 nt, Artificial Sequence
  Synthetic
cggguggcacggugggccgg

SEQ ID NO: 19923 - RNA, 21 nt, Artificial Sequence
  Synthetic
ucggguggcacggugggccgg

SEQ ID NO: 19924 - RNA, 22 nt, Artificial Sequence
  Synthetic
uucggguggcacggugggccgg

SEQ ID NO: 19925 - RNA, 23 nt, Artificial Sequence
  Synthetic
guucggguggcacggugggccgg

SEQ ID NO: 19926 - RNA, 24 nt, Artificial Sequence
  Synthetic
gguucggguggcacggugggccgg

SEQ ID NO: 19927 - RNA, 18 nt, Artificial Sequence
  Synthetic
gacgucuccgggccgcgg

SEQ ID NO: 19928 - RNA, 19 nt, Artificial Sequence
  Synthetic
ggacgucuccgggccgcgg

SEQ ID NO: 19929 - RNA, 20 nt, Artificial Sequence
  Synthetic
gggacgucuccgggccgcgg

SEQ ID NO: 19930 - RNA, 21 nt, Artificial Sequence
  Synthetic
ggggacgucuccgggccgcgg

SEQ ID NO: 19931 - RNA, 22 nt, Artificial Sequence
  Synthetic
gggggacgucuccgggccgcgg

SEQ ID NO: 19932 - RNA, 23 nt, Artificial Sequence
  Synthetic
cgggggacgucuccgggccgcgg

SEQ ID NO: 19933 - RNA, 24 nt, Artificial Sequence
  Synthetic
acgggggacgucuccgggccgcgg

SEQ ID NO: 19934 - RNA, 18 nt, Artificial Sequence
  Synthetic
uaaugagaugccgcgcgg

SEQ ID NO: 19935 - RNA, 19 nt, Artificial Sequence
  Synthetic
cuaaugagaugccgcgcgg

SEQ ID NO: 19936 - RNA, 20 nt, Artificial Sequence
  Synthetic
gcuaaugagaugccgcgcgg

SEQ ID NO: 19937 - RNA, 21 nt, Artificial Sequence
  Synthetic
cgcuaaugagaugccgcgcgg

SEQ ID NO: 19938 - RNA, 22 nt, Artificial Sequence
  Synthetic
gcgcuaaugagaugccgcgcgg

SEQ ID NO: 19939 - RNA, 23 nt, Artificial Sequence
  Synthetic
ggcgcuaaugagaugccgcgcgg

SEQ ID NO: 19940 - RNA, 24 nt, Artificial Sequence
  Synthetic
gggcgcuaaugagaugccgcgcgg

SEQ ID NO: 19941 - RNA, 18 nt, Artificial Sequence
  Synthetic
cggagcgcgacggcgcgg

SEQ ID NO: 19942 - RNA, 19 nt, Artificial Sequence
  Synthetic
ccggagcgcgacggcgcgg

SEQ ID NO: 19943 - RNA, 20 nt, Artificial Sequence
  Synthetic
cccggagcgcgacggcgcgg

SEQ ID NO: 19944 - RNA, 21 nt, Artificial Sequence
  Synthetic
ccccggagcgcgacggcgcgg

SEQ ID NO: 19945 - RNA, 22 nt, Artificial Sequence
  Synthetic
cccccggagcgcgacggcgcgg

SEQ ID NO: 19946 - RNA, 23 nt, Artificial Sequence
  Synthetic
ccccccggagcgcgacggcgcgg

SEQ ID NO: 19947 - RNA, 24 nt, Artificial Sequence
  Synthetic
cccccccggagcgcgacggcgcgg

SEQ ID NO: 19948 - RNA, 18 nt, Artificial Sequence
  Synthetic
gucucauuagcaucgcgg

SEQ ID NO: 19949 - RNA, 19 nt, Artificial Sequence
  Synthetic
ggucucauuagcaucgcgg

SEQ ID NO: 19950 - RNA, 20 nt, Artificial Sequence
  Synthetic
gggucucauuagcaucgcgg

SEQ ID NO: 19951 - RNA, 21 nt, Artificial Sequence
  Synthetic
agggucucauuagcaucgcgg

SEQ ID NO: 19952 - RNA, 22 nt, Artificial Sequence
  Synthetic
gagggucucauuagcaucgcgg

SEQ ID NO: 19953 - RNA, 23 nt, Artificial Sequence
  Synthetic
cgagggucucauuagcaucgcgg

SEQ ID NO: 19954 - RNA, 24 nt, Artificial Sequence
  Synthetic
acgagggucucauuagcaucgcgg

SEQ ID NO: 19955 - RNA, 18 nt, Artificial Sequence
  Synthetic
ccgaggucgcgauggcgg

SEQ ID NO: 19956 - RNA, 19 nt, Artificial Sequence
  Synthetic
gccgaggucgcgauggcgg

SEQ ID NO: 19957 - RNA, 20 nt, Artificial Sequence
  Synthetic
ggccgaggucgcgauggcgg

SEQ ID NO: 19958 - RNA, 21 nt, Artificial Sequence
  Synthetic
gggccgaggucgcgauggcgg

SEQ ID NO: 19959 - RNA, 22 nt, Artificial Sequence
  Synthetic
ggggccgaggucgcgauggcgg

SEQ ID NO: 19960 - RNA, 23 nt, Artificial Sequence
  Synthetic
cggggccgaggucgcgauggcgg

SEQ ID NO: 19961 - RNA, 24 nt, Artificial Sequence
  Synthetic
gcggggccgaggucgcgauggcgg

SEQ ID NO: 19962 - RNA, 18 nt, Artificial Sequence
  Synthetic
acgcacgcaccgcacggg

SEQ ID NO: 19963 - RNA, 19 nt, Artificial Sequence
  Synthetic
cacgcacgcaccgcacggg

SEQ ID NO: 19964 - RNA, 20 nt, Artificial Sequence
  Synthetic
acacgcacgcaccgcacggg

SEQ ID NO: 19965 - RNA, 21 nt, Artificial Sequence
  Synthetic
cacacgcacgcaccgcacggg

SEQ ID NO: 19966 - RNA, 22 nt, Artificial Sequence
  Synthetic
gcacacgcacgcaccgcacggg

SEQ ID NO: 19967 - RNA, 23 nt, Artificial Sequence
  Synthetic
ggcacacgcacgcaccgcacggg

SEQ ID NO: 19968 - RNA, 24 nt, Artificial Sequence
  Synthetic
aggcacacgcacgcaccgcacggg

SEQ ID NO: 19969 - RNA, 18 nt, Artificial Sequence
  Synthetic
aaugagaugccgcgcggg

SEQ ID NO: 19970 - RNA, 19 nt, Artificial Sequence
  Synthetic
uaaugagaugccgcgcggg

SEQ ID NO: 19971 - RNA, 20 nt, Artificial Sequence
  Synthetic
cuaaugagaugccgcgcggg

SEQ ID NO: 19972 - RNA, 21 nt, Artificial Sequence
  Synthetic
gcuaaugagaugccgcgcggg

SEQ ID NO: 19973 - RNA, 22 nt, Artificial Sequence
  Synthetic
cgcuaaugagaugccgcgcggg

SEQ ID NO: 19974 - RNA, 23 nt, Artificial Sequence
  Synthetic
gcgcuaaugagaugccgcgcggg

SEQ ID NO: 19975 - RNA, 24 nt, Artificial Sequence
  Synthetic
ggcgcuaaugagaugccgcgcggg

SEQ ID NO: 19976 - RNA, 18 nt, Artificial Sequence
  Synthetic
ucucauuagcaucgcggg

SEQ ID NO: 19977 - RNA, 19 nt, Artificial Sequence
  Synthetic
gucucauuagcaucgcggg

SEQ ID NO: 19978 - RNA, 20 nt, Artificial Sequence
  Synthetic
ggucucauuagcaucgcggg

SEQ ID NO: 19979 - RNA, 21 nt, Artificial Sequence
  Synthetic
gggucucauuagcaucgcggg

SEQ ID NO: 19980 - RNA, 22 nt, Artificial Sequence
  Synthetic
agggucucauuagcaucgcggg

SEQ ID NO: 19981 - RNA, 23 nt, Artificial Sequence
  Synthetic
gagggucucauuagcaucgcggg

SEQ ID NO: 19982 - RNA, 24 nt, Artificial Sequence
  Synthetic
cgagggucucauuagcaucgcggg

SEQ ID NO: 19983 - RNA, 18 nt, Artificial Sequence
  Synthetic
ggacgcgcgggcgucggg

SEQ ID NO: 19984 - RNA, 19 nt, Artificial Sequence
  Synthetic
cggacgcgcgggcgucggg

SEQ ID NO: 19985 - RNA, 20 nt, Artificial Sequence
  Synthetic
gcggacgcgcgggcgucggg

SEQ ID NO: 19986 - RNA, 21 nt, Artificial Sequence
  Synthetic
cgcggacgcgcgggcgucggg

SEQ ID NO: 19987 - RNA, 22 nt, Artificial Sequence
  Synthetic
acgcggacgcgcgggcgucggg

SEQ ID NO: 19988 - RNA, 23 nt, Artificial Sequence
  Synthetic
gacgcggacgcgcgggcgucggg

SEQ ID NO: 19989 - RNA, 24 nt, Artificial Sequence
  Synthetic
ggacgcggacgcgcgggcgucggg

SEQ ID NO: 19990 - RNA, 18 nt, Artificial Sequence
  Synthetic
cgcacgcaccgcacgggg

SEQ ID NO: 19991 - RNA, 19 nt, Artificial Sequence
  Synthetic
acgcacgcaccgcacgggg

SEQ ID NO: 19992 - RNA, 20 nt, Artificial Sequence
  Synthetic
cacgcacgcaccgcacgggg

SEQ ID NO: 19993 - RNA, 21 nt, Artificial Sequence
  Synthetic
acacgcacgcaccgcacgggg

SEQ ID NO: 19994 - RNA, 22 nt, Artificial Sequence
  Synthetic
cacacgcacgcaccgcacgggg

SEQ ID NO: 19995 - RNA, 23 nt, Artificial Sequence
  Synthetic
gcacacgcacgcaccgcacgggg

SEQ ID NO: 19996 - RNA, 24 nt, Artificial Sequence
  Synthetic
ggcacacgcacgcaccgcacgggg

SEQ ID NO: 19997 - RNA, 18 nt, Artificial Sequence
  Synthetic
cgacgcagggccgcgggg

SEQ ID NO: 19998 - RNA, 19 nt, Artificial Sequence
  Synthetic
acgacgcagggccgcgggg

SEQ ID NO: 19999 - RNA, 20 nt, Artificial Sequence
  Synthetic
gacgacgcagggccgcgggg

SEQ ID NO: 20000 - RNA, 21 nt, Artificial Sequence
  Synthetic
cgacgacgcagggccgcgggg

SEQ ID NO: 20001 - RNA, 22 nt, Artificial Sequence
  Synthetic
acgacgacgcagggccgcgggg

SEQ ID NO: 20002 - RNA, 23 nt, Artificial Sequence
  Synthetic
gacgacgacgcagggccgcgggg

SEQ ID NO: 20003 - RNA, 24 nt, Artificial Sequence
  Synthetic
cgacgacgacgcagggccgcgggg

SEQ ID NO: 20004 - RNA, 18 nt, Artificial Sequence
  Synthetic
gacgcgcgggcgucgggg

SEQ ID NO: 20005 - RNA, 19 nt, Artificial Sequence
  Synthetic
ggacgcgcgggcgucgggg

SEQ ID NO: 20006 - RNA, 20 nt, Artificial Sequence
  Synthetic
cggacgcgcgggcgucgggg

SEQ ID NO: 20007 - RNA, 21 nt, Artificial Sequence
  Synthetic
gcggacgcgcgggcgucgggg

SEQ ID NO: 20008 - RNA, 22 nt, Artificial Sequence
  Synthetic
cgcggacgcgcgggcgucgggg

SEQ ID NO: 20009 - RNA, 23 nt, Artificial Sequence
  Synthetic
acgcggacgcgcgggcgucgggg

SEQ ID NO: 20010 - RNA, 24 nt, Artificial Sequence
  Synthetic
gacgcggacgcgcgggcgucgggg

SEQ ID NO: 20011 - RNA, 18 nt, Artificial Sequence
  Synthetic
cacgcaccgcacgggggg

SEQ ID NO: 20012 - RNA, 19 nt, Artificial Sequence
  Synthetic
gcacgcaccgcacgggggg

SEQ ID NO: 20013 - RNA, 20 nt, Artificial Sequence
  Synthetic
cgcacgcaccgcacgggggg

SEQ ID NO: 20014 - RNA, 21 nt, Artificial Sequence
  Synthetic
acgcacgcaccgcacgggggg

SEQ ID NO: 20015 - RNA, 22 nt, Artificial Sequence
  Synthetic
cacgcacgcaccgcacgggggg

SEQ ID NO: 20016 - RNA, 23 nt, Artificial Sequence
  Synthetic
acacgcacgcaccgcacgggggg

SEQ ID NO: 20017 - RNA, 24 nt, Artificial Sequence
  Synthetic
cacacgcacgcaccgcacgggggg

SEQ ID NO: 20018 - RNA, 18 nt, Artificial Sequence
  Synthetic
ugcgguuccaccuggggg

SEQ ID NO: 20019 - RNA, 19 nt, Artificial Sequence
  Synthetic
augcgguuccaccuggggg

SEQ ID NO: 20020 - RNA, 20 nt, Artificial Sequence
  Synthetic
aaugcgguuccaccuggggg

SEQ ID NO: 20021 - RNA, 21 nt, Artificial Sequence
  Synthetic
uaaugcgguuccaccuggggg

SEQ ID NO: 20022 - RNA, 22 nt, Artificial Sequence
  Synthetic
auaaugcgguuccaccuggggg

SEQ ID NO: 20023 - RNA, 23 nt, Artificial Sequence
  Synthetic
cauaaugcgguuccaccuggggg

SEQ ID NO: 20024 - RNA, 24 nt, Artificial Sequence
  Synthetic
gcauaaugcgguuccaccuggggg

SEQ ID NO: 20025 - RNA, 18 nt, Artificial Sequence
  Synthetic
augcgguuccaccugggg

SEQ ID NO: 20026 - RNA, 19 nt, Artificial Sequence
  Synthetic
aaugcgguuccaccugggg

SEQ ID NO: 20027 - RNA, 20 nt, Artificial Sequence
  Synthetic
uaaugcgguuccaccugggg

SEQ ID NO: 20028 - RNA, 21 nt, Artificial Sequence
  Synthetic
auaaugcgguuccaccugggg

SEQ ID NO: 20029 - RNA, 22 nt, Artificial Sequence
  Synthetic
cauaaugcgguuccaccugggg

SEQ ID NO: 20030 - RNA, 23 nt, Artificial Sequence
  Synthetic
gcauaaugcgguuccaccugggg

SEQ ID NO: 20031 - RNA, 24 nt, Artificial Sequence
  Synthetic
cgcauaaugcgguuccaccugggg

SEQ ID NO: 20032 - RNA, 18 nt, Artificial Sequence
  Synthetic
uucggguggcacgguggg

SEQ ID NO: 20033 - RNA, 19 nt, Artificial Sequence
  Synthetic
guucggguggcacgguggg

SEQ ID NO: 20034 - RNA, 20 nt, Artificial Sequence
  Synthetic
gguucggguggcacgguggg

SEQ ID NO: 20035 - RNA, 21 nt, Artificial Sequence
  Synthetic
ggguucggguggcacgguggg

SEQ ID NO: 20036 - RNA, 22 nt, Artificial Sequence
  Synthetic
cggguucggguggcacgguggg

SEQ ID NO: 20037 - RNA, 23 nt, Artificial Sequence
  Synthetic
ccggguucggguggcacgguggg

SEQ ID NO: 20038 - RNA, 24 nt, Artificial Sequence
  Synthetic
cccggguucggguggcacgguggg

SEQ ID NO: 20039 - RNA, 18 nt, Artificial Sequence
  Synthetic
ugcuggccucgauggugg

SEQ ID NO: 20040 - RNA, 19 nt, Artificial Sequence
  Synthetic
cugcuggccucgauggugg

SEQ ID NO: 20041 - RNA, 20 nt, Artificial Sequence
  Synthetic
ccugcuggccucgauggugg

SEQ ID NO: 20042 - RNA, 21 nt, Artificial Sequence
  Synthetic
cccugcuggccucgauggugg

SEQ ID NO: 20043 - RNA, 22 nt, Artificial Sequence
  Synthetic
gcccugcuggccucgauggugg

SEQ ID NO: 20044 - RNA, 23 nt, Artificial Sequence
  Synthetic
ggcccugcuggccucgauggugg

SEQ ID NO: 20045 - RNA, 24 nt, Artificial Sequence
  Synthetic
uggcccugcuggccucgauggugg

SEQ ID NO: 20046 - RNA, 18 nt, Artificial Sequence
  Synthetic
ggggccgaggucgcgaug

SEQ ID NO: 20047 - RNA, 19 nt, Artificial Sequence
  Synthetic
cggggccgaggucgcgaug

SEQ ID NO: 20048 - RNA, 20 nt, Artificial Sequence
  Synthetic
gcggggccgaggucgcgaug

SEQ ID NO: 20049 - RNA, 21 nt, Artificial Sequence
  Synthetic
cgcggggccgaggucgcgaug

SEQ ID NO: 20050 - RNA, 22 nt, Artificial Sequence
  Synthetic
ccgcggggccgaggucgcgaug

SEQ ID NO: 20051 - RNA, 23 nt, Artificial Sequence
  Synthetic
gccgcggggccgaggucgcgaug

SEQ ID NO: 20052 - RNA, 24 nt, Artificial Sequence
  Synthetic
ggccgcggggccgaggucgcgaug

SEQ ID NO: 20053 - RNA, 18 nt, Artificial Sequence
  Synthetic
gcccugcuggccucgaug

SEQ ID NO: 20054 - RNA, 19 nt, Artificial Sequence
  Synthetic
ggcccugcuggccucgaug

SEQ ID NO: 20055 - RNA, 20 nt, Artificial Sequence
  Synthetic
uggcccugcuggccucgaug

SEQ ID NO: 20056 - RNA, 21 nt, Artificial Sequence
  Synthetic
cuggcccugcuggccucgaug

SEQ ID NO: 20057 - RNA, 22 nt, Artificial Sequence
  Synthetic
gcuggcccugcuggccucgaug

SEQ ID NO: 20058 - RNA, 23 nt, Artificial Sequence
  Synthetic
agcuggcccugcuggccucgaug

SEQ ID NO: 20059 - RNA, 24 nt, Artificial Sequence
  Synthetic
cagcuggcccugcuggccucgaug

SEQ ID NO: 20060 - RNA, 18 nt, Artificial Sequence
  Synthetic
ccaugcgcgccgauuaug

SEQ ID NO: 20061 - RNA, 19 nt, Artificial Sequence
  Synthetic
uccaugcgcgccgauuaug

SEQ ID NO: 20062 - RNA, 20 nt, Artificial Sequence
  Synthetic
cuccaugcgcgccgauuaug

SEQ ID NO: 20063 - RNA, 21 nt, Artificial Sequence
  Synthetic
ccuccaugcgcgccgauuaug

SEQ ID NO: 20064 - RNA, 22 nt, Artificial Sequence
  Synthetic
cccuccaugcgcgccgauuaug

SEQ ID NO: 20065 - RNA, 23 nt, Artificial Sequence
  Synthetic
ccccuccaugcgcgccgauuaug

SEQ ID NO: 20066 - RNA, 24 nt, Artificial Sequence
  Synthetic
cccccuccaugcgcgccgauuaug

SEQ ID NO: 20067 - RNA, 18 nt, Artificial Sequence
  Synthetic
cccccacugccgccccug

SEQ ID NO: 20068 - RNA, 19 nt, Artificial Sequence
  Synthetic
ccccccacugccgccccug

SEQ ID NO: 20069 - RNA, 20 nt, Artificial Sequence
  Synthetic
cccccccacugccgccccug

SEQ ID NO: 20070 - RNA, 21 nt, Artificial Sequence
  Synthetic
ccccccccacugccgccccug

SEQ ID NO: 20071 - RNA, 22 nt, Artificial Sequence
  Synthetic
cccccccccacugccgccccug

SEQ ID NO: 20072 - RNA, 23 nt, Artificial Sequence
  Synthetic
acccccccccacugccgccccug

SEQ ID NO: 20073 - RNA, 24 nt, Artificial Sequence
  Synthetic
cacccccccccacugccgccccug

SEQ ID NO: 20074 - RNA, 18 nt, Artificial Sequence
  Synthetic
cauaaugcgguuccaccu

SEQ ID NO: 20075 - RNA, 19 nt, Artificial Sequence
  Synthetic
gcauaaugcgguuccaccu

SEQ ID NO: 20076 - RNA, 20 nt, Artificial Sequence
  Synthetic
cgcauaaugcgguuccaccu

SEQ ID NO: 20077 - RNA, 21 nt, Artificial Sequence
  Synthetic
gcgcauaaugcgguuccaccu

SEQ ID NO: 20078 - RNA, 22 nt, Artificial Sequence
  Synthetic
cgcgcauaaugcgguuccaccu

SEQ ID NO: 20079 - RNA, 23 nt, Artificial Sequence
  Synthetic
ccgcgcauaaugcgguuccaccu

SEQ ID NO: 20080 - RNA, 24 nt, Artificial Sequence
  Synthetic
gccgcgcauaaugcgguuccaccu

SEQ ID NO: 20081 - RNA, 18 nt, Artificial Sequence
  Synthetic
cgaggacgggggacgucu

SEQ ID NO: 20082 - RNA, 19 nt, Artificial Sequence
  Synthetic
acgaggacgggggacgucu

SEQ ID NO: 20083 - RNA, 20 nt, Artificial Sequence
  Synthetic
gacgaggacgggggacgucu

SEQ ID NO: 20084 - RNA, 21 nt, Artificial Sequence
  Synthetic
ggacgaggacgggggacgucu

SEQ ID NO: 20085 - RNA, 22 nt, Artificial Sequence
  Synthetic
cggacgaggacgggggacgucu

SEQ ID NO: 20086 - RNA, 23 nt, Artificial Sequence
  Synthetic
gcggacgaggacgggggacgucu

SEQ ID NO: 20087 - RNA, 24 nt, Artificial Sequence
  Synthetic
ggcggacgaggacgggggacgucu

SEQ ID NO: 20088 - RNA, 18 nt, Artificial Sequence
  Synthetic
acgaggcggccccggcgu

SEQ ID NO: 20089 - RNA, 19 nt, Artificial Sequence
  Synthetic
gacgaggcggccccggcgu

SEQ ID NO: 20090 - RNA, 20 nt, Artificial Sequence
  Synthetic
cgacgaggcggccccggcgu

SEQ ID NO: 20091 - RNA, 21 nt, Artificial Sequence
  Synthetic
ccgacgaggcggccccggcgu

SEQ ID NO: 20092 - RNA, 22 nt, Artificial Sequence
  Synthetic
gccgacgaggcggccccggcgu

SEQ ID NO: 20093 - RNA, 23 nt, Artificial Sequence
  Synthetic
ugccgacgaggcggccccggcgu

SEQ ID NO: 20094 - RNA, 24 nt, Artificial Sequence
  Synthetic
augccgacgaggcggccccggcgu

SEQ ID NO: 20095 - RNA, 18 nt, Artificial Sequence
  Synthetic
acgcggacgcgcgggcgu

SEQ ID NO: 20096 - RNA, 19 nt, Artificial Sequence
  Synthetic
gacgcggacgcgcgggcgu

SEQ ID NO: 20097 - RNA, 20 nt, Artificial Sequence
  Synthetic
ggacgcggacgcgcgggcgu

SEQ ID NO: 20098 - RNA, 21 nt, Artificial Sequence
  Synthetic
cggacgcggacgcgcgggcgu

SEQ ID NO: 20099 - RNA, 22 nt, Artificial Sequence
  Synthetic
acggacgcggacgcgcgggcgu

SEQ ID NO: 20100 - RNA, 23 nt, Artificial Sequence
  Synthetic
cacggacgcggacgcgcgggcgu

SEQ ID NO: 20101 - RNA, 24 nt, Artificial Sequence
  Synthetic
ccacggacgcggacgcgcgggcgu

SEQ ID NO: 20102 - RNA, 18 nt, Artificial Sequence
  Synthetic
ccccccgcacaccccggu

SEQ ID NO: 20103 - RNA, 19 nt, Artificial Sequence
  Synthetic
cccccccgcacaccccggu

SEQ ID NO: 20104 - RNA, 20 nt, Artificial Sequence
  Synthetic
ccccccccgcacaccccggu

SEQ ID NO: 20105 - RNA, 21 nt, Artificial Sequence
  Synthetic
cccccccccgcacaccccggu

SEQ ID NO: 20106 - RNA, 22 nt, Artificial Sequence
  Synthetic
acccccccccgcacaccccggu

SEQ ID NO: 20107 - RNA, 23 nt, Artificial Sequence
  Synthetic
gacccccccccgcacaccccggu

SEQ ID NO: 20108 - RNA, 24 nt, Artificial Sequence
  Synthetic
agacccccccccgcacaccccggu

SEQ ID NO: 20109 - RNA, 18 nt, Artificial Sequence
  Synthetic
gcggcgacaggcuggcca

SEQ ID NO: 20110 - RNA, 21 nt, Artificial Sequence
  Synthetic
gucgcggcgacaggcuggcca

SEQ ID NO: 20111 - RNA, 22 nt, Artificial Sequence
  Synthetic
ggucgcggcgacaggcuggcca

SEQ ID NO: 20112 - RNA, 23 nt, Artificial Sequence
  Synthetic
gggucgcggcgacaggcuggcca

SEQ ID NO: 20113 - RNA, 24 nt, Artificial Sequence
  Synthetic
ggggucgcggcgacaggcuggcca

SEQ ID NO: 20114 - RNA, 18 nt, Artificial Sequence
  Synthetic
gcggaggacgccgacgac

SEQ ID NO: 20115 - RNA, 19 nt, Artificial Sequence
  Synthetic
ggcggaggacgccgacgac

SEQ ID NO: 20116 - RNA, 21 nt, Artificial Sequence
  Synthetic
gaggcggaggacgccgacgac

SEQ ID NO: 20117 - RNA, 22 nt, Artificial Sequence
  Synthetic
ggaggcggaggacgccgacgac

SEQ ID NO: 20118 - RNA, 24 nt, Artificial Sequence
  Synthetic
gaggaggcggaggacgccgacgac

SEQ ID NO: 20119 - RNA, 20 nt, Artificial Sequence
  Synthetic
gccuccucgucguccgcgcc

SEQ ID NO: 20120 - RNA, 19 nt, Artificial Sequence
  Synthetic
guggugucggcggggcgcc

SEQ ID NO: 20121 - RNA, 20 nt, Artificial Sequence
  Synthetic
gguggugucggcggggcgcc

SEQ ID NO: 20122 - RNA, 22 nt, Artificial Sequence
  Synthetic
gugguggugucggcggggcgcc

SEQ ID NO: 20123 - RNA, 23 nt, Artificial Sequence
  Synthetic
ggugguggugucggcggggcgcc

SEQ ID NO: 20124 - RNA, 18 nt, Artificial Sequence
  Synthetic
gcggcccgcggucgccgc

SEQ ID NO: 20125 - RNA, 19 nt, Artificial Sequence
  Synthetic
ggcggcccgcggucgccgc

SEQ ID NO: 20126 - RNA, 19 nt, Artificial Sequence
  Synthetic
gucgucgucagacgaggag

SEQ ID NO: 20127 - RNA, 22 nt, Artificial Sequence
  Synthetic
gucgucgucgucagacgaggag

SEQ ID NO: 20128 - RNA, 21 nt, Artificial Sequence
  Synthetic
gccccaaagggggcggggccg

SEQ ID NO: 20129 - RNA, 19 nt, Artificial Sequence
  Synthetic
gacgaggauccggauuuug

SEQ ID NO: 20130 - RNA, 22 nt, Artificial Sequence
  Synthetic
gacgacgaggauccggauuuug

SEQ ID NO: 20131 - RNA, 18 nt, Artificial Sequence
  Synthetic
gacgccgacgacgaggau

SEQ ID NO: 20132 - RNA, 19 nt, Artificial Sequence
  Synthetic
ggacgccgacgacgaggau

SEQ ID NO: 20133 - RNA, 21 nt, Artificial Sequence
  Synthetic
gaggacgccgacgacgaggau

SEQ ID NO: 20134 - RNA, 22 nt, Artificial Sequence
  Synthetic
ggaggacgccgacgacgaggau

SEQ ID NO: 20135 - RNA, 24 nt, Artificial Sequence
  Synthetic
gcggaggacgccgacgacgaggau

SEQ ID NO: 20136 - RNA, 19 nt, Artificial Sequence
  Synthetic
gacaggcuggccauggggu

SEQ ID NO: 20137 - RNA, 21 nt, Artificial Sequence
  Synthetic
gcgacaggcuggccauggggu

SEQ ID NO: 20138 - RNA, 22 nt, Artificial Sequence
  Synthetic
ggcgacaggcuggccauggggu

SEQ ID NO: 20139 - RNA, 24 nt, Artificial Sequence
  Synthetic
gcggcgacaggcuggccauggggu

SEQ ID NO: 20140 - RNA, 19 nt, Artificial Sequence
  Synthetic
gcgcggacgacgaggaggc

SEQ ID NO: 20141 - RNA, 20 nt, Artificial Sequence
  Synthetic
ggcgcggacgacgaggaggc

SEQ ID NO: 20142 - RNA, 18 nt, Artificial Sequence
  Synthetic
gccucggggcggagcccg

SEQ ID NO: 20143 - RNA, 22 nt, Artificial Sequence
  Synthetic
gcccgccucggggcggagcccg

SEQ ID NO: 20144 - RNA, 23 nt, Artificial Sequence
  Synthetic
ggcccgccucggggcggagcccg

SEQ ID NO: 20145 - RNA, 24 nt, Artificial Sequence
  Synthetic
gggcccgccucggggcggagcccg

SEQ ID NO: 20146 - RNA, 22 nt, Artificial Sequence
  Synthetic
gcccccuuuggggcggagcccg

SEQ ID NO: 20147 - RNA, 20 nt, Artificial Sequence
  Synthetic
gacgaccgcgacgcgggccg

SEQ ID NO: 20148 - RNA, 23 nt, Artificial Sequence
  Synthetic
gacgacgaccgcgacgcgggccg

SEQ ID NO: 20149 - RNA, 19 nt, Artificial Sequence
  Synthetic
gccucugacucaucaaaau

SEQ ID NO: 20150 - RNA, 22 nt, Artificial Sequence
  Synthetic
gccgccucugacucaucaaaau

SEQ ID NO: 20151 - RNA, 23 nt, Artificial Sequence
  Synthetic
ggccgccucugacucaucaaaau

SEQ ID NO: 20152 - RNA, 19 nt, Artificial Sequence
  Synthetic
cgcggcgacaggcuggcca

SEQ ID NO: 20153 - RNA, 20 nt, Artificial Sequence
  Synthetic
ucgcggcgacaggcuggcca

SEQ ID NO: 20154 - RNA, 20 nt, Artificial Sequence
  Synthetic
aggcggaggacgccgacgac

SEQ ID NO: 20155 - RNA, 23 nt, Artificial Sequence
  Synthetic
aggaggcggaggacgccgacgac

SEQ ID NO: 20156 - RNA, 18 nt, Artificial Sequence
  Synthetic
cuccucgucguccgcgcc

SEQ ID NO: 20157 - RNA, 19 nt, Artificial Sequence
  Synthetic
ccuccucgucguccgcgcc

SEQ ID NO: 20158 - RNA, 21 nt, Artificial Sequence
  Synthetic
cgccuccucgucguccgcgcc

SEQ ID NO: 20159 - RNA, 22 nt, Artificial Sequence
  Synthetic
ccgccuccucgucguccgcgcc

SEQ ID NO: 20160 - RNA, 23 nt, Artificial Sequence
  Synthetic
cccgccuccucgucguccgcgcc

SEQ ID NO: 20161 - RNA, 24 nt, Artificial Sequence
  Synthetic
ccccgccuccucgucguccgcgcc

SEQ ID NO: 20162 - RNA, 18 nt, Artificial Sequence
  Synthetic
uggugucggcggggcgcc

SEQ ID NO: 20163 - RNA, 21 nt, Artificial Sequence
  Synthetic
ugguggugucggcggggcgcc

SEQ ID NO: 20164 - RNA, 24 nt, Artificial Sequence
  Synthetic
uggugguggugucggcggggcgcc

SEQ ID NO: 20165 - RNA, 20 nt, Artificial Sequence
  Synthetic
aggcggcccgcggucgccgc

SEQ ID NO: 20166 - RNA, 21 nt, Artificial Sequence
  Synthetic
caggcggcccgcggucgccgc

SEQ ID NO: 20167 - RNA, 22 nt, Artificial Sequence
  Synthetic
ccaggcggcccgcggucgccgc

SEQ ID NO: 20168 - RNA, 23 nt, Artificial Sequence
  Synthetic
uccaggcggcccgcggucgccgc

SEQ ID NO: 20169 - RNA, 24 nt, Artificial Sequence
  Synthetic
cuccaggcggcccgcggucgccgc

SEQ ID NO: 20170 - RNA, 18 nt, Artificial Sequence
  Synthetic
ucgucgucagacgaggag

SEQ ID NO: 20171 - RNA, 20 nt, Artificial Sequence
  Synthetic
cgucgucgucagacgaggag

SEQ ID NO: 20172 - RNA, 21 nt, Artificial Sequence
  Synthetic
ucgucgucgucagacgaggag

SEQ ID NO: 20173 - RNA, 23 nt, Artificial Sequence
  Synthetic
cgucgucgucgucagacgaggag

SEQ ID NO: 20174 - RNA, 24 nt, Artificial Sequence
  Synthetic
ucgucgucgucgucagacgaggag

SEQ ID NO: 20175 - RNA, 18 nt, Artificial Sequence
  Synthetic
ccaaagggggcggggccg

SEQ ID NO: 20176 - RNA, 19 nt, Artificial Sequence
  Synthetic
cccaaagggggcggggccg

SEQ ID NO: 20177 - RNA, 20 nt, Artificial Sequence
  Synthetic
ccccaaagggggcggggccg

SEQ ID NO: 20178 - RNA, 22 nt, Artificial Sequence
  Synthetic
cgccccaaagggggcggggccg

SEQ ID NO: 20179 - RNA, 23 nt, Artificial Sequence
  Synthetic
ccgccccaaagggggcggggccg

SEQ ID NO: 20180 - RNA, 24 nt, Artificial Sequence
  Synthetic
uccgccccaaagggggcggggccg

SEQ ID NO: 20181 - RNA, 18 nt, Artificial Sequence
  Synthetic
acgaggauccggauuuug

SEQ ID NO: 20182 - RNA, 20 nt, Artificial Sequence
  Synthetic
cgacgaggauccggauuuug

SEQ ID NO: 20183 - RNA, 21 nt, Artificial Sequence
  Synthetic
acgacgaggauccggauuuug

SEQ ID NO: 20184 - RNA, 23 nt, Artificial Sequence
  Synthetic
cgacgacgaggauccggauuuug

SEQ ID NO: 20185 - RNA, 24 nt, Artificial Sequence
  Synthetic
ccgacgacgaggauccggauuuug

SEQ ID NO: 20186 - RNA, 20 nt, Artificial Sequence
  Synthetic
aggacgccgacgacgaggau

SEQ ID NO: 20187 - RNA, 23 nt, Artificial Sequence
  Synthetic
cggaggacgccgacgacgaggau

SEQ ID NO: 20188 - RNA, 18 nt, Artificial Sequence
  Synthetic
acaggcuggccauggggu

SEQ ID NO: 20189 - RNA, 20 nt, Artificial Sequence
  Synthetic
cgacaggcuggccauggggu

SEQ ID NO: 20190 - RNA, 23 nt, Artificial Sequence
  Synthetic
cggcgacaggcuggccauggggu

SEQ ID NO: 20191 - RNA, 18 nt, Artificial Sequence
  Synthetic
cgcggacgacgaggaggc

SEQ ID NO: 20192 - RNA, 21 nt, Artificial Sequence
  Synthetic
cggcgcggacgacgaggaggc

SEQ ID NO: 20193 - RNA, 22 nt, Artificial Sequence
  Synthetic
ucggcgcggacgacgaggaggc

SEQ ID NO: 20194 - RNA, 23 nt, Artificial Sequence
  Synthetic
cucggcgcggacgacgaggaggc

SEQ ID NO: 20195 - RNA, 24 nt, Artificial Sequence
  Synthetic
ccucggcgcggacgacgaggaggc

SEQ ID NO: 20196 - RNA, 19 nt, Artificial Sequence
  Synthetic
cgccucggggcggagcccg

SEQ ID NO: 20197 - RNA, 20 nt, Artificial Sequence
  Synthetic
ccgccucggggcggagcccg

SEQ ID NO: 20198 - RNA, 21 nt, Artificial Sequence
  Synthetic
cccgccucggggcggagcccg

SEQ ID NO: 20199 - RNA, 18 nt, Artificial Sequence
  Synthetic
ccuuuggggcggagcccg

SEQ ID NO: 20200 - RNA, 19 nt, Artificial Sequence
  Synthetic
cccuuuggggcggagcccg

SEQ ID NO: 20201 - RNA, 20 nt, Artificial Sequence
  Synthetic
ccccuuuggggcggagcccg

SEQ ID NO: 20202 - RNA, 21 nt, Artificial Sequence
  Synthetic
cccccuuuggggcggagcccg

SEQ ID NO: 20203 - RNA, 23 nt, Artificial Sequence
  Synthetic
cgcccccuuuggggcggagcccg

SEQ ID NO: 20204 - RNA, 24 nt, Artificial Sequence
  Synthetic
ccgcccccuuuggggcggagcccg

SEQ ID NO: 20205 - RNA, 18 nt, Artificial Sequence
  Synthetic
cgaccgcgacgcgggccg

SEQ ID NO: 20206 - RNA, 19 nt, Artificial Sequence
  Synthetic
acgaccgcgacgcgggccg

SEQ ID NO: 20207 - RNA, 21 nt, Artificial Sequence
  Synthetic
cgacgaccgcgacgcgggccg

SEQ ID NO: 20208 - RNA, 22 nt, Artificial Sequence
  Synthetic
acgacgaccgcgacgcgggccg

SEQ ID NO: 20209 - RNA, 24 nt, Artificial Sequence
  Synthetic
ugacgacgaccgcgacgcgggccg

SEQ ID NO: 20210 - RNA, 18 nt, Artificial Sequence
  Synthetic
ccucugacucaucaaaau

SEQ ID NO: 20211 - RNA, 20 nt, Artificial Sequence
  Synthetic
cgccucugacucaucaaaau

SEQ ID NO: 20212 - RNA, 21 nt, Artificial Sequence
  Synthetic
ccgccucugacucaucaaaau

SEQ ID NO: 20213 - RNA, 24 nt, Artificial Sequence
  Synthetic
cggccgccucugacucaucaaaau

SEQ ID NO: 20214 - RNA, 18 nt, Artificial Sequence
  Synthetic
gggcggcuccgccccaaa

SEQ ID NO: 20215 - RNA, 19 nt, Artificial Sequence
  Synthetic
cgggcggcuccgccccaaa

SEQ ID NO: 20216 - RNA, 20 nt, Artificial Sequence
  Synthetic
gcgggcggcuccgccccaaa

SEQ ID NO: 20217 - RNA, 21 nt, Artificial Sequence
  Synthetic
cgcgggcggcuccgccccaaa

SEQ ID NO: 20218 - RNA, 22 nt, Artificial Sequence
  Synthetic
ccgcgggcggcuccgccccaaa

SEQ ID NO: 20219 - RNA, 23 nt, Artificial Sequence
  Synthetic
uccgcgggcggcuccgccccaaa

SEQ ID NO: 20220 - RNA, 24 nt, Artificial Sequence
  Synthetic
guccgcgggcggcuccgccccaaa

SEQ ID NO: 20221 - RNA, 18 nt, Artificial Sequence
  Synthetic
cgcgggcuccgccccaaa

SEQ ID NO: 20222 - RNA, 19 nt, Artificial Sequence
  Synthetic
ccgcgggcuccgccccaaa

SEQ ID NO: 20223 - RNA, 20 nt, Artificial Sequence
  Synthetic
cccgcgggcuccgccccaaa

SEQ ID NO: 20224 - RNA, 21 nt, Artificial Sequence
  Synthetic
ucccgcgggcuccgccccaaa

SEQ ID NO: 20225 - RNA, 22 nt, Artificial Sequence
  Synthetic
aucccgcgggcuccgccccaaa

SEQ ID NO: 20226 - RNA, 23 nt, Artificial Sequence
  Synthetic
caucccgcgggcuccgccccaaa

SEQ ID NO: 20227 - RNA, 24 nt, Artificial Sequence
  Synthetic
ucaucccgcgggcuccgccccaaa

SEQ ID NO: 20228 - RNA, 18 nt, Artificial Sequence
  Synthetic
cgggcggcuccgccccaa

SEQ ID NO: 20229 - RNA, 19 nt, Artificial Sequence
  Synthetic
gcgggcggcuccgccccaa

SEQ ID NO: 20230 - RNA, 20 nt, Artificial Sequence
  Synthetic
cgcgggcggcuccgccccaa

SEQ ID NO: 20231 - RNA, 21 nt, Artificial Sequence
  Synthetic
ccgcgggcggcuccgccccaa

SEQ ID NO: 20232 - RNA, 22 nt, Artificial Sequence
  Synthetic
uccgcgggcggcuccgccccaa

SEQ ID NO: 20233 - RNA, 23 nt, Artificial Sequence
  Synthetic
guccgcgggcggcuccgccccaa

SEQ ID NO: 20234 - RNA, 24 nt, Artificial Sequence
  Synthetic
gguccgcgggcggcuccgccccaa

SEQ ID NO: 20235 - RNA, 18 nt, Artificial Sequence
  Synthetic
ccgcgggcuccgccccaa

SEQ ID NO: 20236 - RNA, 19 nt, Artificial Sequence
  Synthetic
cccgcgggcuccgccccaa

SEQ ID NO: 20237 - RNA, 20 nt, Artificial Sequence
  Synthetic
ucccgcgggcuccgccccaa

SEQ ID NO: 20238 - RNA, 21 nt, Artificial Sequence
  Synthetic
aucccgcgggcuccgccccaa

SEQ ID NO: 20239 - RNA, 22 nt, Artificial Sequence
  Synthetic
caucccgcgggcuccgccccaa

SEQ ID NO: 20240 - RNA, 23 nt, Artificial Sequence
  Synthetic
ucaucccgcgggcuccgccccaa

SEQ ID NO: 20241 - RNA, 24 nt, Artificial Sequence
  Synthetic
gucaucccgcgggcuccgccccaa

SEQ ID NO: 20242 - RNA, 18 nt, Artificial Sequence
  Synthetic
ggcccccgccggccccaa

SEQ ID NO: 20243 - RNA, 19 nt, Artificial Sequence
  Synthetic
uggcccccgccggccccaa

SEQ ID NO: 20244 - RNA, 20 nt, Artificial Sequence
  Synthetic
uuggcccccgccggccccaa

SEQ ID NO: 20245 - RNA, 21 nt, Artificial Sequence
  Synthetic
guuggcccccgccggccccaa

SEQ ID NO: 20246 - RNA, 22 nt, Artificial Sequence
  Synthetic
cguuggcccccgccggccccaa

SEQ ID NO: 20247 - RNA, 23 nt, Artificial Sequence
  Synthetic
ccguuggcccccgccggccccaa

SEQ ID NO: 20248 - RNA, 24 nt, Artificial Sequence
  Synthetic
cccguuggcccccgccggccccaa

SEQ ID NO: 20249 - RNA, 18 nt, Artificial Sequence
  Synthetic
ggccgcaggguaaaagaa

SEQ ID NO: 20250 - RNA, 19 nt, Artificial Sequence
  Synthetic
gggccgcaggguaaaagaa

SEQ ID NO: 20251 - RNA, 20 nt, Artificial Sequence
  Synthetic
ggggccgcaggguaaaagaa

SEQ ID NO: 20252 - RNA, 21 nt, Artificial Sequence
  Synthetic
cggggccgcaggguaaaagaa

SEQ ID NO: 20253 - RNA, 22 nt, Artificial Sequence
  Synthetic
gcggggccgcaggguaaaagaa

SEQ ID NO: 20254 - RNA, 23 nt, Artificial Sequence
  Synthetic
ggcggggccgcaggguaaaagaa

SEQ ID NO: 20255 - RNA, 24 nt, Artificial Sequence
  Synthetic
gggcggggccgcaggguaaaagaa

SEQ ID NO: 20256 - RNA, 18 nt, Artificial Sequence
  Synthetic
ggcggggccgcaggguaa

SEQ ID NO: 20257 - RNA, 19 nt, Artificial Sequence
  Synthetic
gggcggggccgcaggguaa

SEQ ID NO: 20258 - RNA, 20 nt, Artificial Sequence
  Synthetic
ggggcggggccgcaggguaa

SEQ ID NO: 20259 - RNA, 21 nt, Artificial Sequence
  Synthetic
gggggcggggccgcaggguaa

SEQ ID NO: 20260 - RNA, 22 nt, Artificial Sequence
  Synthetic
agggggcggggccgcaggguaa

SEQ ID NO: 20261 - RNA, 23 nt, Artificial Sequence
  Synthetic
aagggggcggggccgcaggguaa

SEQ ID NO: 20262 - RNA, 24 nt, Artificial Sequence
  Synthetic
aaagggggcggggccgcaggguaa

SEQ ID NO: 20263 - RNA, 18 nt, Artificial Sequence
  Synthetic
gcgggcggcuccgcccca

SEQ ID NO: 20264 - RNA, 19 nt, Artificial Sequence
  Synthetic
cgcgggcggcuccgcccca

SEQ ID NO: 20265 - RNA, 20 nt, Artificial Sequence
  Synthetic
ccgcgggcggcuccgcccca

SEQ ID NO: 20266 - RNA, 21 nt, Artificial Sequence
  Synthetic
uccgcgggcggcuccgcccca

SEQ ID NO: 20267 - RNA, 22 nt, Artificial Sequence
  Synthetic
guccgcgggcggcuccgcccca

SEQ ID NO: 20268 - RNA, 23 nt, Artificial Sequence
  Synthetic
gguccgcgggcggcuccgcccca

SEQ ID NO: 20269 - RNA, 24 nt, Artificial Sequence
  Synthetic
ugguccgcgggcggcuccgcccca

SEQ ID NO: 20270 - RNA, 18 nt, Artificial Sequence
  Synthetic
cccgcgggcuccgcccca

SEQ ID NO: 20271 - RNA, 19 nt, Artificial Sequence
  Synthetic
ucccgcgggcuccgcccca

SEQ ID NO: 20272 - RNA, 20 nt, Artificial Sequence
  Synthetic
aucccgcgggcuccgcccca

SEQ ID NO: 20273 - RNA, 21 nt, Artificial Sequence
  Synthetic
caucccgcgggcuccgcccca

SEQ ID NO: 20274 - RNA, 22 nt, Artificial Sequence
  Synthetic
ucaucccgcgggcuccgcccca

SEQ ID NO: 20275 - RNA, 23 nt, Artificial Sequence
  Synthetic
gucaucccgcgggcuccgcccca

SEQ ID NO: 20276 - RNA, 24 nt, Artificial Sequence
  Synthetic
cgucaucccgcgggcuccgcccca

SEQ ID NO: 20277 - RNA, 18 nt, Artificial Sequence
  Synthetic
uggcccccgccggcccca

SEQ ID NO: 20278 - RNA, 19 nt, Artificial Sequence
  Synthetic
uuggcccccgccggcccca

SEQ ID NO: 20279 - RNA, 20 nt, Artificial Sequence
  Synthetic
guuggcccccgccggcccca

SEQ ID NO: 20280 - RNA, 21 nt, Artificial Sequence
  Synthetic
cguuggcccccgccggcccca

SEQ ID NO: 20281 - RNA, 22 nt, Artificial Sequence
  Synthetic
ccguuggcccccgccggcccca

SEQ ID NO: 20282 - RNA, 23 nt, Artificial Sequence
  Synthetic
cccguuggcccccgccggcccca

SEQ ID NO: 20283 - RNA, 24 nt, Artificial Sequence
  Synthetic
ucccguuggcccccgccggcccca

SEQ ID NO: 20284 - RNA, 18 nt, Artificial Sequence
  Synthetic
ccggcugcgcggcggaga

SEQ ID NO: 20285 - RNA, 19 nt, Artificial Sequence
  Synthetic
accggcugcgcggcggaga

SEQ ID NO: 20286 - RNA, 20 nt, Artificial Sequence
  Synthetic
caccggcugcgcggcggaga

SEQ ID NO: 20287 - RNA, 21 nt, Artificial Sequence
  Synthetic
acaccggcugcgcggcggaga

SEQ ID NO: 20288 - RNA, 22 nt, Artificial Sequence
  Synthetic
cacaccggcugcgcggcggaga

SEQ ID NO: 20289 - RNA, 23 nt, Artificial Sequence
  Synthetic
gcacaccggcugcgcggcggaga

SEQ ID NO: 20290 - RNA, 24 nt, Artificial Sequence
  Synthetic
ggcacaccggcugcgcggcggaga

SEQ ID NO: 20291 - RNA, 18 nt, Artificial Sequence
  Synthetic
ccccgaggcgggcccgga

SEQ ID NO: 20292 - RNA, 19 nt, Artificial Sequence
  Synthetic
gccccgaggcgggcccgga

SEQ ID NO: 20293 - RNA, 20 nt, Artificial Sequence
  Synthetic
cgccccgaggcgggcccgga

SEQ ID NO: 20294 - RNA, 21 nt, Artificial Sequence
  Synthetic
ccgccccgaggcgggcccgga

SEQ ID NO: 20295 - RNA, 22 nt, Artificial Sequence
  Synthetic
uccgccccgaggcgggcccgga

SEQ ID NO: 20296 - RNA, 23 nt, Artificial Sequence
  Synthetic
cuccgccccgaggcgggcccgga

SEQ ID NO: 20297 - RNA, 24 nt, Artificial Sequence
  Synthetic
gcuccgccccgaggcgggcccgga

SEQ ID NO: 20298 - RNA, 18 nt, Artificial Sequence
  Synthetic
ccguuccucgcgcacaua

SEQ ID NO: 20299 - RNA, 19 nt, Artificial Sequence
  Synthetic
gccguuccucgcgcacaua

SEQ ID NO: 20300 - RNA, 20 nt, Artificial Sequence
  Synthetic
ggccguuccucgcgcacaua

SEQ ID NO: 20301 - RNA, 21 nt, Artificial Sequence
  Synthetic
gggccguuccucgcgcacaua

SEQ ID NO: 20302 - RNA, 22 nt, Artificial Sequence
  Synthetic
cgggccguuccucgcgcacaua

SEQ ID NO: 20303 - RNA, 23 nt, Artificial Sequence
  Synthetic
gcgggccguuccucgcgcacaua

SEQ ID NO: 20304 - RNA, 24 nt, Artificial Sequence
  Synthetic
ggcgggccguuccucgcgcacaua

SEQ ID NO: 20305 - RNA, 18 nt, Artificial Sequence
  Synthetic
gguaaaagaagugagaac

SEQ ID NO: 20306 - RNA, 19 nt, Artificial Sequence
  Synthetic
ggguaaaagaagugagaac

SEQ ID NO: 20307 - RNA, 20 nt, Artificial Sequence
  Synthetic
aggguaaaagaagugagaac

SEQ ID NO: 20308 - RNA, 21 nt, Artificial Sequence
  Synthetic
caggguaaaagaagugagaac

SEQ ID NO: 20309 - RNA, 22 nt, Artificial Sequence
  Synthetic
gcaggguaaaagaagugagaac

SEQ ID NO: 20310 - RNA, 23 nt, Artificial Sequence
  Synthetic
cgcaggguaaaagaagugagaac

SEQ ID NO: 20311 - RNA, 24 nt, Artificial Sequence
  Synthetic
ccgcaggguaaaagaagugagaac

SEQ ID NO: 20312 - RNA, 18 nt, Artificial Sequence
  Synthetic
ucccggucgccgccgcac

SEQ ID NO: 20313 - RNA, 19 nt, Artificial Sequence
  Synthetic
gucccggucgccgccgcac

SEQ ID NO: 20314 - RNA, 20 nt, Artificial Sequence
  Synthetic
cgucccggucgccgccgcac

SEQ ID NO: 20315 - RNA, 21 nt, Artificial Sequence
  Synthetic
gcgucccggucgccgccgcac

SEQ ID NO: 20316 - RNA, 22 nt, Artificial Sequence
  Synthetic
ggcgucccggucgccgccgcac

SEQ ID NO: 20317 - RNA, 23 nt, Artificial Sequence
  Synthetic
cggcgucccggucgccgccgcac

SEQ ID NO: 20318 - RNA, 24 nt, Artificial Sequence
  Synthetic
ccggcgucccggucgccgccgcac

SEQ ID NO: 20319 - RNA, 18 nt, Artificial Sequence
  Synthetic
gaggaggcggaugcagac

SEQ ID NO: 20320 - RNA, 19 nt, Artificial Sequence
  Synthetic
cgaggaggcggaugcagac

SEQ ID NO: 20321 - RNA, 20 nt, Artificial Sequence
  Synthetic
acgaggaggcggaugcagac

SEQ ID NO: 20322 - RNA, 21 nt, Artificial Sequence
  Synthetic
gacgaggaggcggaugcagac

SEQ ID NO: 20323 - RNA, 22 nt, Artificial Sequence
  Synthetic
agacgaggaggcggaugcagac

SEQ ID NO: 20324 - RNA, 23 nt, Artificial Sequence
  Synthetic
cagacgaggaggcggaugcagac

SEQ ID NO: 20325 - RNA, 24 nt, Artificial Sequence
  Synthetic
ucagacgaggaggcggaugcagac

SEQ ID NO: 20326 - RNA, 18 nt, Artificial Sequence
  Synthetic
ucgucgucgucgucagac

SEQ ID NO: 20327 - RNA, 19 nt, Artificial Sequence
  Synthetic
gucgucgucgucgucagac

SEQ ID NO: 20328 - RNA, 20 nt, Artificial Sequence
  Synthetic
cgucgucgucgucgucagac

SEQ ID NO: 20329 - RNA, 21 nt, Artificial Sequence
  Synthetic
ucgucgucgucgucgucagac

SEQ ID NO: 20330 - RNA, 22 nt, Artificial Sequence
  Synthetic
gucgucgucgucgucgucagac

SEQ ID NO: 20331 - RNA, 23 nt, Artificial Sequence
  Synthetic
cgucgucgucgucgucgucagac

SEQ ID NO: 20332 - RNA, 24 nt, Artificial Sequence
  Synthetic
ucgucgucgucgucgucgucagac

SEQ ID NO: 20333 - RNA, 18 nt, Artificial Sequence
  Synthetic
cggcugcgcggcggagac

SEQ ID NO: 20334 - RNA, 19 nt, Artificial Sequence
  Synthetic
ccggcugcgcggcggagac

SEQ ID NO: 20335 - RNA, 20 nt, Artificial Sequence
  Synthetic
accggcugcgcggcggagac

SEQ ID NO: 20336 - RNA, 21 nt, Artificial Sequence
  Synthetic
caccggcugcgcggcggagac

SEQ ID NO: 20337 - RNA, 22 nt, Artificial Sequence
  Synthetic
acaccggcugcgcggcggagac

SEQ ID NO: 20338 - RNA, 23 nt, Artificial Sequence
  Synthetic
cacaccggcugcgcggcggagac

SEQ ID NO: 20339 - RNA, 24 nt, Artificial Sequence
  Synthetic
gcacaccggcugcgcggcggagac

SEQ ID NO: 20340 - RNA, 18 nt, Artificial Sequence
  Synthetic
cccgaggcgggcccggac

SEQ ID NO: 20341 - RNA, 19 nt, Artificial Sequence
  Synthetic
ccccgaggcgggcccggac

SEQ ID NO: 20342 - RNA, 20 nt, Artificial Sequence
  Synthetic
gccccgaggcgggcccggac

SEQ ID NO: 20343 - RNA, 21 nt, Artificial Sequence
  Synthetic
cgccccgaggcgggcccggac

SEQ ID NO: 20344 - RNA, 22 nt, Artificial Sequence
  Synthetic
ccgccccgaggcgggcccggac

SEQ ID NO: 20345 - RNA, 23 nt, Artificial Sequence
  Synthetic
uccgccccgaggcgggcccggac

SEQ ID NO: 20346 - RNA, 24 nt, Artificial Sequence
  Synthetic
cuccgccccgaggcgggcccggac

SEQ ID NO: 20347 - RNA, 18 nt, Artificial Sequence
  Synthetic
cccggucgccgccgcacc

SEQ ID NO: 20348 - RNA, 19 nt, Artificial Sequence
  Synthetic
ucccggucgccgccgcacc

SEQ ID NO: 20349 - RNA, 20 nt, Artificial Sequence
  Synthetic
gucccggucgccgccgcacc

SEQ ID NO: 20350 - RNA, 21 nt, Artificial Sequence
  Synthetic
cgucccggucgccgccgcacc

SEQ ID NO: 20351 - RNA, 22 nt, Artificial Sequence
  Synthetic
gcgucccggucgccgccgcacc

SEQ ID NO: 20352 - RNA, 23 nt, Artificial Sequence
  Synthetic
ggcgucccggucgccgccgcacc

SEQ ID NO: 20353 - RNA, 24 nt, Artificial Sequence
  Synthetic
cggcgucccggucgccgccgcacc

SEQ ID NO: 20354 - RNA, 18 nt, Artificial Sequence
  Synthetic
ggguacgccccgcggacc

SEQ ID NO: 20355 - RNA, 19 nt, Artificial Sequence
  Synthetic
cggguacgccccgcggacc

SEQ ID NO: 20356 - RNA, 20 nt, Artificial Sequence
  Synthetic
ccggguacgccccgcggacc

SEQ ID NO: 20357 - RNA, 21 nt, Artificial Sequence
  Synthetic
uccggguacgccccgcggacc

SEQ ID NO: 20358 - RNA, 22 nt, Artificial Sequence
  Synthetic
guccggguacgccccgcggacc

SEQ ID NO: 20359 - RNA, 23 nt, Artificial Sequence
  Synthetic
gguccggguacgccccgcggacc

SEQ ID NO: 20360 - RNA, 24 nt, Artificial Sequence
  Synthetic
ggguccggguacgccccgcggacc

SEQ ID NO: 20361 - RNA, 18 nt, Artificial Sequence
  Synthetic
gggguccggguacgcccc

SEQ ID NO: 20362 - RNA, 19 nt, Artificial Sequence
  Synthetic
ugggguccggguacgcccc

SEQ ID NO: 20363 - RNA, 20 nt, Artificial Sequence
  Synthetic
augggguccggguacgcccc

SEQ ID NO: 20364 - RNA, 21 nt, Artificial Sequence
  Synthetic
caugggguccggguacgcccc

SEQ ID NO: 20365 - RNA, 22 nt, Artificial Sequence
  Synthetic
ccaugggguccggguacgcccc

SEQ ID NO: 20366 - RNA, 23 nt, Artificial Sequence
  Synthetic
gccaugggguccggguacgcccc

SEQ ID NO: 20367 - RNA, 24 nt, Artificial Sequence
  Synthetic
ggccaugggguccggguacgcccc

SEQ ID NO: 20368 - RNA, 18 nt, Artificial Sequence
  Synthetic
cggccggggcgccgcccc

SEQ ID NO: 20369 - RNA, 19 nt, Artificial Sequence
  Synthetic
ucggccggggcgccgcccc

SEQ ID NO: 20370 - RNA, 20 nt, Artificial Sequence
  Synthetic
cucggccggggcgccgcccc

SEQ ID NO: 20371 - RNA, 21 nt, Artificial Sequence
  Synthetic
gcucggccggggcgccgcccc

SEQ ID NO: 20372 - RNA, 22 nt, Artificial Sequence
  Synthetic
ggcucggccggggcgccgcccc

SEQ ID NO: 20373 - RNA, 23 nt, Artificial Sequence
  Synthetic
gggcucggccggggcgccgcccc

SEQ ID NO: 20374 - RNA, 24 nt, Artificial Sequence
  Synthetic
cgggcucggccggggcgccgcccc

SEQ ID NO: 20375 - RNA, 18 nt, Artificial Sequence
  Synthetic
ucggccggggcgccgccc

SEQ ID NO: 20376 - RNA, 19 nt, Artificial Sequence
  Synthetic
cucggccggggcgccgccc

SEQ ID NO: 20377 - RNA, 20 nt, Artificial Sequence
  Synthetic
gcucggccggggcgccgccc

SEQ ID NO: 20378 - RNA, 21 nt, Artificial Sequence
  Synthetic
ggcucggccggggcgccgccc

SEQ ID NO: 20379 - RNA, 22 nt, Artificial Sequence
  Synthetic
gggcucggccggggcgccgccc

SEQ ID NO: 20380 - RNA, 23 nt, Artificial Sequence
  Synthetic
cgggcucggccggggcgccgccc

SEQ ID NO: 20381 - RNA, 24 nt, Artificial Sequence
  Synthetic
gcgggcucggccggggcgccgccc

SEQ ID NO: 20382 - RNA, 18 nt, Artificial Sequence
  Synthetic
cggggcccgcgucauccc

SEQ ID NO: 20383 - RNA, 19 nt, Artificial Sequence
  Synthetic
ccggggcccgcgucauccc

SEQ ID NO: 20384 - RNA, 20 nt, Artificial Sequence
  Synthetic
cccggggcccgcgucauccc

SEQ ID NO: 20385 - RNA, 21 nt, Artificial Sequence
  Synthetic
gcccggggcccgcgucauccc

SEQ ID NO: 20386 - RNA, 22 nt, Artificial Sequence
  Synthetic
ugcccggggcccgcgucauccc

SEQ ID NO: 20387 - RNA, 23 nt, Artificial Sequence
  Synthetic
cugcccggggcccgcgucauccc

SEQ ID NO: 20388 - RNA, 24 nt, Artificial Sequence
  Synthetic
ccugcccggggcccgcgucauccc

SEQ ID NO: 20389 - RNA, 18 nt, Artificial Sequence
  Synthetic
caucccgcgggcuccgcc

SEQ ID NO: 20390 - RNA, 19 nt, Artificial Sequence
  Synthetic
ucaucccgcgggcuccgcc

SEQ ID NO: 20391 - RNA, 20 nt, Artificial Sequence
  Synthetic
gucaucccgcgggcuccgcc

SEQ ID NO: 20392 - RNA, 21 nt, Artificial Sequence
  Synthetic
cgucaucccgcgggcuccgcc

SEQ ID NO: 20393 - RNA, 22 nt, Artificial Sequence
  Synthetic
gcgucaucccgcgggcuccgcc

SEQ ID NO: 20394 - RNA, 23 nt, Artificial Sequence
  Synthetic
cgcgucaucccgcgggcuccgcc

SEQ ID NO: 20395 - RNA, 24 nt, Artificial Sequence
  Synthetic
ccgcgucaucccgcgggcuccgcc

SEQ ID NO: 20396 - RNA, 18 nt, Artificial Sequence
  Synthetic
aggcggcccgcggucgcc

SEQ ID NO: 20397 - RNA, 19 nt, Artificial Sequence
  Synthetic
caggcggcccgcggucgcc

SEQ ID NO: 20398 - RNA, 20 nt, Artificial Sequence
  Synthetic
ccaggcggcccgcggucgcc

SEQ ID NO: 20399 - RNA, 21 nt, Artificial Sequence
  Synthetic
uccaggcggcccgcggucgcc

SEQ ID NO: 20400 - RNA, 22 nt, Artificial Sequence
  Synthetic
cuccaggcggcccgcggucgcc

SEQ ID NO: 20401 - RNA, 23 nt, Artificial Sequence
  Synthetic
gcuccaggcggcccgcggucgcc

SEQ ID NO: 20402 - RNA, 24 nt, Artificial Sequence
  Synthetic
cgcuccaggcggcccgcggucgcc

SEQ ID NO: 20403 - RNA, 18 nt, Artificial Sequence
  Synthetic
gccggggcgggcucggcc

SEQ ID NO: 20404 - RNA, 19 nt, Artificial Sequence
  Synthetic
ggccggggcgggcucggcc

SEQ ID NO: 20405 - RNA, 20 nt, Artificial Sequence
  Synthetic
gggccggggcgggcucggcc

SEQ ID NO: 20406 - RNA, 21 nt, Artificial Sequence
  Synthetic
cgggccggggcgggcucggcc

SEQ ID NO: 20407 - RNA, 22 nt, Artificial Sequence
  Synthetic
ccgggccggggcgggcucggcc

SEQ ID NO: 20408 - RNA, 23 nt, Artificial Sequence
  Synthetic
uccgggccggggcgggcucggcc

SEQ ID NO: 20409 - RNA, 24 nt, Artificial Sequence
  Synthetic
guccgggccggggcgggcucggcc

SEQ ID NO: 20410 - RNA, 18 nt, Artificial Sequence
  Synthetic
cgcggcgacaggcuggcc

SEQ ID NO: 20411 - RNA, 19 nt, Artificial Sequence
  Synthetic
ucgcggcgacaggcuggcc

SEQ ID NO: 20412 - RNA, 20 nt, Artificial Sequence
  Synthetic
gucgcggcgacaggcuggcc

SEQ ID NO: 20413 - RNA, 21 nt, Artificial Sequence
  Synthetic
ggucgcggcgacaggcuggcc

SEQ ID NO: 20414 - RNA, 22 nt, Artificial Sequence
  Synthetic
gggucgcggcgacaggcuggcc

SEQ ID NO: 20415 - RNA, 23 nt, Artificial Sequence
  Synthetic
ggggucgcggcgacaggcuggcc

SEQ ID NO: 20416 - RNA, 24 nt, Artificial Sequence
  Synthetic
gggggucgcggcgacaggcuggcc

SEQ ID NO: 20417 - RNA, 18 nt, Artificial Sequence
  Synthetic
gagcacuggcgcccugcc

SEQ ID NO: 20418 - RNA, 19 nt, Artificial Sequence
  Synthetic
cgagcacuggcgcccugcc

SEQ ID NO: 20419 - RNA, 20 nt, Artificial Sequence
  Synthetic
gcgagcacuggcgcccugcc

SEQ ID NO: 20420 - RNA, 21 nt, Artificial Sequence
  Synthetic
ugcgagcacuggcgcccugcc

SEQ ID NO: 20421 - RNA, 22 nt, Artificial Sequence
  Synthetic
gugcgagcacuggcgcccugcc

SEQ ID NO: 20422 - RNA, 23 nt, Artificial Sequence
  Synthetic
agugcgagcacuggcgcccugcc

SEQ ID NO: 20423 - RNA, 24 nt, Artificial Sequence
  Synthetic
aagugcgagcacuggcgcccugcc

SEQ ID NO: 20424 - RNA, 18 nt, Artificial Sequence
  Synthetic
gagcgcuggcgcccugcc

SEQ ID NO: 20425 - RNA, 19 nt, Artificial Sequence
  Synthetic
cgagcgcuggcgcccugcc

SEQ ID NO: 20426 - RNA, 20 nt, Artificial Sequence
  Synthetic
gcgagcgcuggcgcccugcc

SEQ ID NO: 20427 - RNA, 21 nt, Artificial Sequence
  Synthetic
ugcgagcgcuggcgcccugcc

SEQ ID NO: 20428 - RNA, 22 nt, Artificial Sequence
  Synthetic
gugcgagcgcuggcgcccugcc

SEQ ID NO: 20429 - RNA, 23 nt, Artificial Sequence
  Synthetic
agugcgagcgcuggcgcccugcc

SEQ ID NO: 20430 - RNA, 24 nt, Artificial Sequence
  Synthetic
aagugcgagcgcuggcgcccugcc

SEQ ID NO: 20431 - RNA, 18 nt, Artificial Sequence
  Synthetic
ggacgucgucuccggucc

SEQ ID NO: 20432 - RNA, 19 nt, Artificial Sequence
  Synthetic
cggacgucgucuccggucc

SEQ ID NO: 20433 - RNA, 20 nt, Artificial Sequence
  Synthetic
gcggacgucgucuccggucc

SEQ ID NO: 20434 - RNA, 21 nt, Artificial Sequence
  Synthetic
cgcggacgucgucuccggucc

SEQ ID NO: 20435 - RNA, 22 nt, Artificial Sequence
  Synthetic
ccgcggacgucgucuccggucc

SEQ ID NO: 20436 - RNA, 23 nt, Artificial Sequence
  Synthetic
accgcggacgucgucuccggucc

SEQ ID NO: 20437 - RNA, 24 nt, Artificial Sequence
  Synthetic
gaccgcggacgucgucuccggucc

SEQ ID NO: 20438 - RNA, 18 nt, Artificial Sequence
  Synthetic
aggucgccccguuggucc

SEQ ID NO: 20439 - RNA, 19 nt, Artificial Sequence
  Synthetic
gaggucgccccguuggucc

SEQ ID NO: 20440 - RNA, 20 nt, Artificial Sequence
  Synthetic
cgaggucgccccguuggucc

SEQ ID NO: 20441 - RNA, 21 nt, Artificial Sequence
  Synthetic
gcgaggucgccccguuggucc

SEQ ID NO: 20442 - RNA, 22 nt, Artificial Sequence
  Synthetic
ggcgaggucgccccguuggucc

SEQ ID NO: 20443 - RNA, 23 nt, Artificial Sequence
  Synthetic
cggcgaggucgccccguuggucc

SEQ ID NO: 20444 - RNA, 24 nt, Artificial Sequence
  Synthetic
ccggcgaggucgccccguuggucc

SEQ ID NO: 20445 - RNA, 18 nt, Artificial Sequence
  Synthetic
guggugucggcggggcgc

SEQ ID NO: 20446 - RNA, 19 nt, Artificial Sequence
  Synthetic
gguggugucggcggggcgc

SEQ ID NO: 20447 - RNA, 20 nt, Artificial Sequence
  Synthetic
ugguggugucggcggggcgc

SEQ ID NO: 20448 - RNA, 21 nt, Artificial Sequence
  Synthetic
gugguggugucggcggggcgc

SEQ ID NO: 20449 - RNA, 22 nt, Artificial Sequence
  Synthetic
ggugguggugucggcggggcgc

SEQ ID NO: 20450 - RNA, 23 nt, Artificial Sequence
  Synthetic
uggugguggugucggcggggcgc

SEQ ID NO: 20451 - RNA, 24 nt, Artificial Sequence
  Synthetic
guggugguggugucggcggggcgc

SEQ ID NO: 20452 - RNA, 18 nt, Artificial Sequence
  Synthetic
aggcggccgagcgccggc

SEQ ID NO: 20453 - RNA, 19 nt, Artificial Sequence
  Synthetic
gaggcggccgagcgccggc

SEQ ID NO: 20454 - RNA, 20 nt, Artificial Sequence
  Synthetic
agaggcggccgagcgccggc

SEQ ID NO: 20455 - RNA, 21 nt, Artificial Sequence
  Synthetic
cagaggcggccgagcgccggc

SEQ ID NO: 20456 - RNA, 22 nt, Artificial Sequence
  Synthetic
ucagaggcggccgagcgccggc

SEQ ID NO: 20457 - RNA, 23 nt, Artificial Sequence
  Synthetic
gucagaggcggccgagcgccggc

SEQ ID NO: 20458 - RNA, 24 nt, Artificial Sequence
  Synthetic
agucagaggcggccgagcgccggc

SEQ ID NO: 20459 - RNA, 18 nt, Artificial Sequence
  Synthetic
gcccugggcgggcucggc

SEQ ID NO: 20460 - RNA, 19 nt, Artificial Sequence
  Synthetic
ggcccugggcgggcucggc

SEQ ID NO: 20461 - RNA, 20 nt, Artificial Sequence
  Synthetic
cggcccugggcgggcucggc

SEQ ID NO: 20462 - RNA, 21 nt, Artificial Sequence
  Synthetic
ucggcccugggcgggcucggc

SEQ ID NO: 20463 - RNA, 22 nt, Artificial Sequence
  Synthetic
cucggcccugggcgggcucggc

SEQ ID NO: 20464 - RNA, 23 nt, Artificial Sequence
  Synthetic
gcucggcccugggcgggcucggc

SEQ ID NO: 20465 - RNA, 24 nt, Artificial Sequence
  Synthetic
ggcucggcccugggcgggcucggc

SEQ ID NO: 20466 - RNA, 18 nt, Artificial Sequence
  Synthetic
cgccgcggggguccgggc

SEQ ID NO: 20467 - RNA, 19 nt, Artificial Sequence
  Synthetic
ucgccgcggggguccgggc

SEQ ID NO: 20468 - RNA, 20 nt, Artificial Sequence
  Synthetic
gucgccgcggggguccgggc

SEQ ID NO: 20469 - RNA, 21 nt, Artificial Sequence
  Synthetic
ggucgccgcggggguccgggc

SEQ ID NO: 20470 - RNA, 22 nt, Artificial Sequence
  Synthetic
cggucgccgcggggguccgggc

SEQ ID NO: 20471 - RNA, 23 nt, Artificial Sequence
  Synthetic
gcggucgccgcggggguccgggc

SEQ ID NO: 20472 - RNA, 24 nt, Artificial Sequence
  Synthetic
cgcggucgccgcggggguccgggc

SEQ ID NO: 20473 - RNA, 18 nt, Artificial Sequence
  Synthetic
cuccgccccgaggcgggc

SEQ ID NO: 20474 - RNA, 19 nt, Artificial Sequence
  Synthetic
gcuccgccccgaggcgggc

SEQ ID NO: 20475 - RNA, 20 nt, Artificial Sequence
  Synthetic
ggcuccgccccgaggcgggc

SEQ ID NO: 20476 - RNA, 21 nt, Artificial Sequence
  Synthetic
gggcuccgccccgaggcgggc

SEQ ID NO: 20477 - RNA, 22 nt, Artificial Sequence
  Synthetic
cgggcuccgccccgaggcgggc

SEQ ID NO: 20478 - RNA, 23 nt, Artificial Sequence
  Synthetic
gcgggcuccgccccgaggcgggc

SEQ ID NO: 20479 - RNA, 24 nt, Artificial Sequence
  Synthetic
cgcgggcuccgccccgaggcgggc

SEQ ID NO: 20480 - RNA, 18 nt, Artificial Sequence
  Synthetic
ugcggcgcuggcgggggc

SEQ ID NO: 20481 - RNA, 19 nt, Artificial Sequence
  Synthetic
cugcggcgcuggcgggggc

SEQ ID NO: 20482 - RNA, 20 nt, Artificial Sequence
  Synthetic
ucugcggcgcuggcgggggc

SEQ ID NO: 20483 - RNA, 21 nt, Artificial Sequence
  Synthetic
gucugcggcgcuggcgggggc

SEQ ID NO: 20484 - RNA, 22 nt, Artificial Sequence
  Synthetic
ggucugcggcgcuggcgggggc

SEQ ID NO: 20485 - RNA, 23 nt, Artificial Sequence
  Synthetic
uggucugcggcgcuggcgggggc

SEQ ID NO: 20486 - RNA, 24 nt, Artificial Sequence
  Synthetic
guggucugcggcgcuggcgggggc

SEQ ID NO: 20487 - RNA, 18 nt, Artificial Sequence
  Synthetic
guggucugcggcgcuggc

SEQ ID NO: 20488 - RNA, 19 nt, Artificial Sequence
  Synthetic
cguggucugcggcgcuggc

SEQ ID NO: 20489 - RNA, 20 nt, Artificial Sequence
  Synthetic
gcguggucugcggcgcuggc

SEQ ID NO: 20490 - RNA, 21 nt, Artificial Sequence
  Synthetic
ggcguggucugcggcgcuggc

SEQ ID NO: 20491 - RNA, 22 nt, Artificial Sequence
  Synthetic
cggcguggucugcggcgcuggc

SEQ ID NO: 20492 - RNA, 23 nt, Artificial Sequence
  Synthetic
gcggcguggucugcggcgcuggc

SEQ ID NO: 20493 - RNA, 24 nt, Artificial Sequence
  Synthetic
cgcggcguggucugcggcgcuggc

SEQ ID NO: 20494 - RNA, 18 nt, Artificial Sequence
  Synthetic
cgagcacuggcgcccugc

SEQ ID NO: 20495 - RNA, 19 nt, Artificial Sequence
  Synthetic
gcgagcacuggcgcccugc

SEQ ID NO: 20496 - RNA, 20 nt, Artificial Sequence
  Synthetic
ugcgagcacuggcgcccugc

SEQ ID NO: 20497 - RNA, 21 nt, Artificial Sequence
  Synthetic
gugcgagcacuggcgcccugc

SEQ ID NO: 20498 - RNA, 22 nt, Artificial Sequence
  Synthetic
agugcgagcacuggcgcccugc

SEQ ID NO: 20499 - RNA, 23 nt, Artificial Sequence
  Synthetic
aagugcgagcacuggcgcccugc

SEQ ID NO: 20500 - RNA, 24 nt, Artificial Sequence
  Synthetic
aaagugcgagcacuggcgcccugc

SEQ ID NO: 20501 - RNA, 18 nt, Artificial Sequence
  Synthetic
cgagcgcuggcgcccugc

SEQ ID NO: 20502 - RNA, 19 nt, Artificial Sequence
  Synthetic
gcgagcgcuggcgcccugc

SEQ ID NO: 20503 - RNA, 20 nt, Artificial Sequence
  Synthetic
ugcgagcgcuggcgcccugc

SEQ ID NO: 20504 - RNA, 21 nt, Artificial Sequence
  Synthetic
gugcgagcgcuggcgcccugc

SEQ ID NO: 20505 - RNA, 22 nt, Artificial Sequence
  Synthetic
agugcgagcgcuggcgcccugc

SEQ ID NO: 20506 - RNA, 23 nt, Artificial Sequence
  Synthetic
aagugcgagcgcuggcgcccugc

SEQ ID NO: 20507 - RNA, 24 nt, Artificial Sequence
  Synthetic
aaagugcgagcgcuggcgcccugc

SEQ ID NO: 20508 - RNA, 18 nt, Artificial Sequence
  Synthetic
gccgcccccggggcccuc

SEQ ID NO: 20509 - RNA, 19 nt, Artificial Sequence
  Synthetic
cgccgcccccggggcccuc

SEQ ID NO: 20510 - RNA, 20 nt, Artificial Sequence
  Synthetic
gcgccgcccccggggcccuc

SEQ ID NO: 20511 - RNA, 21 nt, Artificial Sequence
  Synthetic
ggcgccgcccccggggcccuc

SEQ ID NO: 20512 - RNA, 22 nt, Artificial Sequence
  Synthetic
gggcgccgcccccggggcccuc

SEQ ID NO: 20513 - RNA, 23 nt, Artificial Sequence
  Synthetic
ggggcgccgcccccggggcccuc

SEQ ID NO: 20514 - RNA, 24 nt, Artificial Sequence
  Synthetic
cggggcgccgcccccggggcccuc

SEQ ID NO: 20515 - RNA, 18 nt, Artificial Sequence
  Synthetic
acgaggaggcggaugcag

SEQ ID NO: 20516 - RNA, 19 nt, Artificial Sequence
  Synthetic
gacgaggaggcggaugcag

SEQ ID NO: 20517 - RNA, 20 nt, Artificial Sequence
  Synthetic
agacgaggaggcggaugcag

SEQ ID NO: 20518 - RNA, 21 nt, Artificial Sequence
  Synthetic
cagacgaggaggcggaugcag

SEQ ID NO: 20519 - RNA, 22 nt, Artificial Sequence
  Synthetic
ucagacgaggaggcggaugcag

SEQ ID NO: 20520 - RNA, 23 nt, Artificial Sequence
  Synthetic
gucagacgaggaggcggaugcag

SEQ ID NO: 20521 - RNA, 24 nt, Artificial Sequence
  Synthetic
cgucagacgaggaggcggaugcag

SEQ ID NO: 20522 - RNA, 18 nt, Artificial Sequence
  Synthetic
cgucgucgucgucgucag

SEQ ID NO: 20523 - RNA, 19 nt, Artificial Sequence
  Synthetic
ucgucgucgucgucgucag

SEQ ID NO: 20524 - RNA, 20 nt, Artificial Sequence
  Synthetic
gucgucgucgucgucgucag

SEQ ID NO: 20525 - RNA, 21 nt, Artificial Sequence
  Synthetic
cgucgucgucgucgucgucag

SEQ ID NO: 20526 - RNA, 22 nt, Artificial Sequence
  Synthetic
ucgucgucgucgucgucgucag

SEQ ID NO: 20527 - RNA, 23 nt, Artificial Sequence
  Synthetic
gucgucgucgucgucgucgucag

SEQ ID NO: 20528 - RNA, 24 nt, Artificial Sequence
  Synthetic
cgucgucgucgucgucgucgucag

SEQ ID NO: 20529 - RNA, 18 nt, Artificial Sequence
  Synthetic
gaggcggaugcagacgag

SEQ ID NO: 20530 - RNA, 19 nt, Artificial Sequence
  Synthetic
ggaggcggaugcagacgag

SEQ ID NO: 20531 - RNA, 20 nt, Artificial Sequence
  Synthetic
aggaggcggaugcagacgag

SEQ ID NO: 20532 - RNA, 21 nt, Artificial Sequence
  Synthetic
gaggaggcggaugcagacgag

SEQ ID NO: 20533 - RNA, 22 nt, Artificial Sequence
  Synthetic
cgaggaggcggaugcagacgag

SEQ ID NO: 20534 - RNA, 23 nt, Artificial Sequence
  Synthetic
acgaggaggcggaugcagacgag

SEQ ID NO: 20535 - RNA, 24 nt, Artificial Sequence
  Synthetic
gacgaggaggcggaugcagacgag

SEQ ID NO: 20536 - RNA, 18 nt, Artificial Sequence
  Synthetic
cgcgggcuccgccccgag

SEQ ID NO: 20537 - RNA, 19 nt, Artificial Sequence
  Synthetic
ccgcgggcuccgccccgag

SEQ ID NO: 20538 - RNA, 20 nt, Artificial Sequence
  Synthetic
cccgcgggcuccgccccgag

SEQ ID NO: 20539 - RNA, 21 nt, Artificial Sequence
  Synthetic
ucccgcgggcuccgccccgag

SEQ ID NO: 20540 - RNA, 22 nt, Artificial Sequence
  Synthetic
aucccgcgggcuccgccccgag

SEQ ID NO: 20541 - RNA, 23 nt, Artificial Sequence
  Synthetic
caucccgcgggcuccgccccgag

SEQ ID NO: 20542 - RNA, 24 nt, Artificial Sequence
  Synthetic
ucaucccgcgggcuccgccccgag

SEQ ID NO: 20543 - RNA, 18 nt, Artificial Sequence
  Synthetic
gcggaugcagacgaggag

SEQ ID NO: 20544 - RNA, 19 nt, Artificial Sequence
  Synthetic
ggcggaugcagacgaggag

SEQ ID NO: 20545 - RNA, 20 nt, Artificial Sequence
  Synthetic
aggcggaugcagacgaggag

SEQ ID NO: 20546 - RNA, 21 nt, Artificial Sequence
  Synthetic
gaggcggaugcagacgaggag

SEQ ID NO: 20547 - RNA, 22 nt, Artificial Sequence
  Synthetic
ggaggcggaugcagacgaggag

SEQ ID NO: 20548 - RNA, 23 nt, Artificial Sequence
  Synthetic
aggaggcggaugcagacgaggag

SEQ ID NO: 20549 - RNA, 24 nt, Artificial Sequence
  Synthetic
gaggaggcggaugcagacgaggag

SEQ ID NO: 20550 - RNA, 18 nt, Artificial Sequence
  Synthetic
gcagacgaggaggaggag

SEQ ID NO: 20551 - RNA, 19 nt, Artificial Sequence
  Synthetic
ugcagacgaggaggaggag

SEQ ID NO: 20552 - RNA, 20 nt, Artificial Sequence
  Synthetic
augcagacgaggaggaggag

SEQ ID NO: 20553 - RNA, 21 nt, Artificial Sequence
  Synthetic
gaugcagacgaggaggaggag

SEQ ID NO: 20554 - RNA, 22 nt, Artificial Sequence
  Synthetic
ggaugcagacgaggaggaggag

SEQ ID NO: 20555 - RNA, 23 nt, Artificial Sequence
  Synthetic
cggaugcagacgaggaggaggag

SEQ ID NO: 20556 - RNA, 24 nt, Artificial Sequence
  Synthetic
gcggaugcagacgaggaggaggag

SEQ ID NO: 20557 - RNA, 18 nt, Artificial Sequence
  Synthetic
gaggaggcggaggaggag

SEQ ID NO: 20558 - RNA, 19 nt, Artificial Sequence
  Synthetic
ggaggaggcggaggaggag

SEQ ID NO: 20559 - RNA, 20 nt, Artificial Sequence
  Synthetic
aggaggaggcggaggaggag

SEQ ID NO: 20560 - RNA, 21 nt, Artificial Sequence
  Synthetic
gaggaggaggcggaggaggag

SEQ ID NO: 20561 - RNA, 22 nt, Artificial Sequence
  Synthetic
ggaggaggaggcggaggaggag

SEQ ID NO: 20562 - RNA, 23 nt, Artificial Sequence
  Synthetic
aggaggaggaggcggaggaggag

SEQ ID NO: 20563 - RNA, 24 nt, Artificial Sequence
  Synthetic
gaggaggaggaggcggaggaggag

SEQ ID NO: 20564 - RNA, 18 nt, Artificial Sequence
  Synthetic
gaggaggaggaggcggag

SEQ ID NO: 20565 - RNA, 19 nt, Artificial Sequence
  Synthetic
cgaggaggaggaggcggag

SEQ ID NO: 20566 - RNA, 20 nt, Artificial Sequence
  Synthetic
acgaggaggaggaggcggag

SEQ ID NO: 20567 - RNA, 21 nt, Artificial Sequence
  Synthetic
gacgaggaggaggaggcggag

SEQ ID NO: 20568 - RNA, 22 nt, Artificial Sequence
  Synthetic
agacgaggaggaggaggcggag

SEQ ID NO: 20569 - RNA, 23 nt, Artificial Sequence
  Synthetic
cagacgaggaggaggaggcggag

SEQ ID NO: 20570 - RNA, 24 nt, Artificial Sequence
  Synthetic
gcagacgaggaggaggaggcggag

SEQ ID NO: 20571 - RNA, 18 nt, Artificial Sequence
  Synthetic
aggaggcggaugcagacg

SEQ ID NO: 20572 - RNA, 19 nt, Artificial Sequence
  Synthetic
gaggaggcggaugcagacg

SEQ ID NO: 20573 - RNA, 20 nt, Artificial Sequence
  Synthetic
cgaggaggcggaugcagacg

SEQ ID NO: 20574 - RNA, 21 nt, Artificial Sequence
  Synthetic
acgaggaggcggaugcagacg

SEQ ID NO: 20575 - RNA, 22 nt, Artificial Sequence
  Synthetic
gacgaggaggcggaugcagacg

SEQ ID NO: 20576 - RNA, 23 nt, Artificial Sequence
  Synthetic
agacgaggaggcggaugcagacg

SEQ ID NO: 20577 - RNA, 24 nt, Artificial Sequence
  Synthetic
cagacgaggaggcggaugcagacg

SEQ ID NO: 20578 - RNA, 18 nt, Artificial Sequence
  Synthetic
cgucgucgucgucagacg

SEQ ID NO: 20579 - RNA, 19 nt, Artificial Sequence
  Synthetic
ucgucgucgucgucagacg

SEQ ID NO: 20580 - RNA, 20 nt, Artificial Sequence
  Synthetic
gucgucgucgucgucagacg

SEQ ID NO: 20581 - RNA, 21 nt, Artificial Sequence
  Synthetic
cgucgucgucgucgucagacg

SEQ ID NO: 20582 - RNA, 22 nt, Artificial Sequence
  Synthetic
ucgucgucgucgucgucagacg

SEQ ID NO: 20583 - RNA, 23 nt, Artificial Sequence
  Synthetic
gucgucgucgucgucgucagacg

SEQ ID NO: 20584 - RNA, 24 nt, Artificial Sequence
  Synthetic
cgucgucgucgucgucgucagacg

SEQ ID NO: 20585 - RNA, 18 nt, Artificial Sequence
  Synthetic
aggcggaggacgccgacg

SEQ ID NO: 20586 - RNA, 19 nt, Artificial Sequence
  Synthetic
gaggcggaggacgccgacg

SEQ ID NO: 20587 - RNA, 20 nt, Artificial Sequence
  Synthetic
ggaggcggaggacgccgacg

SEQ ID NO: 20588 - RNA, 21 nt, Artificial Sequence
  Synthetic
aggaggcggaggacgccgacg

SEQ ID NO: 20589 - RNA, 22 nt, Artificial Sequence
  Synthetic
gaggaggcggaggacgccgacg

SEQ ID NO: 20590 - RNA, 23 nt, Artificial Sequence
  Synthetic
ggaggaggcggaggacgccgacg

SEQ ID NO: 20591 - RNA, 24 nt, Artificial Sequence
  Synthetic
aggaggaggcggaggacgccgacg

SEQ ID NO: 20592 - RNA, 18 nt, Artificial Sequence
  Synthetic
ccgaggcgggcccggacg

SEQ ID NO: 20593 - RNA, 19 nt, Artificial Sequence
  Synthetic
cccgaggcgggcccggacg

SEQ ID NO: 20594 - RNA, 20 nt, Artificial Sequence
  Synthetic
ccccgaggcgggcccggacg

SEQ ID NO: 20595 - RNA, 21 nt, Artificial Sequence
  Synthetic
gccccgaggcgggcccggacg

SEQ ID NO: 20596 - RNA, 22 nt, Artificial Sequence
  Synthetic
cgccccgaggcgggcccggacg

SEQ ID NO: 20597 - RNA, 23 nt, Artificial Sequence
  Synthetic
ccgccccgaggcgggcccggacg

SEQ ID NO: 20598 - RNA, 24 nt, Artificial Sequence
  Synthetic
uccgccccgaggcgggcccggacg

SEQ ID NO: 20599 - RNA, 18 nt, Artificial Sequence
  Synthetic
agaggcggccgagcgccg

SEQ ID NO: 20600 - RNA, 19 nt, Artificial Sequence
  Synthetic
cagaggcggccgagcgccg

SEQ ID NO: 20601 - RNA, 20 nt, Artificial Sequence
  Synthetic
ucagaggcggccgagcgccg

SEQ ID NO: 20602 - RNA, 21 nt, Artificial Sequence
  Synthetic
gucagaggcggccgagcgccg

SEQ ID NO: 20603 - RNA, 22 nt, Artificial Sequence
  Synthetic
agucagaggcggccgagcgccg

SEQ ID NO: 20604 - RNA, 23 nt, Artificial Sequence
  Synthetic
gagucagaggcggccgagcgccg

SEQ ID NO: 20605 - RNA, 24 nt, Artificial Sequence
  Synthetic
ugagucagaggcggccgagcgccg

SEQ ID NO: 20606 - RNA, 18 nt, Artificial Sequence
  Synthetic
ggcggcccgcggucgccg

SEQ ID NO: 20607 - RNA, 19 nt, Artificial Sequence
  Synthetic
aggcggcccgcggucgccg

SEQ ID NO: 20608 - RNA, 20 nt, Artificial Sequence
  Synthetic
caggcggcccgcggucgccg

SEQ ID NO: 20609 - RNA, 21 nt, Artificial Sequence
  Synthetic
ccaggcggcccgcggucgccg

SEQ ID NO: 20610 - RNA, 22 nt, Artificial Sequence
  Synthetic
uccaggcggcccgcggucgccg

SEQ ID NO: 20611 - RNA, 23 nt, Artificial Sequence
  Synthetic
cuccaggcggcccgcggucgccg

SEQ ID NO: 20612 - RNA, 24 nt, Artificial Sequence
  Synthetic
gcuccaggcggcccgcggucgccg

SEQ ID NO: 20613 - RNA, 18 nt, Artificial Sequence
  Synthetic
ccggccccaaaggggccg

SEQ ID NO: 20614 - RNA, 19 nt, Artificial Sequence
  Synthetic
gccggccccaaaggggccg

SEQ ID NO: 20615 - RNA, 20 nt, Artificial Sequence
  Synthetic
cgccggccccaaaggggccg

SEQ ID NO: 20616 - RNA, 21 nt, Artificial Sequence
  Synthetic
ccgccggccccaaaggggccg

SEQ ID NO: 20617 - RNA, 22 nt, Artificial Sequence
  Synthetic
cccgccggccccaaaggggccg

SEQ ID NO: 20618 - RNA, 23 nt, Artificial Sequence
  Synthetic
ccccgccggccccaaaggggccg

SEQ ID NO: 20619 - RNA, 24 nt, Artificial Sequence
  Synthetic
cccccgccggccccaaaggggccg

SEQ ID NO: 20620 - RNA, 18 nt, Artificial Sequence
  Synthetic
gccuccucgucguccgcg

SEQ ID NO: 20621 - RNA, 19 nt, Artificial Sequence
  Synthetic
cgccuccucgucguccgcg

SEQ ID NO: 20622 - RNA, 20 nt, Artificial Sequence
  Synthetic
ccgccuccucgucguccgcg

SEQ ID NO: 20623 - RNA, 21 nt, Artificial Sequence
  Synthetic
cccgccuccucgucguccgcg

SEQ ID NO: 20624 - RNA, 22 nt, Artificial Sequence
  Synthetic
ccccgccuccucgucguccgcg

SEQ ID NO: 20625 - RNA, 23 nt, Artificial Sequence
  Synthetic
cccccgccuccucgucguccgcg

SEQ ID NO: 20626 - RNA, 24 nt, Artificial Sequence
  Synthetic
acccccgccuccucgucguccgcg

SEQ ID NO: 20627 - RNA, 18 nt, Artificial Sequence
  Synthetic
gggcacaccggcugcgcg

SEQ ID NO: 20628 - RNA, 19 nt, Artificial Sequence
  Synthetic
ggggcacaccggcugcgcg

SEQ ID NO: 20629 - RNA, 20 nt, Artificial Sequence
  Synthetic
aggggcacaccggcugcgcg

SEQ ID NO: 20630 - RNA, 21 nt, Artificial Sequence
  Synthetic
caggggcacaccggcugcgcg

SEQ ID NO: 20631 - RNA, 22 nt, Artificial Sequence
  Synthetic
ccaggggcacaccggcugcgcg

SEQ ID NO: 20632 - RNA, 23 nt, Artificial Sequence
  Synthetic
accaggggcacaccggcugcgcg

SEQ ID NO: 20633 - RNA, 24 nt, Artificial Sequence
  Synthetic
caccaggggcacaccggcugcgcg

SEQ ID NO: 20634 - RNA, 18 nt, Artificial Sequence
  Synthetic
gacgaggaggaggaggcg

SEQ ID NO: 20635 - RNA, 19 nt, Artificial Sequence
  Synthetic
agacgaggaggaggaggcg

SEQ ID NO: 20636 - RNA, 20 nt, Artificial Sequence
  Synthetic
cagacgaggaggaggaggcg

SEQ ID NO: 20637 - RNA, 21 nt, Artificial Sequence
  Synthetic
gcagacgaggaggaggaggcg

SEQ ID NO: 20638 - RNA, 22 nt, Artificial Sequence
  Synthetic
ugcagacgaggaggaggaggcg

SEQ ID NO: 20639 - RNA, 23 nt, Artificial Sequence
  Synthetic
augcagacgaggaggaggaggcg

SEQ ID NO: 20640 - RNA, 24 nt, Artificial Sequence
  Synthetic
gaugcagacgaggaggaggaggcg

SEQ ID NO: 20641 - RNA, 18 nt, Artificial Sequence
  Synthetic
gaggcggaggaggaggcg

SEQ ID NO: 20642 - RNA, 19 nt, Artificial Sequence
  Synthetic
ggaggcggaggaggaggcg

SEQ ID NO: 20643 - RNA, 20 nt, Artificial Sequence
  Synthetic
aggaggcggaggaggaggcg

SEQ ID NO: 20644 - RNA, 21 nt, Artificial Sequence
  Synthetic
gaggaggcggaggaggaggcg

SEQ ID NO: 20645 - RNA, 22 nt, Artificial Sequence
  Synthetic
ggaggaggcggaggaggaggcg

SEQ ID NO: 20646 - RNA, 23 nt, Artificial Sequence
  Synthetic
aggaggaggcggaggaggaggcg

SEQ ID NO: 20647 - RNA, 24 nt, Artificial Sequence
  Synthetic
gaggaggaggcggaggaggaggcg

SEQ ID NO: 20648 - RNA, 18 nt, Artificial Sequence
  Synthetic
ggcggccgagcgccggcg

SEQ ID NO: 20649 - RNA, 19 nt, Artificial Sequence
  Synthetic
aggcggccgagcgccggcg

SEQ ID NO: 20650 - RNA, 20 nt, Artificial Sequence
  Synthetic
gaggcggccgagcgccggcg

SEQ ID NO: 20651 - RNA, 21 nt, Artificial Sequence
  Synthetic
agaggcggccgagcgccggcg

SEQ ID NO: 20652 - RNA, 22 nt, Artificial Sequence
  Synthetic
cagaggcggccgagcgccggcg

SEQ ID NO: 20653 - RNA, 23 nt, Artificial Sequence
  Synthetic
ucagaggcggccgagcgccggcg

SEQ ID NO: 20654 - RNA, 24 nt, Artificial Sequence
  Synthetic
gucagaggcggccgagcgccggcg

SEQ ID NO: 20655 - RNA, 18 nt, Artificial Sequence
  Synthetic
gguggugucggcggggcg

SEQ ID NO: 20656 - RNA, 19 nt, Artificial Sequence
  Synthetic
ugguggugucggcggggcg

SEQ ID NO: 20657 - RNA, 20 nt, Artificial Sequence
  Synthetic
gugguggugucggcggggcg

SEQ ID NO: 20658 - RNA, 21 nt, Artificial Sequence
  Synthetic
ggugguggugucggcggggcg

SEQ ID NO: 20659 - RNA, 22 nt, Artificial Sequence
  Synthetic
uggugguggugucggcggggcg

SEQ ID NO: 20660 - RNA, 23 nt, Artificial Sequence
  Synthetic
guggugguggugucggcggggcg

SEQ ID NO: 20661 - RNA, 24 nt, Artificial Sequence
  Synthetic
gguggugguggugucggcggggcg

SEQ ID NO: 20662 - RNA, 18 nt, Artificial Sequence
  Synthetic
gugguggugguggugucg

SEQ ID NO: 20663 - RNA, 19 nt, Artificial Sequence
  Synthetic
ggugguggugguggugucg

SEQ ID NO: 20664 - RNA, 20 nt, Artificial Sequence
  Synthetic
uggugguggugguggugucg

SEQ ID NO: 20665 - RNA, 21 nt, Artificial Sequence
  Synthetic
guggugguggugguggugucg

SEQ ID NO: 20666 - RNA, 22 nt, Artificial Sequence
  Synthetic
gguggugguggugguggugucg

SEQ ID NO: 20667 - RNA, 23 nt, Artificial Sequence
  Synthetic
ugguggugguggugguggugucg

SEQ ID NO: 20668 - RNA, 24 nt, Artificial Sequence
  Synthetic
gugguggugguggugguggugucg

SEQ ID NO: 20669 - RNA, 18 nt, Artificial Sequence
  Synthetic
aggcggaugcagacgagg

SEQ ID NO: 20670 - RNA, 19 nt, Artificial Sequence
  Synthetic
gaggcggaugcagacgagg

SEQ ID NO: 20671 - RNA, 20 nt, Artificial Sequence
  Synthetic
ggaggcggaugcagacgagg

SEQ ID NO: 20672 - RNA, 21 nt, Artificial Sequence
  Synthetic
aggaggcggaugcagacgagg

SEQ ID NO: 20673 - RNA, 22 nt, Artificial Sequence
  Synthetic
gaggaggcggaugcagacgagg

SEQ ID NO: 20674 - RNA, 23 nt, Artificial Sequence
  Synthetic
cgaggaggcggaugcagacgagg

SEQ ID NO: 20675 - RNA, 24 nt, Artificial Sequence
  Synthetic
acgaggaggcggaugcagacgagg

SEQ ID NO: 20676 - RNA, 18 nt, Artificial Sequence
  Synthetic
cggaugcagacgaggagg

SEQ ID NO: 20677 - RNA, 19 nt, Artificial Sequence
  Synthetic
gcggaugcagacgaggagg

SEQ ID NO: 20678 - RNA, 20 nt, Artificial Sequence
  Synthetic
ggcggaugcagacgaggagg

SEQ ID NO: 20679 - RNA, 21 nt, Artificial Sequence
  Synthetic
aggcggaugcagacgaggagg

SEQ ID NO: 20680 - RNA, 22 nt, Artificial Sequence
  Synthetic
gaggcggaugcagacgaggagg

SEQ ID NO: 20681 - RNA, 23 nt, Artificial Sequence
  Synthetic
ggaggcggaugcagacgaggagg

SEQ ID NO: 20682 - RNA, 24 nt, Artificial Sequence
  Synthetic
aggaggcggaugcagacgaggagg

SEQ ID NO: 20683 - RNA, 18 nt, Artificial Sequence
  Synthetic
cagacgaggaggaggagg

SEQ ID NO: 20684 - RNA, 19 nt, Artificial Sequence
  Synthetic
gcagacgaggaggaggagg

SEQ ID NO: 20685 - RNA, 20 nt, Artificial Sequence
  Synthetic
ugcagacgaggaggaggagg

SEQ ID NO: 20686 - RNA, 21 nt, Artificial Sequence
  Synthetic
augcagacgaggaggaggagg

SEQ ID NO: 20687 - RNA, 22 nt, Artificial Sequence
  Synthetic
gaugcagacgaggaggaggagg

SEQ ID NO: 20688 - RNA, 23 nt, Artificial Sequence
  Synthetic
ggaugcagacgaggaggaggagg

SEQ ID NO: 20689 - RNA, 24 nt, Artificial Sequence
  Synthetic
cggaugcagacgaggaggaggagg

SEQ ID NO: 20690 - RNA, 18 nt, Artificial Sequence
  Synthetic
aggaggcggaggaggagg

SEQ ID NO: 20691 - RNA, 19 nt, Artificial Sequence
  Synthetic
gaggaggcggaggaggagg

SEQ ID NO: 20692 - RNA, 20 nt, Artificial Sequence
  Synthetic
ggaggaggcggaggaggagg

SEQ ID NO: 20693 - RNA, 21 nt, Artificial Sequence
  Synthetic
aggaggaggcggaggaggagg

SEQ ID NO: 20694 - RNA, 22 nt, Artificial Sequence
  Synthetic
gaggaggaggcggaggaggagg

SEQ ID NO: 20695 - RNA, 23 nt, Artificial Sequence
  Synthetic
ggaggaggaggcggaggaggagg

SEQ ID NO: 20696 - RNA, 24 nt, Artificial Sequence
  Synthetic
aggaggaggaggcggaggaggagg

SEQ ID NO: 20697 - RNA, 18 nt, Artificial Sequence
  Synthetic
aggaggaggaggcggagg

SEQ ID NO: 20698 - RNA, 19 nt, Artificial Sequence
  Synthetic
gaggaggaggaggcggagg

SEQ ID NO: 20699 - RNA, 20 nt, Artificial Sequence
  Synthetic
cgaggaggaggaggcggagg

SEQ ID NO: 20700 - RNA, 21 nt, Artificial Sequence
  Synthetic
acgaggaggaggaggcggagg

SEQ ID NO: 20701 - RNA, 22 nt, Artificial Sequence
  Synthetic
gacgaggaggaggaggcggagg

SEQ ID NO: 20702 - RNA, 23 nt, Artificial Sequence
  Synthetic
agacgaggaggaggaggcggagg

SEQ ID NO: 20703 - RNA, 24 nt, Artificial Sequence
  Synthetic
cagacgaggaggaggaggcggagg

SEQ ID NO: 20704 - RNA, 18 nt, Artificial Sequence
  Synthetic
gccccgaggcgggcccgg

SEQ ID NO: 20705 - RNA, 19 nt, Artificial Sequence
  Synthetic
cgccccgaggcgggcccgg

SEQ ID NO: 20706 - RNA, 20 nt, Artificial Sequence
  Synthetic
ccgccccgaggcgggcccgg

SEQ ID NO: 20707 - RNA, 21 nt, Artificial Sequence
  Synthetic
uccgccccgaggcgggcccgg

SEQ ID NO: 20708 - RNA, 22 nt, Artificial Sequence
  Synthetic
cuccgccccgaggcgggcccgg

SEQ ID NO: 20709 - RNA, 23 nt, Artificial Sequence
  Synthetic
gcuccgccccgaggcgggcccgg

SEQ ID NO: 20710 - RNA, 24 nt, Artificial Sequence
  Synthetic
ggcuccgccccgaggcgggcccgg

SEQ ID NO: 20711 - RNA, 18 nt, Artificial Sequence
  Synthetic
gaggcggccgagcgccgg

SEQ ID NO: 20712 - RNA, 19 nt, Artificial Sequence
  Synthetic
agaggcggccgagcgccgg

SEQ ID NO: 20713 - RNA, 20 nt, Artificial Sequence
  Synthetic
cagaggcggccgagcgccgg

SEQ ID NO: 20714 - RNA, 21 nt, Artificial Sequence
  Synthetic
ucagaggcggccgagcgccgg

SEQ ID NO: 20715 - RNA, 22 nt, Artificial Sequence
  Synthetic
gucagaggcggccgagcgccgg

SEQ ID NO: 20716 - RNA, 23 nt, Artificial Sequence
  Synthetic
agucagaggcggccgagcgccgg

SEQ ID NO: 20717 - RNA, 24 nt, Artificial Sequence
  Synthetic
gagucagaggcggccgagcgccgg

SEQ ID NO: 20718 - RNA, 18 nt, Artificial Sequence
  Synthetic
ggcacaccggcugcgcgg

SEQ ID NO: 20719 - RNA, 19 nt, Artificial Sequence
  Synthetic
gggcacaccggcugcgcgg

SEQ ID NO: 20720 - RNA, 20 nt, Artificial Sequence
  Synthetic
ggggcacaccggcugcgcgg

SEQ ID NO: 20721 - RNA, 21 nt, Artificial Sequence
  Synthetic
aggggcacaccggcugcgcgg

SEQ ID NO: 20722 - RNA, 22 nt, Artificial Sequence
  Synthetic
caggggcacaccggcugcgcgg

SEQ ID NO: 20723 - RNA, 23 nt, Artificial Sequence
  Synthetic
ccaggggcacaccggcugcgcgg

SEQ ID NO: 20724 - RNA, 24 nt, Artificial Sequence
  Synthetic
accaggggcacaccggcugcgcgg

SEQ ID NO: 20725 - RNA, 18 nt, Artificial Sequence
  Synthetic
uugaugagucagaggcgg

SEQ ID NO: 20726 - RNA, 19 nt, Artificial Sequence
  Synthetic
uuugaugagucagaggcgg

SEQ ID NO: 20727 - RNA, 20 nt, Artificial Sequence
  Synthetic
uuuugaugagucagaggcgg

SEQ ID NO: 20728 - RNA, 21 nt, Artificial Sequence
  Synthetic
auuuugaugagucagaggcgg

SEQ ID NO: 20729 - RNA, 22 nt, Artificial Sequence
  Synthetic
gauuuugaugagucagaggcgg

SEQ ID NO: 20730 - RNA, 23 nt, Artificial Sequence
  Synthetic
ggauuuugaugagucagaggcgg

SEQ ID NO: 20731 - RNA, 24 nt, Artificial Sequence
  Synthetic
cggauuuugaugagucagaggcgg

SEQ ID NO: 20732 - RNA, 18 nt, Artificial Sequence
  Synthetic
acgaggaggaggaggcgg

SEQ ID NO: 20733 - RNA, 19 nt, Artificial Sequence
  Synthetic
gacgaggaggaggaggcgg

SEQ ID NO: 20734 - RNA, 20 nt, Artificial Sequence
  Synthetic
agacgaggaggaggaggcgg

SEQ ID NO: 20735 - RNA, 21 nt, Artificial Sequence
  Synthetic
cagacgaggaggaggaggcgg

SEQ ID NO: 20736 - RNA, 22 nt, Artificial Sequence
  Synthetic
gcagacgaggaggaggaggcgg

SEQ ID NO: 20737 - RNA, 23 nt, Artificial Sequence
  Synthetic
ugcagacgaggaggaggaggcgg

SEQ ID NO: 20738 - RNA, 24 nt, Artificial Sequence
  Synthetic
augcagacgaggaggaggaggcgg

SEQ ID NO: 20739 - RNA, 18 nt, Artificial Sequence
  Synthetic
ggcccugggcgggcucgg

SEQ ID NO: 20740 - RNA, 19 nt, Artificial Sequence
  Synthetic
cggcccugggcgggcucgg

SEQ ID NO: 20741 - RNA, 20 nt, Artificial Sequence
  Synthetic
ucggcccugggcgggcucgg

SEQ ID NO: 20742 - RNA, 21 nt, Artificial Sequence
  Synthetic
cucggcccugggcgggcucgg

SEQ ID NO: 20743 - RNA, 22 nt, Artificial Sequence
  Synthetic
gcucggcccugggcgggcucgg

SEQ ID NO: 20744 - RNA, 23 nt, Artificial Sequence
  Synthetic
ggcucggcccugggcgggcucgg

SEQ ID NO: 20745 - RNA, 24 nt, Artificial Sequence
  Synthetic
gggcucggcccugggcgggcucgg

SEQ ID NO: 20746 - RNA, 18 nt, Artificial Sequence
  Synthetic
ugguggugguggugucgg

SEQ ID NO: 20747 - RNA, 19 nt, Artificial Sequence
  Synthetic
gugguggugguggugucgg

SEQ ID NO: 20748 - RNA, 20 nt, Artificial Sequence
  Synthetic
ggugguggugguggugucgg

SEQ ID NO: 20749 - RNA, 21 nt, Artificial Sequence
  Synthetic
uggugguggugguggugucgg

SEQ ID NO: 20750 - RNA, 22 nt, Artificial Sequence
  Synthetic
guggugguggugguggugucgg

SEQ ID NO: 20751 - RNA, 23 nt, Artificial Sequence
  Synthetic
gguggugguggugguggugucgg

SEQ ID NO: 20752 - RNA, 24 nt, Artificial Sequence
  Synthetic
ugguggugguggugguggugucgg

SEQ ID NO: 20753 - RNA, 18 nt, Artificial Sequence
  Synthetic
gcggggguccgggccggg

SEQ ID NO: 20754 - RNA, 19 nt, Artificial Sequence
  Synthetic
cgcggggguccgggccggg

SEQ ID NO: 20755 - RNA, 20 nt, Artificial Sequence
  Synthetic
ccgcggggguccgggccggg

SEQ ID NO: 20756 - RNA, 21 nt, Artificial Sequence
  Synthetic
gccgcggggguccgggccggg

SEQ ID NO: 20757 - RNA, 22 nt, Artificial Sequence
  Synthetic
cgccgcggggguccgggccggg

SEQ ID NO: 20758 - RNA, 23 nt, Artificial Sequence
  Synthetic
ucgccgcggggguccgggccggg

SEQ ID NO: 20759 - RNA, 24 nt, Artificial Sequence
  Synthetic
gucgccgcggggguccgggccggg

SEQ ID NO: 20760 - RNA, 18 nt, Artificial Sequence
  Synthetic
ucgccgcggggguccggg

SEQ ID NO: 20761 - RNA, 19 nt, Artificial Sequence
  Synthetic
gucgccgcggggguccggg

SEQ ID NO: 20762 - RNA, 20 nt, Artificial Sequence
  Synthetic
ggucgccgcggggguccggg

SEQ ID NO: 20763 - RNA, 21 nt, Artificial Sequence
  Synthetic
cggucgccgcggggguccggg

SEQ ID NO: 20764 - RNA, 22 nt, Artificial Sequence
  Synthetic
gcggucgccgcggggguccggg

SEQ ID NO: 20765 - RNA, 23 nt, Artificial Sequence
  Synthetic
cgcggucgccgcggggguccggg

SEQ ID NO: 20766 - RNA, 24 nt, Artificial Sequence
  Synthetic
ccgcggucgccgcggggguccggg

SEQ ID NO: 20767 - RNA, 18 nt, Artificial Sequence
  Synthetic
ggcuccgccccaaagggg

SEQ ID NO: 20768 - RNA, 19 nt, Artificial Sequence
  Synthetic
cggcuccgccccaaagggg

SEQ ID NO: 20769 - RNA, 20 nt, Artificial Sequence
  Synthetic
gcggcuccgccccaaagggg

SEQ ID NO: 20770 - RNA, 21 nt, Artificial Sequence
  Synthetic
ggcggcuccgccccaaagggg

SEQ ID NO: 20771 - RNA, 22 nt, Artificial Sequence
  Synthetic
gggcggcuccgccccaaagggg

SEQ ID NO: 20772 - RNA, 23 nt, Artificial Sequence
  Synthetic
cgggcggcuccgccccaaagggg

SEQ ID NO: 20773 - RNA, 24 nt, Artificial Sequence
  Synthetic
gcgggcggcuccgccccaaagggg

SEQ ID NO: 20774 - RNA, 19 nt, Artificial Sequence
  Synthetic
gggcuccgccccaaagggg

SEQ ID NO: 20775 - RNA, 20 nt, Artificial Sequence
  Synthetic
cgggcuccgccccaaagggg

SEQ ID NO: 20776 - RNA, 21 nt, Artificial Sequence
  Synthetic
gcgggcuccgccccaaagggg

SEQ ID NO: 20777 - RNA, 22 nt, Artificial Sequence
  Synthetic
cgcgggcuccgccccaaagggg

SEQ ID NO: 20778 - RNA, 23 nt, Artificial Sequence
  Synthetic
ccgcgggcuccgccccaaagggg

SEQ ID NO: 20779 - RNA, 24 nt, Artificial Sequence
  Synthetic
cccgcgggcuccgccccaaagggg

SEQ ID NO: 20780 - RNA, 18 nt, Artificial Sequence
  Synthetic
gcuccgccccaaaggggg

SEQ ID NO: 20781 - RNA, 19 nt, Artificial Sequence
  Synthetic
ggcuccgccccaaaggggg

SEQ ID NO: 20782 - RNA, 20 nt, Artificial Sequence
  Synthetic
cggcuccgccccaaaggggg

SEQ ID NO: 20783 - RNA, 21 nt, Artificial Sequence
  Synthetic
gcggcuccgccccaaaggggg

SEQ ID NO: 20784 - RNA, 22 nt, Artificial Sequence
  Synthetic
ggcggcuccgccccaaaggggg

SEQ ID NO: 20785 - RNA, 23 nt, Artificial Sequence
  Synthetic
gggcggcuccgccccaaaggggg

SEQ ID NO: 20786 - RNA, 24 nt, Artificial Sequence
  Synthetic
cgggcggcuccgccccaaaggggg

SEQ ID NO: 20787 - RNA, 20 nt, Artificial Sequence
  Synthetic
gggcuccgccccaaaggggg

SEQ ID NO: 20788 - RNA, 21 nt, Artificial Sequence
  Synthetic
cgggcuccgccccaaaggggg

SEQ ID NO: 20789 - RNA, 22 nt, Artificial Sequence
  Synthetic
gcgggcuccgccccaaaggggg

SEQ ID NO: 20790 - RNA, 23 nt, Artificial Sequence
  Synthetic
cgcgggcuccgccccaaaggggg

SEQ ID NO: 20791 - RNA, 24 nt, Artificial Sequence
  Synthetic
ccgcgggcuccgccccaaaggggg

SEQ ID NO: 20792 - RNA, 18 nt, Artificial Sequence
  Synthetic
ggcgggcccggacggggg

SEQ ID NO: 20793 - RNA, 19 nt, Artificial Sequence
  Synthetic
aggcgggcccggacggggg

SEQ ID NO: 20794 - RNA, 20 nt, Artificial Sequence
  Synthetic
gaggcgggcccggacggggg

SEQ ID NO: 20795 - RNA, 21 nt, Artificial Sequence
  Synthetic
cgaggcgggcccggacggggg

SEQ ID NO: 20796 - RNA, 22 nt, Artificial Sequence
  Synthetic
ccgaggcgggcccggacggggg

SEQ ID NO: 20797 - RNA, 23 nt, Artificial Sequence
  Synthetic
cccgaggcgggcccggacggggg

SEQ ID NO: 20798 - RNA, 24 nt, Artificial Sequence
  Synthetic
ccccgaggcgggcccggacggggg

SEQ ID NO: 20799 - RNA, 18 nt, Artificial Sequence
  Synthetic
gggcgggcucggcccugg

SEQ ID NO: 20800 - RNA, 19 nt, Artificial Sequence
  Synthetic
ggggcgggcucggcccugg

SEQ ID NO: 20801 - RNA, 20 nt, Artificial Sequence
  Synthetic
cggggcgggcucggcccugg

SEQ ID NO: 20802 - RNA, 21 nt, Artificial Sequence
  Synthetic
ccggggcgggcucggcccugg

SEQ ID NO: 20803 - RNA, 22 nt, Artificial Sequence
  Synthetic
gccggggcgggcucggcccugg

SEQ ID NO: 20804 - RNA, 23 nt, Artificial Sequence
  Synthetic
ggccggggcgggcucggcccugg

SEQ ID NO: 20805 - RNA, 24 nt, Artificial Sequence
  Synthetic
gggccggggcgggcucggcccugg

SEQ ID NO: 20806 - RNA, 18 nt, Artificial Sequence
  Synthetic
cguggucugcggcgcugg

SEQ ID NO: 20807 - RNA, 19 nt, Artificial Sequence
  Synthetic
gcguggucugcggcgcugg

SEQ ID NO: 20808 - RNA, 20 nt, Artificial Sequence
  Synthetic
ggcguggucugcggcgcugg

SEQ ID NO: 20809 - RNA, 21 nt, Artificial Sequence
  Synthetic
cggcguggucugcggcgcugg

SEQ ID NO: 20810 - RNA, 22 nt, Artificial Sequence
  Synthetic
gcggcguggucugcggcgcugg

SEQ ID NO: 20811 - RNA, 23 nt, Artificial Sequence
  Synthetic
cgcggcguggucugcggcgcugg

SEQ ID NO: 20812 - RNA, 24 nt, Artificial Sequence
  Synthetic
ccgcggcguggucugcggcgcugg

SEQ ID NO: 20813 - RNA, 18 nt, Artificial Sequence
  Synthetic
gcguggucugcggcgcug

SEQ ID NO: 20814 - RNA, 19 nt, Artificial Sequence
  Synthetic
ggcguggucugcggcgcug

SEQ ID NO: 20815 - RNA, 20 nt, Artificial Sequence
  Synthetic
cggcguggucugcggcgcug

SEQ ID NO: 20816 - RNA, 21 nt, Artificial Sequence
  Synthetic
gcggcguggucugcggcgcug

SEQ ID NO: 20817 - RNA, 22 nt, Artificial Sequence
  Synthetic
cgcggcguggucugcggcgcug

SEQ ID NO: 20818 - RNA, 23 nt, Artificial Sequence
  Synthetic
ccgcggcguggucugcggcgcug

SEQ ID NO: 20819 - RNA, 24 nt, Artificial Sequence
  Synthetic
cccgcggcguggucugcggcgcug

SEQ ID NO: 20820 - RNA, 18 nt, Artificial Sequence
  Synthetic
uaauaguauauauauuau

SEQ ID NO: 20821 - RNA, 19 nt, Artificial Sequence
  Synthetic
cuaauaguauauauauuau

SEQ ID NO: 20822 - RNA, 20 nt, Artificial Sequence
  Synthetic
ccuaauaguauauauauuau

SEQ ID NO: 20823 - RNA, 21 nt, Artificial Sequence
  Synthetic
uccuaauaguauauauauuau

SEQ ID NO: 20824 - RNA, 22 nt, Artificial Sequence
  Synthetic
guccuaauaguauauauauuau

SEQ ID NO: 20825 - RNA, 23 nt, Artificial Sequence
  Synthetic
cguccuaauaguauauauauuau

SEQ ID NO: 20826 - RNA, 24 nt, Artificial Sequence
  Synthetic
ucguccuaauaguauauauauuau

SEQ ID NO: 20827 - RNA, 18 nt, Artificial Sequence
  Synthetic
auauuauuagggcaaagu

SEQ ID NO: 20828 - RNA, 19 nt, Artificial Sequence
  Synthetic
uauauuauuagggcaaagu

SEQ ID NO: 20829 - RNA, 20 nt, Artificial Sequence
  Synthetic
auauauuauuagggcaaagu

SEQ ID NO: 20830 - RNA, 21 nt, Artificial Sequence
  Synthetic
uauauauuauuagggcaaagu

SEQ ID NO: 20831 - RNA, 22 nt, Artificial Sequence
  Synthetic
auauauauuauuagggcaaagu

SEQ ID NO: 20832 - RNA, 23 nt, Artificial Sequence
  Synthetic
uauauauauuauuagggcaaagu

SEQ ID NO: 20833 - RNA, 24 nt, Artificial Sequence
  Synthetic
guauauauauuauuagggcaaagu

SEQ ID NO: 20834 - RNA, 18 nt, Artificial Sequence
  Synthetic
ccgcaggguaaaagaagu

SEQ ID NO: 20835 - RNA, 19 nt, Artificial Sequence
  Synthetic
gccgcaggguaaaagaagu

SEQ ID NO: 20836 - RNA, 20 nt, Artificial Sequence
  Synthetic
ggccgcaggguaaaagaagu

SEQ ID NO: 20837 - RNA, 21 nt, Artificial Sequence
  Synthetic
gggccgcaggguaaaagaagu

SEQ ID NO: 20838 - RNA, 22 nt, Artificial Sequence
  Synthetic
ggggccgcaggguaaaagaagu

SEQ ID NO: 20839 - RNA, 23 nt, Artificial Sequence
  Synthetic
cggggccgcaggguaaaagaagu

SEQ ID NO: 20840 - RNA, 24 nt, Artificial Sequence
  Synthetic
gcggggccgcaggguaaaagaagu

SEQ ID NO: 20841 - RNA, 18 nt, Artificial Sequence
  Synthetic
auccggauuuugaugagu

SEQ ID NO: 20842 - RNA, 19 nt, Artificial Sequence
  Synthetic
gauccggauuuugaugagu

SEQ ID NO: 20843 - RNA, 20 nt, Artificial Sequence
  Synthetic
ggauccggauuuugaugagu

SEQ ID NO: 20844 - RNA, 21 nt, Artificial Sequence
  Synthetic
aggauccggauuuugaugagu

SEQ ID NO: 20845 - RNA, 22 nt, Artificial Sequence
  Synthetic
gaggauccggauuuugaugagu

SEQ ID NO: 20846 - RNA, 23 nt, Artificial Sequence
  Synthetic
cgaggauccggauuuugaugagu

SEQ ID NO: 20847 - RNA, 24 nt, Artificial Sequence
  Synthetic
acgaggauccggauuuugaugagu

SEQ ID NO: 20848 - RNA, 18 nt, Artificial Sequence
  Synthetic
cgcggucgccgcgggggu

SEQ ID NO: 20849 - RNA, 19 nt, Artificial Sequence
  Synthetic
ccgcggucgccgcgggggu

SEQ ID NO: 20850 - RNA, 20 nt, Artificial Sequence
  Synthetic
cccgcggucgccgcgggggu

SEQ ID NO: 20851 - RNA, 21 nt, Artificial Sequence
  Synthetic
gcccgcggucgccgcgggggu

SEQ ID NO: 20852 - RNA, 22 nt, Artificial Sequence
  Synthetic
ggcccgcggucgccgcgggggu

SEQ ID NO: 20853 - RNA, 23 nt, Artificial Sequence
  Synthetic
cggcccgcggucgccgcgggggu

SEQ ID NO: 20854 - RNA, 24 nt, Artificial Sequence
  Synthetic
gcggcccgcggucgccgcgggggu

SEQ ID NO: 20855 - RNA, 18 nt, Artificial Sequence
  Synthetic
gagccgcccgcggaccaa

SEQ ID NO: 20856 - RNA, 19 nt, Artificial Sequence
  Synthetic
ggagccgcccgcggaccaa

SEQ ID NO: 20857 - RNA, 20 nt, Artificial Sequence
  Synthetic
cggagccgcccgcggaccaa

SEQ ID NO: 20858 - RNA, 21 nt, Artificial Sequence
  Synthetic
gcggagccgcccgcggaccaa

SEQ ID NO: 20859 - RNA, 22 nt, Artificial Sequence
  Synthetic
ggcggagccgcccgcggaccaa

SEQ ID NO: 20860 - RNA, 23 nt, Artificial Sequence
  Synthetic
gggcggagccgcccgcggaccaa

SEQ ID NO: 20861 - RNA, 24 nt, Artificial Sequence
  Synthetic
ggggcggagccgcccgcggaccaa

SEQ ID NO: 20862 - RNA, 18 nt, Artificial Sequence
  Synthetic
ggggccggcgggggccaa

SEQ ID NO: 20863 - RNA, 19 nt, Artificial Sequence
  Synthetic
uggggccggcgggggccaa

SEQ ID NO: 20864 - RNA, 20 nt, Artificial Sequence
  Synthetic
uuggggccggcgggggccaa

SEQ ID NO: 20865 - RNA, 21 nt, Artificial Sequence
  Synthetic
uuuggggccggcgggggccaa

SEQ ID NO: 20866 - RNA, 22 nt, Artificial Sequence
  Synthetic
cuuuggggccggcgggggccaa

SEQ ID NO: 20867 - RNA, 23 nt, Artificial Sequence
  Synthetic
ccuuuggggccggcgggggccaa

SEQ ID NO: 20868 - RNA, 24 nt, Artificial Sequence
  Synthetic
cccuuuggggccggcgggggccaa

SEQ ID NO: 20869 - RNA, 18 nt, Artificial Sequence
  Synthetic
ggagccgcccgcggacca

SEQ ID NO: 20870 - RNA, 19 nt, Artificial Sequence
  Synthetic
cggagccgcccgcggacca

SEQ ID NO: 20871 - RNA, 20 nt, Artificial Sequence
  Synthetic
gcggagccgcccgcggacca

SEQ ID NO: 20872 - RNA, 21 nt, Artificial Sequence
  Synthetic
ggcggagccgcccgcggacca

SEQ ID NO: 20873 - RNA, 22 nt, Artificial Sequence
  Synthetic
gggcggagccgcccgcggacca

SEQ ID NO: 20874 - RNA, 23 nt, Artificial Sequence
  Synthetic
ggggcggagccgcccgcggacca

SEQ ID NO: 20875 - RNA, 24 nt, Artificial Sequence
  Synthetic
uggggcggagccgcccgcggacca

SEQ ID NO: 20876 - RNA, 18 nt, Artificial Sequence
  Synthetic
uggggccggcgggggcca

SEQ ID NO: 20877 - RNA, 19 nt, Artificial Sequence
  Synthetic
uuggggccggcgggggcca

SEQ ID NO: 20878 - RNA, 20 nt, Artificial Sequence
  Synthetic
uuuggggccggcgggggcca

SEQ ID NO: 20879 - RNA, 21 nt, Artificial Sequence
  Synthetic
cuuuggggccggcgggggcca

SEQ ID NO: 20880 - RNA, 22 nt, Artificial Sequence
  Synthetic
ccuuuggggccggcgggggcca

SEQ ID NO: 20881 - RNA, 23 nt, Artificial Sequence
  Synthetic
cccuuuggggccggcgggggcca

SEQ ID NO: 20882 - RNA, 24 nt, Artificial Sequence
  Synthetic
ccccuuuggggccggcgggggcca

SEQ ID NO: 20883 - RNA, 18 nt, Artificial Sequence
  Synthetic
ccccuggugcggcggcga

SEQ ID NO: 20884 - RNA, 19 nt, Artificial Sequence
  Synthetic
gccccuggugcggcggcga

SEQ ID NO: 20885 - RNA, 20 nt, Artificial Sequence
  Synthetic
ugccccuggugcggcggcga

SEQ ID NO: 20886 - RNA, 21 nt, Artificial Sequence
  Synthetic
gugccccuggugcggcggcga

SEQ ID NO: 20887 - RNA, 22 nt, Artificial Sequence
  Synthetic
ugugccccuggugcggcggcga

SEQ ID NO: 20888 - RNA, 23 nt, Artificial Sequence
  Synthetic
gugugccccuggugcggcggcga

SEQ ID NO: 20889 - RNA, 24 nt, Artificial Sequence
  Synthetic
ggugugccccuggugcggcggcga

SEQ ID NO: 20890 - RNA, 18 nt, Artificial Sequence
  Synthetic
ggccgcuggguccgcgga

SEQ ID NO: 20891 - RNA, 19 nt, Artificial Sequence
  Synthetic
gggccgcuggguccgcgga

SEQ ID NO: 20892 - RNA, 20 nt, Artificial Sequence
  Synthetic
cgggccgcuggguccgcgga

SEQ ID NO: 20893 - RNA, 21 nt, Artificial Sequence
  Synthetic
gcgggccgcuggguccgcgga

SEQ ID NO: 20894 - RNA, 22 nt, Artificial Sequence
  Synthetic
cgcgggccgcuggguccgcgga

SEQ ID NO: 20895 - RNA, 23 nt, Artificial Sequence
  Synthetic
acgcgggccgcuggguccgcgga

SEQ ID NO: 20896 - RNA, 24 nt, Artificial Sequence
  Synthetic
gacgcgggccgcuggguccgcgga

SEQ ID NO: 20897 - RNA, 18 nt, Artificial Sequence
  Synthetic
gggccggcgggggccaac

SEQ ID NO: 20898 - RNA, 19 nt, Artificial Sequence
  Synthetic
ggggccggcgggggccaac

SEQ ID NO: 20899 - RNA, 20 nt, Artificial Sequence
  Synthetic
uggggccggcgggggccaac

SEQ ID NO: 20900 - RNA, 21 nt, Artificial Sequence
  Synthetic
uuggggccggcgggggccaac

SEQ ID NO: 20901 - RNA, 22 nt, Artificial Sequence
  Synthetic
uuuggggccggcgggggccaac

SEQ ID NO: 20902 - RNA, 23 nt, Artificial Sequence
  Synthetic
cuuuggggccggcgggggccaac

SEQ ID NO: 20903 - RNA, 24 nt, Artificial Sequence
  Synthetic
ccuuuggggccggcgggggccaac

SEQ ID NO: 20904 - RNA, 18 nt, Artificial Sequence
  Synthetic
acccucggcgcggacgac

SEQ ID NO: 20905 - RNA, 19 nt, Artificial Sequence
  Synthetic
gacccucggcgcggacgac

SEQ ID NO: 20906 - RNA, 20 nt, Artificial Sequence
  Synthetic
ggacccucggcgcggacgac

SEQ ID NO: 20907 - RNA, 21 nt, Artificial Sequence
  Synthetic
gggacccucggcgcggacgac

SEQ ID NO: 20908 - RNA, 22 nt, Artificial Sequence
  Synthetic
cgggacccucggcgcggacgac

SEQ ID NO: 20909 - RNA, 23 nt, Artificial Sequence
  Synthetic
gcgggacccucggcgcggacgac

SEQ ID NO: 20910 - RNA, 24 nt, Artificial Sequence
  Synthetic
ggcgggacccucggcgcggacgac

SEQ ID NO: 20911 - RNA, 18 nt, Artificial Sequence
  Synthetic
gaugacgacgaccgcgac

SEQ ID NO: 20912 - RNA, 19 nt, Artificial Sequence
  Synthetic
cgaugacgacgaccgcgac

SEQ ID NO: 20913 - RNA, 20 nt, Artificial Sequence
  Synthetic
acgaugacgacgaccgcgac

SEQ ID NO: 20914 - RNA, 21 nt, Artificial Sequence
  Synthetic
gacgaugacgacgaccgcgac

SEQ ID NO: 20915 - RNA, 22 nt, Artificial Sequence
  Synthetic
cgacgaugacgacgaccgcgac

SEQ ID NO: 20916 - RNA, 23 nt, Artificial Sequence
  Synthetic
acgacgaugacgacgaccgcgac

SEQ ID NO: 20917 - RNA, 24 nt, Artificial Sequence
  Synthetic
gacgacgaugacgacgaccgcgac

SEQ ID NO: 20918 - RNA, 18 nt, Artificial Sequence
  Synthetic
cccuggugcggcggcgac

SEQ ID NO: 20919 - RNA, 19 nt, Artificial Sequence
  Synthetic
ccccuggugcggcggcgac

SEQ ID NO: 20920 - RNA, 20 nt, Artificial Sequence
  Synthetic
gccccuggugcggcggcgac

SEQ ID NO: 20921 - RNA, 21 nt, Artificial Sequence
  Synthetic
ugccccuggugcggcggcgac

SEQ ID NO: 20922 - RNA, 22 nt, Artificial Sequence
  Synthetic
gugccccuggugcggcggcgac

SEQ ID NO: 20923 - RNA, 23 nt, Artificial Sequence
  Synthetic
ugugccccuggugcggcggcgac

SEQ ID NO: 20924 - RNA, 24 nt, Artificial Sequence
  Synthetic
gugugccccuggugcggcggcgac

SEQ ID NO: 20925 - RNA, 18 nt, Artificial Sequence
  Synthetic
gccgcuggguccgcggac

SEQ ID NO: 20926 - RNA, 19 nt, Artificial Sequence
  Synthetic
ggccgcuggguccgcggac

SEQ ID NO: 20927 - RNA, 20 nt, Artificial Sequence
  Synthetic
gggccgcuggguccgcggac

SEQ ID NO: 20928 - RNA, 21 nt, Artificial Sequence
  Synthetic
cgggccgcuggguccgcggac

SEQ ID NO: 20929 - RNA, 22 nt, Artificial Sequence
  Synthetic
gcgggccgcuggguccgcggac

SEQ ID NO: 20930 - RNA, 23 nt, Artificial Sequence
  Synthetic
cgcgggccgcuggguccgcggac

SEQ ID NO: 20931 - RNA, 24 nt, Artificial Sequence
  Synthetic
acgcgggccgcuggguccgcggac

SEQ ID NO: 20932 - RNA, 18 nt, Artificial Sequence
  Synthetic
cggagcccgcgggaugac

SEQ ID NO: 20933 - RNA, 19 nt, Artificial Sequence
  Synthetic
gcggagcccgcgggaugac

SEQ ID NO: 20934 - RNA, 20 nt, Artificial Sequence
  Synthetic
ggcggagcccgcgggaugac

SEQ ID NO: 20935 - RNA, 21 nt, Artificial Sequence
  Synthetic
gggcggagcccgcgggaugac

SEQ ID NO: 20936 - RNA, 22 nt, Artificial Sequence
  Synthetic
ggggcggagcccgcgggaugac

SEQ ID NO: 20937 - RNA, 23 nt, Artificial Sequence
  Synthetic
cggggcggagcccgcgggaugac

SEQ ID NO: 20938 - RNA, 24 nt, Artificial Sequence
  Synthetic
ucggggcggagcccgcgggaugac

SEQ ID NO: 20939 - RNA, 23 nt, Artificial Sequence
  Synthetic
uggggcggagcccgcgggaugac

SEQ ID NO: 20940 - RNA, 24 nt, Artificial Sequence
  Synthetic
uuggggcggagcccgcgggaugac

SEQ ID NO: 20941 - RNA, 18 nt, Artificial Sequence
  Synthetic
gcgguccgcggggcguac

SEQ ID NO: 20942 - RNA, 19 nt, Artificial Sequence
  Synthetic
cgcgguccgcggggcguac

SEQ ID NO: 20943 - RNA, 20 nt, Artificial Sequence
  Synthetic
ccgcgguccgcggggcguac

SEQ ID NO: 20944 - RNA, 21 nt, Artificial Sequence
  Synthetic
uccgcgguccgcggggcguac

SEQ ID NO: 20945 - RNA, 22 nt, Artificial Sequence
  Synthetic
guccgcgguccgcggggcguac

SEQ ID NO: 20946 - RNA, 23 nt, Artificial Sequence
  Synthetic
cguccgcgguccgcggggcguac

SEQ ID NO: 20947 - RNA, 24 nt, Artificial Sequence
  Synthetic
acguccgcgguccgcggggcguac

SEQ ID NO: 20948 - RNA, 18 nt, Artificial Sequence
  Synthetic
cggacccccgcggcgacc

SEQ ID NO: 20949 - RNA, 19 nt, Artificial Sequence
  Synthetic
ccggacccccgcggcgacc

SEQ ID NO: 20950 - RNA, 20 nt, Artificial Sequence
  Synthetic
cccggacccccgcggcgacc

SEQ ID NO: 20951 - RNA, 21 nt, Artificial Sequence
  Synthetic
gcccggacccccgcggcgacc

SEQ ID NO: 20952 - RNA, 22 nt, Artificial Sequence
  Synthetic
ggcccggacccccgcggcgacc

SEQ ID NO: 20953 - RNA, 23 nt, Artificial Sequence
  Synthetic
cggcccggacccccgcggcgacc

SEQ ID NO: 20954 - RNA, 24 nt, Artificial Sequence
  Synthetic
ccggcccggacccccgcggcgacc

SEQ ID NO: 20955 - RNA, 18 nt, Artificial Sequence
  Synthetic
ggccggcaucucauuacc

SEQ ID NO: 20956 - RNA, 19 nt, Artificial Sequence
  Synthetic
gggccggcaucucauuacc

SEQ ID NO: 20957 - RNA, 20 nt, Artificial Sequence
  Synthetic
ggggccggcaucucauuacc

SEQ ID NO: 20958 - RNA, 21 nt, Artificial Sequence
  Synthetic
cggggccggcaucucauuacc

SEQ ID NO: 20959 - RNA, 22 nt, Artificial Sequence
  Synthetic
gcggggccggcaucucauuacc

SEQ ID NO: 20960 - RNA, 23 nt, Artificial Sequence
  Synthetic
cgcggggccggcaucucauuacc

SEQ ID NO: 20961 - RNA, 24 nt, Artificial Sequence
  Synthetic
gcgcggggccggcaucucauuacc

SEQ ID NO: 20962 - RNA, 18 nt, Artificial Sequence
  Synthetic
ggugcccgcgagggcccc

SEQ ID NO: 20963 - RNA, 19 nt, Artificial Sequence
  Synthetic
gggugcccgcgagggcccc

SEQ ID NO: 20964 - RNA, 20 nt, Artificial Sequence
  Synthetic
ggggugcccgcgagggcccc

SEQ ID NO: 20965 - RNA, 21 nt, Artificial Sequence
  Synthetic
gggggugcccgcgagggcccc

SEQ ID NO: 20966 - RNA, 22 nt, Artificial Sequence
  Synthetic
cgggggugcccgcgagggcccc

SEQ ID NO: 20967 - RNA, 23 nt, Artificial Sequence
  Synthetic
gcgggggugcccgcgagggcccc

SEQ ID NO: 20968 - RNA, 24 nt, Artificial Sequence
  Synthetic
ggcgggggugcccgcgagggcccc

SEQ ID NO: 20969 - RNA, 18 nt, Artificial Sequence
  Synthetic
cgccucggggcggagccc

SEQ ID NO: 20970 - RNA, 19 nt, Artificial Sequence
  Synthetic
ccgccucggggcggagccc

SEQ ID NO: 20971 - RNA, 20 nt, Artificial Sequence
  Synthetic
cccgccucggggcggagccc

SEQ ID NO: 20972 - RNA, 21 nt, Artificial Sequence
  Synthetic
gcccgccucggggcggagccc

SEQ ID NO: 20973 - RNA, 22 nt, Artificial Sequence
  Synthetic
ggcccgccucggggcggagccc

SEQ ID NO: 20974 - RNA, 23 nt, Artificial Sequence
  Synthetic
gggcccgccucggggcggagccc

SEQ ID NO: 20975 - RNA, 24 nt, Artificial Sequence
  Synthetic
cgggcccgccucggggcggagccc

SEQ ID NO: 20976 - RNA, 18 nt, Artificial Sequence
  Synthetic
cccuuuggggcggagccc

SEQ ID NO: 20977 - RNA, 19 nt, Artificial Sequence
  Synthetic
ccccuuuggggcggagccc

SEQ ID NO: 20978 - RNA, 20 nt, Artificial Sequence
  Synthetic
cccccuuuggggcggagccc

SEQ ID NO: 20979 - RNA, 21 nt, Artificial Sequence
  Synthetic
gcccccuuuggggcggagccc

SEQ ID NO: 20980 - RNA, 22 nt, Artificial Sequence
  Synthetic
cgcccccuuuggggcggagccc

SEQ ID NO: 20981 - RNA, 23 nt, Artificial Sequence
  Synthetic
ccgcccccuuuggggcggagccc

SEQ ID NO: 20982 - RNA, 24 nt, Artificial Sequence
  Synthetic
cccgcccccuuuggggcggagccc

SEQ ID NO: 20983 - RNA, 18 nt, Artificial Sequence
  Synthetic
uuuggggcggagccgccc

SEQ ID NO: 20984 - RNA, 19 nt, Artificial Sequence
  Synthetic
cuuuggggcggagccgccc

SEQ ID NO: 20985 - RNA, 20 nt, Artificial Sequence
  Synthetic
ccuuuggggcggagccgccc

SEQ ID NO: 20986 - RNA, 21 nt, Artificial Sequence
  Synthetic
cccuuuggggcggagccgccc

SEQ ID NO: 20987 - RNA, 22 nt, Artificial Sequence
  Synthetic
ccccuuuggggcggagccgccc

SEQ ID NO: 20988 - RNA, 23 nt, Artificial Sequence
  Synthetic
cccccuuuggggcggagccgccc

SEQ ID NO: 20989 - RNA, 24 nt, Artificial Sequence
  Synthetic
gcccccuuuggggcggagccgccc

SEQ ID NO: 20990 - RNA, 18 nt, Artificial Sequence
  Synthetic
gggugcccgcgagggccc

SEQ ID NO: 20991 - RNA, 19 nt, Artificial Sequence
  Synthetic
ggggugcccgcgagggccc

SEQ ID NO: 20992 - RNA, 20 nt, Artificial Sequence
  Synthetic
gggggugcccgcgagggccc

SEQ ID NO: 20993 - RNA, 21 nt, Artificial Sequence
  Synthetic
cgggggugcccgcgagggccc

SEQ ID NO: 20994 - RNA, 22 nt, Artificial Sequence
  Synthetic
gcgggggugcccgcgagggccc

SEQ ID NO: 20995 - RNA, 23 nt, Artificial Sequence
  Synthetic
ggcgggggugcccgcgagggccc

SEQ ID NO: 20996 - RNA, 24 nt, Artificial Sequence
  Synthetic
aggcgggggugcccgcgagggccc

SEQ ID NO: 20997 - RNA, 18 nt, Artificial Sequence
  Synthetic
gaggaggcgggggugccc

SEQ ID NO: 20998 - RNA, 19 nt, Artificial Sequence
  Synthetic
cgaggaggcgggggugccc

SEQ ID NO: 20999 - RNA, 20 nt, Artificial Sequence
  Synthetic
acgaggaggcgggggugccc

SEQ ID NO: 21000 - RNA, 21 nt, Artificial Sequence
  Synthetic
gacgaggaggcgggggugccc

SEQ ID NO: 21001 - RNA, 22 nt, Artificial Sequence
  Synthetic
cgacgaggaggcgggggugccc

SEQ ID NO: 21002 - RNA, 23 nt, Artificial Sequence
  Synthetic
acgacgaggaggcgggggugccc

SEQ ID NO: 21003 - RNA, 24 nt, Artificial Sequence
  Synthetic
gacgacgaggaggcgggggugccc

SEQ ID NO: 21004 - RNA, 18 nt, Artificial Sequence
  Synthetic
agcgccgcagaccacgcc

SEQ ID NO: 21005 - RNA, 19 nt, Artificial Sequence
  Synthetic
cagcgccgcagaccacgcc

SEQ ID NO: 21006 - RNA, 20 nt, Artificial Sequence
  Synthetic
ccagcgccgcagaccacgcc

SEQ ID NO: 21007 - RNA, 21 nt, Artificial Sequence
  Synthetic
gccagcgccgcagaccacgcc

SEQ ID NO: 21008 - RNA, 22 nt, Artificial Sequence
  Synthetic
cgccagcgccgcagaccacgcc

SEQ ID NO: 21009 - RNA, 23 nt, Artificial Sequence
  Synthetic
ccgccagcgccgcagaccacgcc

SEQ ID NO: 21010 - RNA, 24 nt, Artificial Sequence
  Synthetic
cccgccagcgccgcagaccacgcc

SEQ ID NO: 21011 - RNA, 18 nt, Artificial Sequence
  Synthetic
gccccggccgagcccgcc

SEQ ID NO: 21012 - RNA, 19 nt, Artificial Sequence
  Synthetic
cgccccggccgagcccgcc

SEQ ID NO: 21013 - RNA, 20 nt, Artificial Sequence
  Synthetic
gcgccccggccgagcccgcc

SEQ ID NO: 21014 - RNA, 21 nt, Artificial Sequence
  Synthetic
ggcgccccggccgagcccgcc

SEQ ID NO: 21015 - RNA, 22 nt, Artificial Sequence
  Synthetic
cggcgccccggccgagcccgcc

SEQ ID NO: 21016 - RNA, 23 nt, Artificial Sequence
  Synthetic
gcggcgccccggccgagcccgcc

SEQ ID NO: 21017 - RNA, 24 nt, Artificial Sequence
  Synthetic
ggcggcgccccggccgagcccgcc

SEQ ID NO: 21018 - RNA, 18 nt, Artificial Sequence
  Synthetic
cccccguccgggcccgcc

SEQ ID NO: 21019 - RNA, 19 nt, Artificial Sequence
  Synthetic
ccccccguccgggcccgcc

SEQ ID NO: 21020 - RNA, 20 nt, Artificial Sequence
  Synthetic
gccccccguccgggcccgcc

SEQ ID NO: 21021 - RNA, 21 nt, Artificial Sequence
  Synthetic
cgccccccguccgggcccgcc

SEQ ID NO: 21022 - RNA, 22 nt, Artificial Sequence
  Synthetic
ccgccccccguccgggcccgcc

SEQ ID NO: 21023 - RNA, 23 nt, Artificial Sequence
  Synthetic
cccgccccccguccgggcccgcc

SEQ ID NO: 21024 - RNA, 24 nt, Artificial Sequence
  Synthetic
gcccgccccccguccgggcccgcc

SEQ ID NO: 21025 - RNA, 18 nt, Artificial Sequence
  Synthetic
cggcgaccgcgggccgcc

SEQ ID NO: 21026 - RNA, 19 nt, Artificial Sequence
  Synthetic
gcggcgaccgcgggccgcc

SEQ ID NO: 21027 - RNA, 20 nt, Artificial Sequence
  Synthetic
cgcggcgaccgcgggccgcc

SEQ ID NO: 21028 - RNA, 21 nt, Artificial Sequence
  Synthetic
ccgcggcgaccgcgggccgcc

SEQ ID NO: 21029 - RNA, 22 nt, Artificial Sequence
  Synthetic
cccgcggcgaccgcgggccgcc

SEQ ID NO: 21030 - RNA, 23 nt, Artificial Sequence
  Synthetic
ccccgcggcgaccgcgggccgcc

SEQ ID NO: 21031 - RNA, 24 nt, Artificial Sequence
  Synthetic
cccccgcggcgaccgcgggccgcc

SEQ ID NO: 21032 - RNA, 18 nt, Artificial Sequence
  Synthetic
ggggugcccgcgagggcc

SEQ ID NO: 21033 - RNA, 19 nt, Artificial Sequence
  Synthetic
gggggugcccgcgagggcc

SEQ ID NO: 21034 - RNA, 20 nt, Artificial Sequence
  Synthetic
cgggggugcccgcgagggcc

SEQ ID NO: 21035 - RNA, 21 nt, Artificial Sequence
  Synthetic
gcgggggugcccgcgagggcc

SEQ ID NO: 21036 - RNA, 22 nt, Artificial Sequence
  Synthetic
ggcgggggugcccgcgagggcc

SEQ ID NO: 21037 - RNA, 23 nt, Artificial Sequence
  Synthetic
aggcgggggugcccgcgagggcc

SEQ ID NO: 21038 - RNA, 24 nt, Artificial Sequence
  Synthetic
gaggcgggggugcccgcgagggcc

SEQ ID NO: 21039 - RNA, 18 nt, Artificial Sequence
  Synthetic
cgcgggaugacgcgggcc

SEQ ID NO: 21040 - RNA, 19 nt, Artificial Sequence
  Synthetic
ccgcgggaugacgcgggcc

SEQ ID NO: 21041 - RNA, 20 nt, Artificial Sequence
  Synthetic
cccgcgggaugacgcgggcc

SEQ ID NO: 21042 - RNA, 21 nt, Artificial Sequence
  Synthetic
gcccgcgggaugacgcgggcc

SEQ ID NO: 21043 - RNA, 22 nt, Artificial Sequence
  Synthetic
agcccgcgggaugacgcgggcc

SEQ ID NO: 21044 - RNA, 23 nt, Artificial Sequence
  Synthetic
gagcccgcgggaugacgcgggcc

SEQ ID NO: 21045 - RNA, 24 nt, Artificial Sequence
  Synthetic
ggagcccgcgggaugacgcgggcc

SEQ ID NO: 21046 - RNA, 18 nt, Artificial Sequence
  Synthetic
agacgacguccgcggucc

SEQ ID NO: 21047 - RNA, 19 nt, Artificial Sequence
  Synthetic
gagacgacguccgcggucc

SEQ ID NO: 21048 - RNA, 20 nt, Artificial Sequence
  Synthetic
ggagacgacguccgcggucc

SEQ ID NO: 21049 - RNA, 21 nt, Artificial Sequence
  Synthetic
cggagacgacguccgcggucc

SEQ ID NO: 21050 - RNA, 22 nt, Artificial Sequence
  Synthetic
ccggagacgacguccgcggucc

SEQ ID NO: 21051 - RNA, 23 nt, Artificial Sequence
  Synthetic
accggagacgacguccgcggucc

SEQ ID NO: 21052 - RNA, 24 nt, Artificial Sequence
  Synthetic
gaccggagacgacguccgcggucc

SEQ ID NO: 21053 - RNA, 18 nt, Artificial Sequence
  Synthetic
acgcgggccgcugggucc

SEQ ID NO: 21054 - RNA, 19 nt, Artificial Sequence
  Synthetic
gacgcgggccgcugggucc

SEQ ID NO: 21055 - RNA, 20 nt, Artificial Sequence
  Synthetic
cgacgcgggccgcugggucc

SEQ ID NO: 21056 - RNA, 21 nt, Artificial Sequence
  Synthetic
gcgacgcgggccgcugggucc

SEQ ID NO: 21057 - RNA, 22 nt, Artificial Sequence
  Synthetic
cgcgacgcgggccgcugggucc

SEQ ID NO: 21058 - RNA, 23 nt, Artificial Sequence
  Synthetic
ccgcgacgcgggccgcugggucc

SEQ ID NO: 21059 - RNA, 24 nt, Artificial Sequence
  Synthetic
accgcgacgcgggccgcugggucc

SEQ ID NO: 21060 - RNA, 18 nt, Artificial Sequence
  Synthetic
gcgggggccaacgggagc

SEQ ID NO: 21061 - RNA, 19 nt, Artificial Sequence
  Synthetic
ggcgggggccaacgggagc

SEQ ID NO: 21062 - RNA, 20 nt, Artificial Sequence
  Synthetic
cggcgggggccaacgggagc

SEQ ID NO: 21063 - RNA, 21 nt, Artificial Sequence
  Synthetic
ccggcgggggccaacgggagc

SEQ ID NO: 21064 - RNA, 22 nt, Artificial Sequence
  Synthetic
gccggcgggggccaacgggagc

SEQ ID NO: 21065 - RNA, 23 nt, Artificial Sequence
  Synthetic
ggccggcgggggccaacgggagc

SEQ ID NO: 21066 - RNA, 24 nt, Artificial Sequence
  Synthetic
gggccggcgggggccaacgggagc

SEQ ID NO: 21067 - RNA, 18 nt, Artificial Sequence
  Synthetic
ggaggcgggggugcccgc

SEQ ID NO: 21068 - RNA, 19 nt, Artificial Sequence
  Synthetic
aggaggcgggggugcccgc

SEQ ID NO: 21069 - RNA, 20 nt, Artificial Sequence
  Synthetic
gaggaggcgggggugcccgc

SEQ ID NO: 21070 - RNA, 21 nt, Artificial Sequence
  Synthetic
cgaggaggcgggggugcccgc

SEQ ID NO: 21071 - RNA, 22 nt, Artificial Sequence
  Synthetic
acgaggaggcgggggugcccgc

SEQ ID NO: 21072 - RNA, 23 nt, Artificial Sequence
  Synthetic
gacgaggaggcgggggugcccgc

SEQ ID NO: 21073 - RNA, 24 nt, Artificial Sequence
  Synthetic
cgacgaggaggcgggggugcccgc

SEQ ID NO: 21074 - RNA, 18 nt, Artificial Sequence
  Synthetic
gcggcgaccgcgggccgc

SEQ ID NO: 21075 - RNA, 19 nt, Artificial Sequence
  Synthetic
cgcggcgaccgcgggccgc

SEQ ID NO: 21076 - RNA, 20 nt, Artificial Sequence
  Synthetic
ccgcggcgaccgcgggccgc

SEQ ID NO: 21077 - RNA, 21 nt, Artificial Sequence
  Synthetic
cccgcggcgaccgcgggccgc

SEQ ID NO: 21078 - RNA, 22 nt, Artificial Sequence
  Synthetic
ccccgcggcgaccgcgggccgc

SEQ ID NO: 21079 - RNA, 23 nt, Artificial Sequence
  Synthetic
cccccgcggcgaccgcgggccgc

SEQ ID NO: 21080 - RNA, 24 nt, Artificial Sequence
  Synthetic
acccccgcggcgaccgcgggccgc

SEQ ID NO: 21081 - RNA, 18 nt, Artificial Sequence
  Synthetic
ccggcccuuuaugugcgc

SEQ ID NO: 21082 - RNA, 19 nt, Artificial Sequence
  Synthetic
gccggcccuuuaugugcgc

SEQ ID NO: 21083 - RNA, 20 nt, Artificial Sequence
  Synthetic
cgccggcccuuuaugugcgc

SEQ ID NO: 21084 - RNA, 21 nt, Artificial Sequence
  Synthetic
acgccggcccuuuaugugcgc

SEQ ID NO: 21085 - RNA, 22 nt, Artificial Sequence
  Synthetic
gacgccggcccuuuaugugcgc

SEQ ID NO: 21086 - RNA, 23 nt, Artificial Sequence
  Synthetic
ggacgccggcccuuuaugugcgc

SEQ ID NO: 21087 - RNA, 24 nt, Artificial Sequence
  Synthetic
gggacgccggcccuuuaugugcgc

SEQ ID NO: 21088 - RNA, 18 nt, Artificial Sequence
  Synthetic
ggccgagcccgccccggc

SEQ ID NO: 21089 - RNA, 19 nt, Artificial Sequence
  Synthetic
gggccgagcccgccccggc

SEQ ID NO: 21090 - RNA, 20 nt, Artificial Sequence
  Synthetic
agggccgagcccgccccggc

SEQ ID NO: 21091 - RNA, 21 nt, Artificial Sequence
  Synthetic
cagggccgagcccgccccggc

SEQ ID NO: 21092 - RNA, 22 nt, Artificial Sequence
  Synthetic
ccagggccgagcccgccccggc

SEQ ID NO: 21093 - RNA, 23 nt, Artificial Sequence
  Synthetic
cccagggccgagcccgccccggc

SEQ ID NO: 21094 - RNA, 24 nt, Artificial Sequence
  Synthetic
gcccagggccgagcccgccccggc

SEQ ID NO: 21095 - RNA, 18 nt, Artificial Sequence
  Synthetic
ggccccuuuggggccggc

SEQ ID NO: 21096 - RNA, 19 nt, Artificial Sequence
  Synthetic
cggccccuuuggggccggc

SEQ ID NO: 21097 - RNA, 20 nt, Artificial Sequence
  Synthetic
ccggccccuuuggggccggc

SEQ ID NO: 21098 - RNA, 21 nt, Artificial Sequence
  Synthetic
gccggccccuuuggggccggc

SEQ ID NO: 21099 - RNA, 22 nt, Artificial Sequence
  Synthetic
cgccggccccuuuggggccggc

SEQ ID NO: 21100 - RNA, 23 nt, Artificial Sequence
  Synthetic
ucgccggccccuuuggggccggc

SEQ ID NO: 21101 - RNA, 24 nt, Artificial Sequence
  Synthetic
cucgccggccccuuuggggccggc

SEQ ID NO: 21102 - RNA, 18 nt, Artificial Sequence
  Synthetic
gcgggcgggacccucggc

SEQ ID NO: 21103 - RNA, 19 nt, Artificial Sequence
  Synthetic
cgcgggcgggacccucggc

SEQ ID NO: 21104 - RNA, 20 nt, Artificial Sequence
  Synthetic
ccgcgggcgggacccucggc

SEQ ID NO: 21105 - RNA, 21 nt, Artificial Sequence
  Synthetic
gccgcgggcgggacccucggc

SEQ ID NO: 21106 - RNA, 22 nt, Artificial Sequence
  Synthetic
cgccgcgggcgggacccucggc

SEQ ID NO: 21107 - RNA, 23 nt, Artificial Sequence
  Synthetic
acgccgcgggcgggacccucggc

SEQ ID NO: 21108 - RNA, 24 nt, Artificial Sequence
  Synthetic
cacgccgcgggcgggacccucggc

SEQ ID NO: 21109 - RNA, 18 nt, Artificial Sequence
  Synthetic
cgccggcccuuuaugugc

SEQ ID NO: 21110 - RNA, 19 nt, Artificial Sequence
  Synthetic
acgccggcccuuuaugugc

SEQ ID NO: 21111 - RNA, 20 nt, Artificial Sequence
  Synthetic
gacgccggcccuuuaugugc

SEQ ID NO: 21112 - RNA, 21 nt, Artificial Sequence
  Synthetic
ggacgccggcccuuuaugugc

SEQ ID NO: 21113 - RNA, 22 nt, Artificial Sequence
  Synthetic
gggacgccggcccuuuaugugc

SEQ ID NO: 21114 - RNA, 23 nt, Artificial Sequence
  Synthetic
cgggacgccggcccuuuaugugc

SEQ ID NO: 21115 - RNA, 24 nt, Artificial Sequence
  Synthetic
ccgggacgccggcccuuuaugugc

SEQ ID NO: 21116 - RNA, 18 nt, Artificial Sequence
  Synthetic
ggcgcggacgacgaggag

SEQ ID NO: 21117 - RNA, 19 nt, Artificial Sequence
  Synthetic
cggcgcggacgacgaggag

SEQ ID NO: 21118 - RNA, 20 nt, Artificial Sequence
  Synthetic
ucggcgcggacgacgaggag

SEQ ID NO: 21119 - RNA, 21 nt, Artificial Sequence
  Synthetic
cucggcgcggacgacgaggag

SEQ ID NO: 21120 - RNA, 22 nt, Artificial Sequence
  Synthetic
ccucggcgcggacgacgaggag

SEQ ID NO: 21121 - RNA, 23 nt, Artificial Sequence
  Synthetic
cccucggcgcggacgacgaggag

SEQ ID NO: 21122 - RNA, 24 nt, Artificial Sequence
  Synthetic
acccucggcgcggacgacgaggag

SEQ ID NO: 21123 - RNA, 18 nt, Artificial Sequence
  Synthetic
cccucggcgcggacgacg

SEQ ID NO: 21124 - RNA, 19 nt, Artificial Sequence
  Synthetic
acccucggcgcggacgacg

SEQ ID NO: 21125 - RNA, 20 nt, Artificial Sequence
  Synthetic
gacccucggcgcggacgacg

SEQ ID NO: 21126 - RNA, 21 nt, Artificial Sequence
  Synthetic
ggacccucggcgcggacgacg

SEQ ID NO: 21127 - RNA, 22 nt, Artificial Sequence
  Synthetic
gggacccucggcgcggacgacg

SEQ ID NO: 21128 - RNA, 23 nt, Artificial Sequence
  Synthetic
cgggacccucggcgcggacgacg

SEQ ID NO: 21129 - RNA, 24 nt, Artificial Sequence
  Synthetic
gcgggacccucggcgcggacgacg

SEQ ID NO: 21130 - RNA, 18 nt, Artificial Sequence
  Synthetic
ggacccucggcgcggacg

SEQ ID NO: 21131 - RNA, 19 nt, Artificial Sequence
  Synthetic
gggacccucggcgcggacg

SEQ ID NO: 21132 - RNA, 20 nt, Artificial Sequence
  Synthetic
cgggacccucggcgcggacg

SEQ ID NO: 21133 - RNA, 21 nt, Artificial Sequence
  Synthetic
gcgggacccucggcgcggacg

SEQ ID NO: 21134 - RNA, 22 nt, Artificial Sequence
  Synthetic
ggcgggacccucggcgcggacg

SEQ ID NO: 21135 - RNA, 23 nt, Artificial Sequence
  Synthetic
gggcgggacccucggcgcggacg

SEQ ID NO: 21136 - RNA, 24 nt, Artificial Sequence
  Synthetic
cgggcgggacccucggcgcggacg

SEQ ID NO: 21137 - RNA, 18 nt, Artificial Sequence
  Synthetic
gggccgccuggagcgccg

SEQ ID NO: 21138 - RNA, 19 nt, Artificial Sequence
  Synthetic
cgggccgccuggagcgccg

SEQ ID NO: 21139 - RNA, 20 nt, Artificial Sequence
  Synthetic
gcgggccgccuggagcgccg

SEQ ID NO: 21140 - RNA, 21 nt, Artificial Sequence
  Synthetic
cgcgggccgccuggagcgccg

SEQ ID NO: 21141 - RNA, 22 nt, Artificial Sequence
  Synthetic
ccgcgggccgccuggagcgccg

SEQ ID NO: 21142 - RNA, 23 nt, Artificial Sequence
  Synthetic
accgcgggccgccuggagcgccg

SEQ ID NO: 21143 - RNA, 24 nt, Artificial Sequence
  Synthetic
gaccgcgggccgccuggagcgccg

SEQ ID NO: 21144 - RNA, 18 nt, Artificial Sequence
  Synthetic
ccggccccuuuggggccg

SEQ ID NO: 21145 - RNA, 19 nt, Artificial Sequence
  Synthetic
gccggccccuuuggggccg

SEQ ID NO: 21146 - RNA, 20 nt, Artificial Sequence
  Synthetic
cgccggccccuuuggggccg

SEQ ID NO: 21147 - RNA, 21 nt, Artificial Sequence
  Synthetic
ucgccggccccuuuggggccg

SEQ ID NO: 21148 - RNA, 22 nt, Artificial Sequence
  Synthetic
cucgccggccccuuuggggccg

SEQ ID NO: 21149 - RNA, 23 nt, Artificial Sequence
  Synthetic
ccucgccggccccuuuggggccg

SEQ ID NO: 21150 - RNA, 24 nt, Artificial Sequence
  Synthetic
accucgccggccccuuuggggccg

SEQ ID NO: 21151 - RNA, 18 nt, Artificial Sequence
  Synthetic
gacgacguccgcgguccg

SEQ ID NO: 21152 - RNA, 19 nt, Artificial Sequence
  Synthetic
agacgacguccgcgguccg

SEQ ID NO: 21153 - RNA, 20 nt, Artificial Sequence
  Synthetic
gagacgacguccgcgguccg

SEQ ID NO: 21154 - RNA, 21 nt, Artificial Sequence
  Synthetic
ggagacgacguccgcgguccg

SEQ ID NO: 21155 - RNA, 22 nt, Artificial Sequence
  Synthetic
cggagacgacguccgcgguccg

SEQ ID NO: 21156 - RNA, 23 nt, Artificial Sequence
  Synthetic
ccggagacgacguccgcgguccg

SEQ ID NO: 21157 - RNA, 24 nt, Artificial Sequence
  Synthetic
accggagacgacguccgcgguccg

SEQ ID NO: 21158 - RNA, 18 nt, Artificial Sequence
  Synthetic
cgggggccaacgggagcg

SEQ ID NO: 21159 - RNA, 19 nt, Artificial Sequence
  Synthetic
gcgggggccaacgggagcg

SEQ ID NO: 21160 - RNA, 20 nt, Artificial Sequence
  Synthetic
ggcgggggccaacgggagcg

SEQ ID NO: 21161 - RNA, 21 nt, Artificial Sequence
  Synthetic
cggcgggggccaacgggagcg

SEQ ID NO: 21162 - RNA, 22 nt, Artificial Sequence
  Synthetic
ccggcgggggccaacgggagcg

SEQ ID NO: 21163 - RNA, 23 nt, Artificial Sequence
  Synthetic
gccggcgggggccaacgggagcg

SEQ ID NO: 21164 - RNA, 24 nt, Artificial Sequence
  Synthetic
ggccggcgggggccaacgggagcg

SEQ ID NO: 21165 - RNA, 18 nt, Artificial Sequence
  Synthetic
cggcccuuuaugugcgcg

SEQ ID NO: 21166 - RNA, 19 nt, Artificial Sequence
  Synthetic
ccggcccuuuaugugcgcg

SEQ ID NO: 21167 - RNA, 20 nt, Artificial Sequence
  Synthetic
gccggcccuuuaugugcgcg

SEQ ID NO: 21168 - RNA, 21 nt, Artificial Sequence
  Synthetic
cgccggcccuuuaugugcgcg

SEQ ID NO: 21169 - RNA, 22 nt, Artificial Sequence
  Synthetic
acgccggcccuuuaugugcgcg

SEQ ID NO: 21170 - RNA, 23 nt, Artificial Sequence
  Synthetic
gacgccggcccuuuaugugcgcg

SEQ ID NO: 21171 - RNA, 24 nt, Artificial Sequence
  Synthetic
ggacgccggcccuuuaugugcgcg

SEQ ID NO: 21172 - RNA, 18 nt, Artificial Sequence
  Synthetic
gcgcggacgacgaggagg

SEQ ID NO: 21173 - RNA, 19 nt, Artificial Sequence
  Synthetic
ggcgcggacgacgaggagg

SEQ ID NO: 21174 - RNA, 20 nt, Artificial Sequence
  Synthetic
cggcgcggacgacgaggagg

SEQ ID NO: 21175 - RNA, 21 nt, Artificial Sequence
  Synthetic
ucggcgcggacgacgaggagg

SEQ ID NO: 21176 - RNA, 22 nt, Artificial Sequence
  Synthetic
cucggcgcggacgacgaggagg

SEQ ID NO: 21177 - RNA, 23 nt, Artificial Sequence
  Synthetic
ccucggcgcggacgacgaggagg

SEQ ID NO: 21178 - RNA, 24 nt, Artificial Sequence
  Synthetic
cccucggcgcggacgacgaggagg

SEQ ID NO: 21179 - RNA, 18 nt, Artificial Sequence
  Synthetic
aauauauauacuauuagg

SEQ ID NO: 21180 - RNA, 19 nt, Artificial Sequence
  Synthetic
uaauauauauacuauuagg

SEQ ID NO: 21181 - RNA, 20 nt, Artificial Sequence
  Synthetic
auaauauauauacuauuagg

SEQ ID NO: 21182 - RNA, 21 nt, Artificial Sequence
  Synthetic
aauaauauauauacuauuagg

SEQ ID NO: 21183 - RNA, 22 nt, Artificial Sequence
  Synthetic
uaauaauauauauacuauuagg

SEQ ID NO: 21184 - RNA, 23 nt, Artificial Sequence
  Synthetic
cuaauaauauauauacuauuagg

SEQ ID NO: 21185 - RNA, 24 nt, Artificial Sequence
  Synthetic
ccuaauaauauauauacuauuagg

SEQ ID NO: 21186 - RNA, 18 nt, Artificial Sequence
  Synthetic
ccgggggcggcgccccgg

SEQ ID NO: 21187 - RNA, 19 nt, Artificial Sequence
  Synthetic
cccgggggcggcgccccgg

SEQ ID NO: 21188 - RNA, 20 nt, Artificial Sequence
  Synthetic
ccccgggggcggcgccccgg

SEQ ID NO: 21189 - RNA, 21 nt, Artificial Sequence
  Synthetic
gccccgggggcggcgccccgg

SEQ ID NO: 21190 - RNA, 22 nt, Artificial Sequence
  Synthetic
ggccccgggggcggcgccccgg

SEQ ID NO: 21191 - RNA, 23 nt, Artificial Sequence
  Synthetic
gggccccgggggcggcgccccgg

SEQ ID NO: 21192 - RNA, 24 nt, Artificial Sequence
  Synthetic
agggccccgggggcggcgccccgg

SEQ ID NO: 21193 - RNA, 18 nt, Artificial Sequence
  Synthetic
cggccccuuuggggccgg

SEQ ID NO: 21194 - RNA, 19 nt, Artificial Sequence
  Synthetic
ccggccccuuuggggccgg

SEQ ID NO: 21195 - RNA, 20 nt, Artificial Sequence
  Synthetic
gccggccccuuuggggccgg

SEQ ID NO: 21196 - RNA, 21 nt, Artificial Sequence
  Synthetic
cgccggccccuuuggggccgg

SEQ ID NO: 21197 - RNA, 22 nt, Artificial Sequence
  Synthetic
ucgccggccccuuuggggccgg

SEQ ID NO: 21198 - RNA, 23 nt, Artificial Sequence
  Synthetic
cucgccggccccuuuggggccgg

SEQ ID NO: 21199 - RNA, 24 nt, Artificial Sequence
  Synthetic
ccucgccggccccuuuggggccgg

SEQ ID NO: 21200 - RNA, 18 nt, Artificial Sequence
  Synthetic
ccgcagaccacgccgcgg

SEQ ID NO: 21201 - RNA, 19 nt, Artificial Sequence
  Synthetic
gccgcagaccacgccgcgg

SEQ ID NO: 21202 - RNA, 20 nt, Artificial Sequence
  Synthetic
cgccgcagaccacgccgcgg

SEQ ID NO: 21203 - RNA, 21 nt, Artificial Sequence
  Synthetic
gcgccgcagaccacgccgcgg

SEQ ID NO: 21204 - RNA, 22 nt, Artificial Sequence
  Synthetic
agcgccgcagaccacgccgcgg

SEQ ID NO: 21205 - RNA, 23 nt, Artificial Sequence
  Synthetic
cagcgccgcagaccacgccgcgg

SEQ ID NO: 21206 - RNA, 24 nt, Artificial Sequence
  Synthetic
ccagcgccgcagaccacgccgcgg

SEQ ID NO: 21207 - RNA, 18 nt, Artificial Sequence
  Synthetic
ggccgagcccgcccaggg

SEQ ID NO: 21208 - RNA, 19 nt, Artificial Sequence
  Synthetic
cggccgagcccgcccaggg

SEQ ID NO: 21209 - RNA, 20 nt, Artificial Sequence
  Synthetic
ccggccgagcccgcccaggg

SEQ ID NO: 21210 - RNA, 21 nt, Artificial Sequence
  Synthetic
cccggccgagcccgcccaggg

SEQ ID NO: 21211 - RNA, 22 nt, Artificial Sequence
  Synthetic
ccccggccgagcccgcccaggg

SEQ ID NO: 21212 - RNA, 23 nt, Artificial Sequence
  Synthetic
gccccggccgagcccgcccaggg

SEQ ID NO: 21213 - RNA, 24 nt, Artificial Sequence
  Synthetic
cgccccggccgagcccgcccaggg

SEQ ID NO: 21214 - RNA, 18 nt, Artificial Sequence
  Synthetic
gaugacgcgggccccggg

SEQ ID NO: 21215 - RNA, 19 nt, Artificial Sequence
  Synthetic
ggaugacgcgggccccggg

SEQ ID NO: 21216 - RNA, 20 nt, Artificial Sequence
  Synthetic
gggaugacgcgggccccggg

SEQ ID NO: 21217 - RNA, 21 nt, Artificial Sequence
  Synthetic
cgggaugacgcgggccccggg

SEQ ID NO: 21218 - RNA, 22 nt, Artificial Sequence
  Synthetic
gcgggaugacgcgggccccggg

SEQ ID NO: 21219 - RNA, 23 nt, Artificial Sequence
  Synthetic
cgcgggaugacgcgggccccggg

SEQ ID NO: 21220 - RNA, 24 nt, Artificial Sequence
  Synthetic
ccgcgggaugacgcgggccccggg

SEQ ID NO: 21221 - RNA, 18 nt, Artificial Sequence
  Synthetic
cgcagaccacgccgcggg

SEQ ID NO: 21222 - RNA, 19 nt, Artificial Sequence
  Synthetic
ccgcagaccacgccgcggg

SEQ ID NO: 21223 - RNA, 20 nt, Artificial Sequence
  Synthetic
gccgcagaccacgccgcggg

SEQ ID NO: 21224 - RNA, 21 nt, Artificial Sequence
  Synthetic
cgccgcagaccacgccgcggg

SEQ ID NO: 21225 - RNA, 22 nt, Artificial Sequence
  Synthetic
gcgccgcagaccacgccgcggg

SEQ ID NO: 21226 - RNA, 23 nt, Artificial Sequence
  Synthetic
agcgccgcagaccacgccgcggg

SEQ ID NO: 21227 - RNA, 24 nt, Artificial Sequence
  Synthetic
cagcgccgcagaccacgccgcggg

SEQ ID NO: 21228 - RNA, 18 nt, Artificial Sequence
  Synthetic
guccgggcccgccucggg

SEQ ID NO: 21229 - RNA, 19 nt, Artificial Sequence
  Synthetic
cguccgggcccgccucggg

SEQ ID NO: 21230 - RNA, 20 nt, Artificial Sequence
  Synthetic
ccguccgggcccgccucggg

SEQ ID NO: 21231 - RNA, 21 nt, Artificial Sequence
  Synthetic
cccguccgggcccgccucggg

SEQ ID NO: 21232 - RNA, 22 nt, Artificial Sequence
  Synthetic
ccccguccgggcccgccucggg

SEQ ID NO: 21233 - RNA, 23 nt, Artificial Sequence
  Synthetic
cccccguccgggcccgccucggg

SEQ ID NO: 21234 - RNA, 24 nt, Artificial Sequence
  Synthetic
ccccccguccgggcccgccucggg

SEQ ID NO: 21235 - RNA, 18 nt, Artificial Sequence
  Synthetic
uccgggcccgccucgggg

SEQ ID NO: 21236 - RNA, 19 nt, Artificial Sequence
  Synthetic
guccgggcccgccucgggg

SEQ ID NO: 21237 - RNA, 20 nt, Artificial Sequence
  Synthetic
cguccgggcccgccucgggg

SEQ ID NO: 21238 - RNA, 21 nt, Artificial Sequence
  Synthetic
ccguccgggcccgccucgggg

SEQ ID NO: 21239 - RNA, 22 nt, Artificial Sequence
  Synthetic
cccguccgggcccgccucgggg

SEQ ID NO: 21240 - RNA, 23 nt, Artificial Sequence
  Synthetic
ccccguccgggcccgccucgggg

SEQ ID NO: 21241 - RNA, 24 nt, Artificial Sequence
  Synthetic
cccccguccgggcccgccucgggg

SEQ ID NO: 21242 - RNA, 18 nt, Artificial Sequence
  Synthetic
gccccgcccccuuugggg

SEQ ID NO: 21243 - RNA, 19 nt, Artificial Sequence
  Synthetic
ggccccgcccccuuugggg

SEQ ID NO: 21244 - RNA, 20 nt, Artificial Sequence
  Synthetic
cggccccgcccccuuugggg

SEQ ID NO: 21245 - RNA, 21 nt, Artificial Sequence
  Synthetic
gcggccccgcccccuuugggg

SEQ ID NO: 21246 - RNA, 22 nt, Artificial Sequence
  Synthetic
ugcggccccgcccccuuugggg

SEQ ID NO: 21247 - RNA, 23 nt, Artificial Sequence
  Synthetic
cugcggccccgcccccuuugggg

SEQ ID NO: 21248 - RNA, 24 nt, Artificial Sequence
  Synthetic
ccugcggccccgcccccuuugggg

SEQ ID NO: 21249 - RNA, 18 nt, Artificial Sequence
  Synthetic
ggccccgcccccuuuggg

SEQ ID NO: 21250 - RNA, 19 nt, Artificial Sequence
  Synthetic
cggccccgcccccuuuggg

SEQ ID NO: 21251 - RNA, 20 nt, Artificial Sequence
  Synthetic
gcggccccgcccccuuuggg

SEQ ID NO: 21252 - RNA, 21 nt, Artificial Sequence
  Synthetic
ugcggccccgcccccuuuggg

SEQ ID NO: 21253 - RNA, 22 nt, Artificial Sequence
  Synthetic
cugcggccccgcccccuuuggg

SEQ ID NO: 21254 - RNA, 23 nt, Artificial Sequence
  Synthetic
ccugcggccccgcccccuuuggg

SEQ ID NO: 21255 - RNA, 24 nt, Artificial Sequence
  Synthetic
cccugcggccccgcccccuuuggg

SEQ ID NO: 21256 - RNA, 18 nt, Artificial Sequence
  Synthetic
uaauaauauauauacuau

SEQ ID NO: 21257 - RNA, 19 nt, Artificial Sequence
  Synthetic
cuaauaauauauauacuau

SEQ ID NO: 21258 - RNA, 20 nt, Artificial Sequence
  Synthetic
ccuaauaauauauauacuau

SEQ ID NO: 21259 - RNA, 21 nt, Artificial Sequence
  Synthetic
cccuaauaauauauauacuau

SEQ ID NO: 21260 - RNA, 22 nt, Artificial Sequence
  Synthetic
gcccuaauaauauauauacuau

SEQ ID NO: 21261 - RNA, 23 nt, Artificial Sequence
  Synthetic
ugcccuaauaauauauauacuau

SEQ ID NO: 21262 - RNA, 24 nt, Artificial Sequence
  Synthetic
uugcccuaauaauauauauacuau

SEQ ID NO: 21263 - RNA, 18 nt, Artificial Sequence
  Synthetic
ccugcggccccgcccccu

SEQ ID NO: 21264 - RNA, 19 nt, Artificial Sequence
  Synthetic
cccugcggccccgcccccu

SEQ ID NO: 21265 - RNA, 20 nt, Artificial Sequence
  Synthetic
acccugcggccccgcccccu

SEQ ID NO: 21266 - RNA, 21 nt, Artificial Sequence
  Synthetic
uacccugcggccccgcccccu

SEQ ID NO: 21267 - RNA, 22 nt, Artificial Sequence
  Synthetic
uuacccugcggccccgcccccu

SEQ ID NO: 21268 - RNA, 23 nt, Artificial Sequence
  Synthetic
uuuacccugcggccccgcccccu

SEQ ID NO: 21269 - RNA, 24 nt, Artificial Sequence
  Synthetic
uuuuacccugcggccccgcccccu

SEQ ID NO: 21270 - RNA, 18 nt, Artificial Sequence
  Synthetic
gcgaccucgccggccccu

SEQ ID NO: 21271 - RNA, 19 nt, Artificial Sequence
  Synthetic
ggcgaccucgccggccccu

SEQ ID NO: 21272 - RNA, 20 nt, Artificial Sequence
  Synthetic
gggcgaccucgccggccccu

SEQ ID NO: 21273 - RNA, 21 nt, Artificial Sequence
  Synthetic
ggggcgaccucgccggccccu

SEQ ID NO: 21274 - RNA, 22 nt, Artificial Sequence
  Synthetic
cggggcgaccucgccggccccu

SEQ ID NO: 21275 - RNA, 23 nt, Artificial Sequence
  Synthetic
acggggcgaccucgccggccccu

SEQ ID NO: 21276 - RNA, 24 nt, Artificial Sequence
  Synthetic
aacggggcgaccucgccggccccu

SEQ ID NO: 21277 - RNA, 18 nt, Artificial Sequence
  Synthetic
ccccguccgggcccgccu

SEQ ID NO: 21278 - RNA, 19 nt, Artificial Sequence
  Synthetic
cccccguccgggcccgccu

SEQ ID NO: 21279 - RNA, 20 nt, Artificial Sequence
  Synthetic
ccccccguccgggcccgccu

SEQ ID NO: 21280 - RNA, 21 nt, Artificial Sequence
  Synthetic
gccccccguccgggcccgccu

SEQ ID NO: 21281 - RNA, 22 nt, Artificial Sequence
  Synthetic
cgccccccguccgggcccgccu

SEQ ID NO: 21282 - RNA, 23 nt, Artificial Sequence
  Synthetic
ccgccccccguccgggcccgccu

SEQ ID NO: 21283 - RNA, 24 nt, Artificial Sequence
  Synthetic
cccgccccccguccgggcccgccu

SEQ ID NO: 21284 - RNA, 18 nt, Artificial Sequence
  Synthetic
auacuauuaggacgaagu

SEQ ID NO: 21285 - RNA, 19 nt, Artificial Sequence
  Synthetic
uauacuauuaggacgaagu

SEQ ID NO: 21286 - RNA, 20 nt, Artificial Sequence
  Synthetic
auauacuauuaggacgaagu

SEQ ID NO: 21287 - RNA, 21 nt, Artificial Sequence
  Synthetic
uauauacuauuaggacgaagu

SEQ ID NO: 21288 - RNA, 22 nt, Artificial Sequence
  Synthetic
auauauacuauuaggacgaagu

SEQ ID NO: 21289 - RNA, 23 nt, Artificial Sequence
  Synthetic
uauauauacuauuaggacgaagu

SEQ ID NO: 21290 - RNA, 24 nt, Artificial Sequence
  Synthetic
auauauauacuauuaggacgaagu

SEQ ID NO: 21291 - RNA, 18 nt, Artificial Sequence
  Synthetic
gaacggcccgccccccgu

SEQ ID NO: 21292 - RNA, 19 nt, Artificial Sequence
  Synthetic
ggaacggcccgccccccgu

SEQ ID NO: 21293 - RNA, 20 nt, Artificial Sequence
  Synthetic
aggaacggcccgccccccgu

SEQ ID NO: 21294 - RNA, 21 nt, Artificial Sequence
  Synthetic
gaggaacggcccgccccccgu

SEQ ID NO: 21295 - RNA, 22 nt, Artificial Sequence
  Synthetic
cgaggaacggcccgccccccgu

SEQ ID NO: 21296 - RNA, 23 nt, Artificial Sequence
  Synthetic
gcgaggaacggcccgccccccgu

SEQ ID NO: 21297 - RNA, 24 nt, Artificial Sequence
  Synthetic
cgcgaggaacggcccgccccccgu

SEQ ID NO: 21298 - RNA, 18 nt, Artificial Sequence
  Synthetic
cugcggccccgcccccuu

SEQ ID NO: 21299 - RNA, 19 nt, Artificial Sequence
  Synthetic
ccugcggccccgcccccuu

SEQ ID NO: 21300 - RNA, 20 nt, Artificial Sequence
  Synthetic
cccugcggccccgcccccuu

SEQ ID NO: 21301 - RNA, 21 nt, Artificial Sequence
  Synthetic
acccugcggccccgcccccuu

SEQ ID NO: 21302 - RNA, 22 nt, Artificial Sequence
  Synthetic
uacccugcggccccgcccccuu

SEQ ID NO: 21303 - RNA, 23 nt, Artificial Sequence
  Synthetic
uuacccugcggccccgcccccuu

SEQ ID NO: 21304 - RNA, 24 nt, Artificial Sequence
  Synthetic
uuuacccugcggccccgcccccuu

SEQ ID NO: 21305 - RNA, 18 nt, Artificial Sequence
  Synthetic
cgaccucgccggccccuu

SEQ ID NO: 21306 - RNA, 19 nt, Artificial Sequence
  Synthetic
gcgaccucgccggccccuu

SEQ ID NO: 21307 - RNA, 20 nt, Artificial Sequence
  Synthetic
ggcgaccucgccggccccuu

SEQ ID NO: 21308 - RNA, 21 nt, Artificial Sequence
  Synthetic
gggcgaccucgccggccccuu

SEQ ID NO: 21309 - RNA, 22 nt, Artificial Sequence
  Synthetic
ggggcgaccucgccggccccuu

SEQ ID NO: 21310 - RNA, 23 nt, Artificial Sequence
  Synthetic
cggggcgaccucgccggccccuu

SEQ ID NO: 21311 - RNA, 24 nt, Artificial Sequence
  Synthetic
acggggcgaccucgccggccccuu

SEQ ID NO: 21312 - RNA, 17 nt, Artificial Sequence
  Synthetic
ggcggagaaggcgagcg

SEQ ID NO: 21313 - RNA, 17 nt, Artificial Sequence
  Synthetic
cgcccggcgcgggcggc

SEQ ID NO: 21314 - RNA, 17 nt, Artificial Sequence
  Synthetic
cauuagcgcccggcgcg

SEQ ID NO: 21315 - RNA, 17 nt, Artificial Sequence
  Synthetic
cggacccccuccaugcg

SEQ ID NO: 21316 - RNA, 20 nt, Artificial Sequence
  Synthetic
uagcgcccggcgcgggcggc

SEQ ID NO: 21317 - RNA, 20 nt, Artificial Sequence
  Synthetic
cgcggcggagaaggcgagcg

SEQ ID NO: 21318 - RNA, 20 nt, Artificial Sequence
  Synthetic
ucucauuagcgcccggcgcg

SEQ ID NO: 21319 - RNA, 20 nt, Artificial Sequence
  Synthetic
ccgcggacccccuccaugcg

SEQ ID NO: 21320 - RNA, 17 nt, Artificial Sequence
  Synthetic
gacgccgacgacgagga

SEQ ID NO: 21321 - RNA, 17 nt, Artificial Sequence
  Synthetic
cuauuaggacgaagugc

SEQ ID NO: 21322 - RNA, 20 nt, Artificial Sequence
  Synthetic
gaggacgccgacgacgagga

SEQ ID NO: 21323 - RNA, 20 nt, Artificial Sequence
  Synthetic
auacuauuaggacgaagugc

SEQ ID NO: 21324 - RNA, 17 nt, Artificial Sequence
  Synthetic
ggcggacagcacggaca

SEQ ID NO: 21325 - RNA, 17 nt, Artificial Sequence
  Synthetic
gacggggggagcgacga

SEQ ID NO: 21326 - RNA, 17 nt, Artificial Sequence
  Synthetic
gcccccccucgagagga

SEQ ID NO: 21327 - RNA, 17 nt, Artificial Sequence
  Synthetic
gcgcccccgcaacugcc

SEQ ID NO: 21328 - RNA, 17 nt, Artificial Sequence
  Synthetic
ggaaggugucgcagcgc

SEQ ID NO: 21329 - RNA, 17 nt, Artificial Sequence
  Synthetic
ggcguugcacagcgggc

SEQ ID NO: 21330 - RNA, 17 nt, Artificial Sequence
  Synthetic
gguacucgcuccggggc

SEQ ID NO: 21331 - RNA, 17 nt, Artificial Sequence
  Synthetic
guucgagacggggcugc

SEQ ID NO: 21332 - RNA, 17 nt, Artificial Sequence
  Synthetic
gaugggggggcggucuc

SEQ ID NO: 21333 - RNA, 17 nt, Artificial Sequence
  Synthetic
gggcgcccccccucgag

SEQ ID NO: 21334 - RNA, 17 nt, Artificial Sequence
  Synthetic
ggcggguacucgcuccg

SEQ ID NO: 21335 - RNA, 17 nt, Artificial Sequence
  Synthetic
ggggagccccccccgcg

SEQ ID NO: 21336 - RNA, 17 nt, Artificial Sequence
  Synthetic
gcuguccgccucggagg

SEQ ID NO: 21337 - RNA, 17 nt, Artificial Sequence
  Synthetic
ggguacucgcuccgggg

SEQ ID NO: 21338 - RNA, 17 nt, Artificial Sequence
  Synthetic
ggucuuccucgcggggg

SEQ ID NO: 21339 - RNA, 17 nt, Artificial Sequence
  Synthetic
gaguacccgccggccug

SEQ ID NO: 21340 - RNA, 17 nt, Artificial Sequence
  Synthetic
gaagaccccggcaguug

SEQ ID NO: 21341 - RNA, 20 nt, Artificial Sequence
  Synthetic
ggacacggaacuguucgaga

SEQ ID NO: 21342 - RNA, 20 nt, Artificial Sequence
  Synthetic
ggcgcccccccucgagagga

SEQ ID NO: 21343 - RNA, 20 nt, Artificial Sequence
  Synthetic
gaagcggugcaugcacggga

SEQ ID NO: 21344 - RNA, 20 nt, Artificial Sequence
  Synthetic
gcgaguacccgccggccuga

SEQ ID NO: 21345 - RNA, 20 nt, Artificial Sequence
  Synthetic
gcauccagguuuucaugcac

SEQ ID NO: 21346 - RNA, 20 nt, Artificial Sequence
  Synthetic
gacacggaacuguucgagac

SEQ ID NO: 21347 - RNA, 20 nt, Artificial Sequence
  Synthetic
gcgcccccccucgagaggac

SEQ ID NO: 21348 - RNA, 20 nt, Artificial Sequence
  Synthetic
gcaucccgugcaugaaaacc

SEQ ID NO: 21349 - RNA, 20 nt, Artificial Sequence
  Synthetic
ggggcgcccccgcaacugcc

SEQ ID NO: 21350 - RNA, 20 nt, Artificial Sequence
  Synthetic
ggccggcggguacucgcucc

SEQ ID NO: 21351 - RNA, 20 nt, Artificial Sequence
  Synthetic
gccccggagcgaguacccgc

SEQ ID NO: 21352 - RNA, 20 nt, Artificial Sequence
  Synthetic
guccggcaggucucggucgc

SEQ ID NO: 21353 - RNA, 20 nt, Artificial Sequence
  Synthetic
guggaugggggggcggucuc

SEQ ID NO: 21354 - RNA, 20 nt, Artificial Sequence
  Synthetic
gcuccccccguccucucgag

SEQ ID NO: 21355 - RNA, 20 nt, Artificial Sequence
  Synthetic
gggcgcccccgcaacugccg

SEQ ID NO: 21356 - RNA, 20 nt, Artificial Sequence
  Synthetic
gccggcggguacucgcuccg

SEQ ID NO: 21357 - RNA, 20 nt, Artificial Sequence
  Synthetic
gagaccgaagugggggggcg

SEQ ID NO: 21358 - RNA, 20 nt, Artificial Sequence
  Synthetic
ggaagaccccggcaguugcg

SEQ ID NO: 21359 - RNA, 20 nt, Artificial Sequence
  Synthetic
gcccccccucgagaggacgg

SEQ ID NO: 21360 - RNA, 20 nt, Artificial Sequence
  Synthetic
guccgugcuguccgccucgg

SEQ ID NO: 21361 - RNA, 20 nt, Artificial Sequence
  Synthetic
gaugggggggcggucucggg

SEQ ID NO: 21362 - RNA, 20 nt, Artificial Sequence
  Synthetic
ggcggguacucgcuccgggg

SEQ ID NO: 21363 - RNA, 20 nt, Artificial Sequence
  Synthetic
gggccgcagggcguggaugg

SEQ ID NO: 21364 - RNA, 20 nt, Artificial Sequence
  Synthetic
gccggacagcagcgacucug

SEQ ID NO: 21365 - RNA, 20 nt, Artificial Sequence
  Synthetic
gaggaagaccccggcaguug

SEQ ID NO: 21366 - RNA, 20 nt, Artificial Sequence
  Synthetic
gaaggugucgcagcgcaggu

SEQ ID NO: 21367 - RNA, 20 nt, Artificial Sequence
  Synthetic
ggagucgucgucaugguggu

SEQ ID NO: 21368 - RNA, 20 nt, Artificial Sequence
  Synthetic
guccccccgcccccccacuu

SEQ ID NO: 21369 - RNA, 17 nt, Artificial Sequence
  Synthetic
cuccgaggcggacagca

SEQ ID NO: 21370 - RNA, 17 nt, Artificial Sequence
  Synthetic
aggcggagucgucguca

SEQ ID NO: 21371 - RNA, 17 nt, Artificial Sequence
  Synthetic
uccccccguccucucga

SEQ ID NO: 21372 - RNA, 17 nt, Artificial Sequence
  Synthetic
aguacccgccggccuga

SEQ ID NO: 21373 - RNA, 17 nt, Artificial Sequence
  Synthetic
agaagcggugcaugcac

SEQ ID NO: 21374 - RNA, 17 nt, Artificial Sequence
  Synthetic
cccccccucgagaggac

SEQ ID NO: 21375 - RNA, 17 nt, Artificial Sequence
  Synthetic
ucccgugcaugaaaacc

SEQ ID NO: 21376 - RNA, 17 nt, Artificial Sequence
  Synthetic
cggcggguacucgcucc

SEQ ID NO: 21377 - RNA, 17 nt, Artificial Sequence
  Synthetic
ccggagcgaguacccgc

SEQ ID NO: 21378 - RNA, 17 nt, Artificial Sequence
  Synthetic
cggcaggucucggucgc

SEQ ID NO: 21379 - RNA, 17 nt, Artificial Sequence
  Synthetic
agucgcugcuguccggc

SEQ ID NO: 21380 - RNA, 17 nt, Artificial Sequence
  Synthetic
aagaccccggcaguugc

SEQ ID NO: 21381 - RNA, 17 nt, Artificial Sequence
  Synthetic
ccggcggguacucgcuc

SEQ ID NO: 21382 - RNA, 17 nt, Artificial Sequence
  Synthetic
ccccccguccucucgag

SEQ ID NO: 21383 - RNA, 17 nt, Artificial Sequence
  Synthetic
cggaacuguucgagacg

SEQ ID NO: 21384 - RNA, 17 nt, Artificial Sequence
  Synthetic
ccccccucgagaggacg

SEQ ID NO: 21385 - RNA, 17 nt, Artificial Sequence
  Synthetic
cgacgacuccgccuccg

SEQ ID NO: 21386 - RNA, 17 nt, Artificial Sequence
  Synthetic
ccggggucuuccucgcg

SEQ ID NO: 21387 - RNA, 17 nt, Artificial Sequence
  Synthetic
accgaagugggggggcg

SEQ ID NO: 21388 - RNA, 17 nt, Artificial Sequence
  Synthetic
cuccccccguccucucg

SEQ ID NO: 21389 - RNA, 17 nt, Artificial Sequence
  Synthetic
augggggggcggucucg

SEQ ID NO: 21390 - RNA, 17 nt, Artificial Sequence
  Synthetic
aggugucgcagcgcagg

SEQ ID NO: 21391 - RNA, 17 nt, Artificial Sequence
  Synthetic
cgacuccgccuccgagg

SEQ ID NO: 21392 - RNA, 17 nt, Artificial Sequence
  Synthetic
cccccucgagaggacgg

SEQ ID NO: 21393 - RNA, 17 nt, Artificial Sequence
  Synthetic
cggggucuuccucgcgg

SEQ ID NO: 21394 - RNA, 17 nt, Artificial Sequence
  Synthetic
ccccucgagaggacggg

SEQ ID NO: 21395 - RNA, 17 nt, Artificial Sequence
  Synthetic
cggagaccgaagugggg

SEQ ID NO: 21396 - RNA, 17 nt, Artificial Sequence
  Synthetic
cggagucgucgucaugg

SEQ ID NO: 21397 - RNA, 17 nt, Artificial Sequence
  Synthetic
uaucagguacaccagcu

SEQ ID NO: 21398 - RNA, 17 nt, Artificial Sequence
  Synthetic
uucgagacggggcugcu

SEQ ID NO: 21399 - RNA, 20 nt, Artificial Sequence
  Synthetic
cgaggcggacagcacggaca

SEQ ID NO: 21400 - RNA, 20 nt, Artificial Sequence
  Synthetic
cgccuccgaggcggacagca

SEQ ID NO: 21401 - RNA, 20 nt, Artificial Sequence
  Synthetic
uccggcaggucucggucgca

SEQ ID NO: 21402 - RNA, 20 nt, Artificial Sequence
  Synthetic
cgacgugugcgccgugugca

SEQ ID NO: 21403 - RNA, 20 nt, Artificial Sequence
  Synthetic
cggaggcggagucgucguca

SEQ ID NO: 21404 - RNA, 20 nt, Artificial Sequence
  Synthetic
cgcuccccccguccucucga

SEQ ID NO: 21405 - RNA, 20 nt, Artificial Sequence
  Synthetic
ugcagaagcggugcaugcac

SEQ ID NO: 21406 - RNA, 20 nt, Artificial Sequence
  Synthetic
cccccccgcgaggaagaccc

SEQ ID NO: 21407 - RNA, 20 nt, Artificial Sequence
  Synthetic
ccagcuuggcguugcacagc

SEQ ID NO: 21408 - RNA, 20 nt, Artificial Sequence
  Synthetic
acgggaaggugucgcagcgc

SEQ ID NO: 21409 - RNA, 20 nt, Artificial Sequence
  Synthetic
acugccggggucuuccucgc

SEQ ID NO: 21410 - RNA, 20 nt, Artificial Sequence
  Synthetic
cagagucgcugcuguccggc

SEQ ID NO: 21411 - RNA, 20 nt, Artificial Sequence
  Synthetic
cuuggcguugcacagcgggc

SEQ ID NO: 21412 - RNA, 20 nt, Artificial Sequence
  Synthetic
aacacccagacauccggggc

SEQ ID NO: 21413 - RNA, 20 nt, Artificial Sequence
  Synthetic
acuguucgagacggggcugc

SEQ ID NO: 21414 - RNA, 20 nt, Artificial Sequence
  Synthetic
aggaagaccccggcaguugc

SEQ ID NO: 21415 - RNA, 20 nt, Artificial Sequence
  Synthetic
ucgcgcugggggcggcccuc

SEQ ID NO: 21416 - RNA, 20 nt, Artificial Sequence
  Synthetic
aggccggcggguacucgcuc

SEQ ID NO: 21417 - RNA, 20 nt, Artificial Sequence
  Synthetic
ucaugcacgggaugcagaag

SEQ ID NO: 21418 - RNA, 20 nt, Artificial Sequence
  Synthetic
cgggggcgcccccccucgag

SEQ ID NO: 21419 - RNA, 20 nt, Artificial Sequence
  Synthetic
caagcugguguaccugauag

SEQ ID NO: 21420 - RNA, 20 nt, Artificial Sequence
  Synthetic
acacggaacuguucgagacg

SEQ ID NO: 21421 - RNA, 20 nt, Artificial Sequence
  Synthetic
agaggacggggggagcgacg

SEQ ID NO: 21422 - RNA, 20 nt, Artificial Sequence
  Synthetic
cgcccccccucgagaggacg

SEQ ID NO: 21423 - RNA, 20 nt, Artificial Sequence
  Synthetic
ugacgacgacuccgccuccg

SEQ ID NO: 21424 - RNA, 20 nt, Artificial Sequence
  Synthetic
cugccggggucuuccucgcg

SEQ ID NO: 21425 - RNA, 20 nt, Artificial Sequence
  Synthetic
cggguacucgcuccggggcg

SEQ ID NO: 21426 - RNA, 20 nt, Artificial Sequence
  Synthetic
aacugccggggucuuccucg

SEQ ID NO: 21427 - RNA, 20 nt, Artificial Sequence
  Synthetic
ucgcuccccccguccucucg

SEQ ID NO: 21428 - RNA, 20 nt, Artificial Sequence
  Synthetic
uggaugggggggcggucucg

SEQ ID NO: 21429 - RNA, 20 nt, Artificial Sequence
  Synthetic
cgacgacuccgccuccgagg

SEQ ID NO: 21430 - RNA, 20 nt, Artificial Sequence
  Synthetic
cgugcuguccgccucggagg

SEQ ID NO: 21431 - RNA, 20 nt, Artificial Sequence
  Synthetic
ugccggggucuuccucgcgg

SEQ ID NO: 21432 - RNA, 20 nt, Artificial Sequence
  Synthetic
cccccccucgagaggacggg

SEQ ID NO: 21433 - RNA, 20 nt, Artificial Sequence
  Synthetic
aggcggagucgucgucaugg

SEQ ID NO: 21434 - RNA, 20 nt, Artificial Sequence
  Synthetic
ugaggcggagaccgaagugg

SEQ ID NO: 21435 - RNA, 20 nt, Artificial Sequence
  Synthetic
agcgaguacccgccggccug

SEQ ID NO: 21436 - RNA, 20 nt, Artificial Sequence
  Synthetic
uguucgagacggggcugcug

SEQ ID NO: 21437 - RNA, 20 nt, Artificial Sequence
  Synthetic
cguguccgugcuguccgccu

SEQ ID NO: 21438 - RNA, 20 nt, Artificial Sequence
  Synthetic
cuguucgagacggggcugcu

SEQ ID NO: 21439 - RNA, 20 nt, Artificial Sequence
  Synthetic
cguggaugggggggcggucu

SEQ ID NO: 21440 - RNA, 20 nt, Artificial Sequence
  Synthetic
ucugaggcggagaccgaagu

SEQ ID NO: 21441 - RNA, 20 nt, Artificial Sequence
  Synthetic
aagcugguguaccugauagu

SEQ ID NO: 21442 - RNA, 17 nt, Artificial Sequence
  Synthetic
gaucucauccgugcaca

SEQ ID NO: 21443 - RNA, 17 nt, Artificial Sequence
  Synthetic
gggcugcuggggccgca

SEQ ID NO: 21444 - RNA, 17 nt, Artificial Sequence
  Synthetic
ggcaggucucggucgca

SEQ ID NO: 21445 - RNA, 17 nt, Artificial Sequence
  Synthetic
gcggugcaugcacggga

SEQ ID NO: 21446 - RNA, 17 nt, Artificial Sequence
  Synthetic
gggccgcagggcgugga

SEQ ID NO: 21447 - RNA, 17 nt, Artificial Sequence
  Synthetic
gaaacacccagacaucc

SEQ ID NO: 21448 - RNA, 17 nt, Artificial Sequence
  Synthetic
guugcgcaauugcaucc

SEQ ID NO: 21449 - RNA, 17 nt, Artificial Sequence
  Synthetic
gcugugcaacgccaagc

SEQ ID NO: 21450 - RNA, 17 nt, Artificial Sequence
  Synthetic
gcuuggcguugcacagc

SEQ ID NO: 21451 - RNA, 17 nt, Artificial Sequence
  Synthetic
ggggcugcuggggccgc

SEQ ID NO: 21452 - RNA, 17 nt, Artificial Sequence
  Synthetic
gccggggucuuccucgc

SEQ ID NO: 21453 - RNA, 17 nt, Artificial Sequence
  Synthetic
gggggcggcccucaggc

SEQ ID NO: 21454 - RNA, 17 nt, Artificial Sequence
  Synthetic
gcggcccucaggccggc

SEQ ID NO: 21455 - RNA, 17 nt, Artificial Sequence
  Synthetic
gaccgaagugggggggc

SEQ ID NO: 21456 - RNA, 17 nt, Artificial Sequence
  Synthetic
ggcgcccccgcaacugc

SEQ ID NO: 21457 - RNA, 17 nt, Artificial Sequence
  Synthetic
ggaaacacccagacauc

SEQ ID NO: 21458 - RNA, 17 nt, Artificial Sequence
  Synthetic
gcugguguaccugauag

SEQ ID NO: 21459 - RNA, 17 nt, Artificial Sequence
  Synthetic
ggacggggggagcgacg

SEQ ID NO: 21460 - RNA, 17 nt, Artificial Sequence
  Synthetic
gcuggggccgcagggcg

SEQ ID NO: 21461 - RNA, 17 nt, Artificial Sequence
  Synthetic
guacucgcuccggggcg

SEQ ID NO: 21462 - RNA, 17 nt, Artificial Sequence
  Synthetic
ggcggcccucaggccgg

SEQ ID NO: 21463 - RNA, 17 nt, Artificial Sequence
  Synthetic
gaccccggcaguugcgg

SEQ ID NO: 21464 - RNA, 17 nt, Artificial Sequence
  Synthetic
ggggucuuccucgcggg

SEQ ID NO: 21465 - RNA, 17 nt, Artificial Sequence
  Synthetic
gggggggcggucucggg

SEQ ID NO: 21466 - RNA, 17 nt, Artificial Sequence
  Synthetic
gggucuuccucgcgggg

SEQ ID NO: 21467 - RNA, 17 nt, Artificial Sequence
  Synthetic
ggggggcggucucgggg

SEQ ID NO: 21468 - RNA, 17 nt, Artificial Sequence
  Synthetic
gggcguggauggggggg

SEQ ID NO: 21469 - RNA, 17 nt, Artificial Sequence
  Synthetic
gcagggcguggaugggg

SEQ ID NO: 21470 - RNA, 17 nt, Artificial Sequence
  Synthetic
gcggagaccgaaguggg

SEQ ID NO: 21471 - RNA, 17 nt, Artificial Sequence
  Synthetic
ggcggagaccgaagugg

SEQ ID NO: 21472 - RNA, 17 nt, Artificial Sequence
  Synthetic
gccgcagggcguggaug

SEQ ID NO: 21473 - RNA, 17 nt, Artificial Sequence
  Synthetic
ggacagcagcgacucug

SEQ ID NO: 21474 - RNA, 17 nt, Artificial Sequence
  Synthetic
gugucgcagcgcaggug

SEQ ID NO: 21475 - RNA, 17 nt, Artificial Sequence
  Synthetic
ggccgcagggcguggau

SEQ ID NO: 21476 - RNA, 17 nt, Artificial Sequence
  Synthetic
guccgugcuguccgccu

SEQ ID NO: 21477 - RNA, 17 nt, Artificial Sequence
  Synthetic
ggaugggggggcggucu

SEQ ID NO: 21478 - RNA, 17 nt, Artificial Sequence
  Synthetic
gaggcggagaccgaagu

SEQ ID NO: 21479 - RNA, 17 nt, Artificial Sequence
  Synthetic
ggugucgcagcgcaggu

SEQ ID NO: 21480 - RNA, 17 nt, Artificial Sequence
  Synthetic
gucgucgucaugguggu

SEQ ID NO: 21481 - RNA, 20 nt, Artificial Sequence
  Synthetic
gaggacggggggagcgacga

SEQ ID NO: 21482 - RNA, 20 nt, Artificial Sequence
  Synthetic
gguguugcgcaauugcaucc

SEQ ID NO: 21483 - RNA, 20 nt, Artificial Sequence
  Synthetic
gacggggcugcuggggccgc

SEQ ID NO: 21484 - RNA, 20 nt, Artificial Sequence
  Synthetic
gcugggggcggcccucaggc

SEQ ID NO: 21485 - RNA, 20 nt, Artificial Sequence
  Synthetic
ggggcggcccucaggccggc

SEQ ID NO: 21486 - RNA, 20 nt, Artificial Sequence
  Synthetic
gcggguacucgcuccggggc

SEQ ID NO: 21487 - RNA, 20 nt, Artificial Sequence
  Synthetic
ggagaccgaagugggggggc

SEQ ID NO: 21488 - RNA, 20 nt, Artificial Sequence
  Synthetic
gggggcgcccccgcaacugc

SEQ ID NO: 21489 - RNA, 20 nt, Artificial Sequence
  Synthetic
gccucagagucgcugcuguc

SEQ ID NO: 21490 - RNA, 20 nt, Artificial Sequence
  Synthetic
gggaaacacccagacauccg

SEQ ID NO: 21491 - RNA, 20 nt, Artificial Sequence
  Synthetic
gggggggagccccccccgcg

SEQ ID NO: 21492 - RNA, 20 nt, Artificial Sequence
  Synthetic
gcugcuggggccgcagggcg

SEQ ID NO: 21493 - RNA, 20 nt, Artificial Sequence
  Synthetic
ggaaggugucgcagcgcagg

SEQ ID NO: 21494 - RNA, 20 nt, Artificial Sequence
  Synthetic
ggacagcagcgacucugagg

SEQ ID NO: 21495 - RNA, 20 nt, Artificial Sequence
  Synthetic
gggggcggcccucaggccgg

SEQ ID NO: 21496 - RNA, 20 nt, Artificial Sequence
  Synthetic
gaagaccccggcaguugcgg

SEQ ID NO: 21497 - RNA, 20 nt, Artificial Sequence
  Synthetic
ggaugggggggcggucucgg

SEQ ID NO: 21498 - RNA, 20 nt, Artificial Sequence
  Synthetic
gccggggucuuccucgcggg

SEQ ID NO: 21499 - RNA, 20 nt, Artificial Sequence
  Synthetic
gaccgaagugggggggcggg

SEQ ID NO: 21500 - RNA, 20 nt, Artificial Sequence
  Synthetic
gcagggcguggauggggggg

SEQ ID NO: 21501 - RNA, 20 nt, Artificial Sequence
  Synthetic
gccgcagggcguggaugggg

SEQ ID NO: 21502 - RNA, 20 nt, Artificial Sequence
  Synthetic
ggccgcagggcguggauggg

SEQ ID NO: 21503 - RNA, 20 nt, Artificial Sequence
  Synthetic
gaggcggagaccgaaguggg

SEQ ID NO: 21504 - RNA, 20 nt, Artificial Sequence
  Synthetic
ggggccgcagggcguggaug

SEQ ID NO: 21505 - RNA, 20 nt, Artificial Sequence
  Synthetic
gcccccccauccacgcccug

SEQ ID NO: 21506 - RNA, 17 nt, Artificial Sequence
  Synthetic
cagaagcggugcaugca

SEQ ID NO: 21507 - RNA, 17 nt, Artificial Sequence
  Synthetic
auccagguuuucaugca

SEQ ID NO: 21508 - RNA, 17 nt, Artificial Sequence
  Synthetic
cgugugcgccgugugca

SEQ ID NO: 21509 - RNA, 17 nt, Artificial Sequence
  Synthetic
cacggaacuguucgaga

SEQ ID NO: 21510 - RNA, 17 nt, Artificial Sequence
  Synthetic
uccagguuuucaugcac

SEQ ID NO: 21511 - RNA, 17 nt, Artificial Sequence
  Synthetic
acggaacuguucgagac

SEQ ID NO: 21512 - RNA, 17 nt, Artificial Sequence
  Synthetic
ccccgcgaggaagaccc

SEQ ID NO: 21513 - RNA, 17 nt, Artificial Sequence
  Synthetic
acccagacauccggggc

SEQ ID NO: 21514 - RNA, 17 nt, Artificial Sequence
  Synthetic
cugcgaccgagaccugc

SEQ ID NO: 21515 - RNA, 17 nt, Artificial Sequence
  Synthetic
cgcugggggcggcccuc

SEQ ID NO: 21516 - RNA, 17 nt, Artificial Sequence
  Synthetic
ucagagucgcugcuguc

SEQ ID NO: 21517 - RNA, 17 nt, Artificial Sequence
  Synthetic
ugcacgggaugcagaag

SEQ ID NO: 21518 - RNA, 17 nt, Artificial Sequence
  Synthetic
ugaggcggagaccgaag

SEQ ID NO: 21519 - RNA, 17 nt, Artificial Sequence
  Synthetic
agcuuggcguugcacag

SEQ ID NO: 21520 - RNA, 17 nt, Artificial Sequence
  Synthetic
cgcccccgcaacugccg

SEQ ID NO: 21521 - RNA, 17 nt, Artificial Sequence
  Synthetic
aaacacccagacauccg

SEQ ID NO: 21522 - RNA, 17 nt, Artificial Sequence
  Synthetic
agaccccggcaguugcg

SEQ ID NO: 21523 - RNA, 17 nt, Artificial Sequence
  Synthetic
ugccggggucuuccucg

SEQ ID NO: 21524 - RNA, 17 nt, Artificial Sequence
  Synthetic
cccccguccucucgagg

SEQ ID NO: 21525 - RNA, 17 nt, Artificial Sequence
  Synthetic
cagcagcgacucugagg

SEQ ID NO: 21526 - RNA, 17 nt, Artificial Sequence
  Synthetic
ccgaagugggggggcgg

SEQ ID NO: 21527 - RNA, 17 nt, Artificial Sequence
  Synthetic
cgugcuguccgccucgg

SEQ ID NO: 21528 - RNA, 17 nt, Artificial Sequence
  Synthetic
ugggggggcggucucgg

SEQ ID NO: 21529 - RNA, 17 nt, Artificial Sequence
  Synthetic
ccccguccucucgaggg

SEQ ID NO: 21530 - RNA, 17 nt, Artificial Sequence
  Synthetic
cgaagugggggggcggg

SEQ ID NO: 21531 - RNA, 17 nt, Artificial Sequence
  Synthetic
cccguccucucgagggg

SEQ ID NO: 21532 - RNA, 17 nt, Artificial Sequence
  Synthetic
cacccagacauccgggg

SEQ ID NO: 21533 - RNA, 17 nt, Artificial Sequence
  Synthetic
agaccgaaguggggggg

SEQ ID NO: 21534 - RNA, 17 nt, Artificial Sequence
  Synthetic
cgcagggcguggauggg

SEQ ID NO: 21535 - RNA, 17 nt, Artificial Sequence
  Synthetic
ccgcagggcguggaugg

SEQ ID NO: 21536 - RNA, 17 nt, Artificial Sequence
  Synthetic
cccccauccacgcccug

SEQ ID NO: 21537 - RNA, 17 nt, Artificial Sequence
  Synthetic
ucgagacggggcugcug

SEQ ID NO: 21538 - RNA, 17 nt, Artificial Sequence
  Synthetic
aggcggagaccgaagug

SEQ ID NO: 21539 - RNA, 17 nt, Artificial Sequence
  Synthetic
ugcuguccggcaggucu

SEQ ID NO: 21540 - RNA, 17 nt, Artificial Sequence
  Synthetic
cugguguaccugauagu

SEQ ID NO: 21541 - RNA, 17 nt, Artificial Sequence
  Synthetic
cccccgcccccccacuu

SEQ ID NO: 21542 - RNA, 20 nt, Artificial Sequence
  Synthetic
cgcgaucucauccgugcaca

SEQ ID NO: 21543 - RNA, 20 nt, Artificial Sequence
  Synthetic
acggggcugcuggggccgca

SEQ ID NO: 21544 - RNA, 20 nt, Artificial Sequence
  Synthetic
augcagaagcggugcaugca

SEQ ID NO: 21545 - RNA, 20 nt, Artificial Sequence
  Synthetic
ugcauccagguuuucaugca

SEQ ID NO: 21546 - RNA, 20 nt, Artificial Sequence
  Synthetic
cuggggccgcagggcgugga

SEQ ID NO: 21547 - RNA, 20 nt, Artificial Sequence
  Synthetic
agggaaacacccagacaucc

SEQ ID NO: 21548 - RNA, 20 nt, Artificial Sequence
  Synthetic
cccgcugugcaacgccaagc

SEQ ID NO: 21549 - RNA, 20 nt, Artificial Sequence
  Synthetic
ucccugcgaccgagaccugc

SEQ ID NO: 21550 - RNA, 20 nt, Artificial Sequence
  Synthetic
cagggaaacacccagacauc

SEQ ID NO: 21551 - RNA, 20 nt, Artificial Sequence
  Synthetic
cucugaggcggagaccgaag

SEQ ID NO: 21552 - RNA, 20 nt, Artificial Sequence
  Synthetic
accagcuuggcguugcacag

SEQ ID NO: 21553 - RNA, 20 nt, Artificial Sequence
  Synthetic
cuccccccguccucucgagg

SEQ ID NO: 21554 - RNA, 20 nt, Artificial Sequence
  Synthetic
agaccgaagugggggggcgg

SEQ ID NO: 21555 - RNA, 20 nt, Artificial Sequence
  Synthetic
uccccccguccucucgaggg

SEQ ID NO: 21556 - RNA, 20 nt, Artificial Sequence
  Synthetic
ccccccguccucucgagggg

SEQ ID NO: 21557 - RNA, 20 nt, Artificial Sequence
  Synthetic
aaacacccagacauccgggg

SEQ ID NO: 21558 - RNA, 20 nt, Artificial Sequence
  Synthetic
ccggggucuuccucgcgggg

SEQ ID NO: 21559 - RNA, 20 nt, Artificial Sequence
  Synthetic
augggggggcggucucgggg

SEQ ID NO: 21560 - RNA, 20 nt, Artificial Sequence
  Synthetic
cggggucuuccucgcggggg

SEQ ID NO: 21561 - RNA, 20 nt, Artificial Sequence
  Synthetic
cggagaccgaaguggggggg

SEQ ID NO: 21562 - RNA, 20 nt, Artificial Sequence
  Synthetic
aggcggagaccgaagugggg

SEQ ID NO: 21563 - RNA, 20 nt, Artificial Sequence
  Synthetic
cugaggcggagaccgaagug

SEQ ID NO: 21564 - RNA, 20 nt, Artificial Sequence
  Synthetic
aaggugucgcagcgcaggug

SEQ ID NO: 21565 - RNA, 20 nt, Artificial Sequence
  Synthetic
uggggccgcagggcguggau

SEQ ID NO: 21566 - RNA, 20 nt, Artificial Sequence
  Synthetic
cacuaucagguacaccagcu

SEQ ID NO: 21567 - RNA, 20 nt, Artificial Sequence
  Synthetic
cgcugcuguccggcaggucu

SEQ ID NO: 21568 - RNA, 17 nt, Artificial Sequence
  Synthetic
ggcgggucuguugacaa

SEQ ID NO: 21569 - RNA, 17 nt, Artificial Sequence
  Synthetic
gucucuguuguuugcaa

SEQ ID NO: 21570 - RNA, 17 nt, Artificial Sequence
  Synthetic
ggaccagacgggaaaca

SEQ ID NO: 21571 - RNA, 17 nt, Artificial Sequence
  Synthetic
gcgcccaucgggccaca

SEQ ID NO: 21572 - RNA, 17 nt, Artificial Sequence
  Synthetic
gacccugggggggcaca

SEQ ID NO: 21573 - RNA, 17 nt, Artificial Sequence
  Synthetic
agugcgacuggggcaca

SEQ ID NO: 21574 - RNA, 17 nt, Artificial Sequence
  Synthetic
guucacguaaggcgaca

SEQ ID NO: 21575 - RNA, 17 nt, Artificial Sequence
  Synthetic
cgggugggugggcgaca

SEQ ID NO: 21576 - RNA, 17 nt, Artificial Sequence
  Synthetic
ccugcccauccuggaca

SEQ ID NO: 21577 - RNA, 17 nt, Artificial Sequence
  Synthetic
gggcgggucuguugaca

SEQ ID NO: 21578 - RNA, 17 nt, Artificial Sequence
  Synthetic
ccacccggagcccacca

SEQ ID NO: 21579 - RNA, 17 nt, Artificial Sequence
  Synthetic
aacaugcuguucgacca

SEQ ID NO: 21580 - RNA, 17 nt, Artificial Sequence
  Synthetic
cccugcuccccggacca

SEQ ID NO: 21581 - RNA, 17 nt, Artificial Sequence
  Synthetic
caccgugugccccccca

SEQ ID NO: 21582 - RNA, 17 nt, Artificial Sequence
  Synthetic
gaacagcauguucccca

SEQ ID NO: 21583 - RNA, 17 nt, Artificial Sequence
  Synthetic
cucuugucucccuccca

SEQ ID NO: 21584 - RNA, 17 nt, Artificial Sequence
  Synthetic
guucgcggccugagcca

SEQ ID NO: 21585 - RNA, 17 nt, Artificial Sequence
  Synthetic
ccgggggggcgcggcca

SEQ ID NO: 21586 - RNA, 17 nt, Artificial Sequence
  Synthetic
ucgcacgcacggggcca

SEQ ID NO: 21587 - RNA, 17 nt, Artificial Sequence
  Synthetic
cguccagauaaagucca

SEQ ID NO: 21588 - RNA, 17 nt, Artificial Sequence
  Synthetic
caggcugcggaagucca

SEQ ID NO: 21589 - RNA, 17 nt, Artificial Sequence
  Synthetic
ccgugguccggggagca

SEQ ID NO: 21590 - RNA, 17 nt, Artificial Sequence
  Synthetic
cgcggucucggggagca

SEQ ID NO: 21591 - RNA, 17 nt, Artificial Sequence
  Synthetic
ggcggcgcucgcacgca

SEQ ID NO: 21592 - RNA, 17 nt, Artificial Sequence
  Synthetic
cgacccccagacccgca

SEQ ID NO: 21593 - RNA, 17 nt, Artificial Sequence
  Synthetic
ccccccucgcgccggca

SEQ ID NO: 21594 - RNA, 17 nt, Artificial Sequence
  Synthetic
ggccgucagggcgggca

SEQ ID NO: 21595 - RNA, 17 nt, Artificial Sequence
  Synthetic
ggcguggagggugggca

SEQ ID NO: 21596 - RNA, 17 nt, Artificial Sequence
  Synthetic
gggggcggagccuggca

SEQ ID NO: 21597 - RNA, 17 nt, Artificial Sequence
  Synthetic
ggucucuguuguuugca

SEQ ID NO: 21598 - RNA, 17 nt, Artificial Sequence
  Synthetic
cgugaacaagacuauca

SEQ ID NO: 21599 - RNA, 17 nt, Artificial Sequence
  Synthetic
acccccccuccgacuca

SEQ ID NO: 21600 - RNA, 17 nt, Artificial Sequence
  Synthetic
ggccgccgaggacguca

SEQ ID NO: 21601 - RNA, 17 nt, Artificial Sequence
  Synthetic
agacgccccgcccguca

SEQ ID NO: 21602 - RNA, 17 nt, Artificial Sequence
  Synthetic
ggccgaggaggccguca

SEQ ID NO: 21603 - RNA, 17 nt, Artificial Sequence
  Synthetic
gccggcaggggccaaga

SEQ ID NO: 21604 - RNA, 17 nt, Artificial Sequence
  Synthetic
gguccugguggaccaga

SEQ ID NO: 21605 - RNA, 17 nt, Artificial Sequence
  Synthetic
gcuagagacccccgaga

SEQ ID NO: 21606 - RNA, 17 nt, Artificial Sequence
  Synthetic
cauccuggacauggaga

SEQ ID NO: 21607 - RNA, 17 nt, Artificial Sequence
  Synthetic
gcgucgacccgggacga

SEQ ID NO: 21608 - RNA, 17 nt, Artificial Sequence
  Synthetic
cccucccagggcaccga

SEQ ID NO: 21609 - RNA, 17 nt, Artificial Sequence
  Synthetic
gccccccgaguacccga

SEQ ID NO: 21610 - RNA, 17 nt, Artificial Sequence
  Synthetic
gcugccguguggcccga

SEQ ID NO: 21611 - RNA, 17 nt, Artificial Sequence
  Synthetic
ggcccgaugggcgccga

SEQ ID NO: 21612 - RNA, 17 nt, Artificial Sequence
  Synthetic
ggaggcggggcggccga

SEQ ID NO: 21613 - RNA, 17 nt, Artificial Sequence
  Synthetic
agcagcgcgggggccga

SEQ ID NO: 21614 - RNA, 17 nt, Artificial Sequence
  Synthetic
ggccccugccggcgcga

SEQ ID NO: 21615 - RNA, 17 nt, Artificial Sequence
  Synthetic
gugccgggcgcgugcga

SEQ ID NO: 21616 - RNA, 17 nt, Artificial Sequence
  Synthetic
cgucuccauguccagga

SEQ ID NO: 21617 - RNA, 17 nt, Artificial Sequence
  Synthetic
accccaacccccccgga

SEQ ID NO: 21618 - RNA, 17 nt, Artificial Sequence
  Synthetic
agcggggcggcgccgga

SEQ ID NO: 21619 - RNA, 17 nt, Artificial Sequence
  Synthetic
gcggccgaggggccgga

SEQ ID NO: 21620 - RNA, 17 nt, Artificial Sequence
  Synthetic
ucgacagaggcggcgga

SEQ ID NO: 21621 - RNA, 17 nt, Artificial Sequence
  Synthetic
cccggcccugagucgga

SEQ ID NO: 21622 - RNA, 17 nt, Artificial Sequence
  Synthetic
ggggcggcgccgcggga

SEQ ID NO: 21623 - RNA, 17 nt, Artificial Sequence
  Synthetic
gucguucacgaucggga

SEQ ID NO: 21624 - RNA, 17 nt, Artificial Sequence
  Synthetic
gaggccgcccgcgggga

SEQ ID NO: 21625 - RNA, 17 nt, Artificial Sequence
  Synthetic
cgcguggacugggggga

SEQ ID NO: 21626 - RNA, 17 nt, Artificial Sequence
  Synthetic
ccgucggugcccuggga

SEQ ID NO: 21627 - RNA, 17 nt, Artificial Sequence
  Synthetic
cguggacuuuaucugga

SEQ ID NO: 21628 - RNA, 17 nt, Artificial Sequence
  Synthetic
ggggggccgggcgugga

SEQ ID NO: 21629 - RNA, 17 nt, Artificial Sequence
  Synthetic
ggccgugcccgcccuga

SEQ ID NO: 21630 - RNA, 17 nt, Artificial Sequence
  Synthetic
cgccgcgccccccguga

SEQ ID NO: 21631 - RNA, 17 nt, Artificial Sequence
  Synthetic
gggggggcacacgguga

SEQ ID NO: 21632 - RNA, 17 nt, Artificial Sequence
  Synthetic
guccagggcgcccacua

SEQ ID NO: 21633 - RNA, 17 nt, Artificial Sequence
  Synthetic
ggagucgcugaucacua

SEQ ID NO: 21634 - RNA, 17 nt, Artificial Sequence
  Synthetic
auagucuuguucacgua

SEQ ID NO: 21635 - RNA, 17 nt, Artificial Sequence
  Synthetic
ccugcuccccggaccac

SEQ ID NO: 21636 - RNA, 17 nt, Artificial Sequence
  Synthetic
ccccggccucuccccac

SEQ ID NO: 21637 - RNA, 17 nt, Artificial Sequence
  Synthetic
aacagcauguuccccac

SEQ ID NO: 21638 - RNA, 17 nt, Artificial Sequence
  Synthetic
gcggcgcucgcacgcac

SEQ ID NO: 21639 - RNA, 17 nt, Artificial Sequence
  Synthetic
gcguggagggugggcac

SEQ ID NO: 21640 - RNA, 17 nt, Artificial Sequence
  Synthetic
gugaacaagacuaucac

SEQ ID NO: 21641 - RNA, 17 nt, Artificial Sequence
  Synthetic
gacgccccgcccgucac

SEQ ID NO: 21642 - RNA, 17 nt, Artificial Sequence
  Synthetic
guccugguggaccagac

SEQ ID NO: 21643 - RNA, 17 nt, Artificial Sequence
  Synthetic
auccuggacauggagac

SEQ ID NO: 21644 - RNA, 17 nt, Artificial Sequence
  Synthetic
gcgccgcggcucgcgac

SEQ ID NO: 21645 - RNA, 17 nt, Artificial Sequence
  Synthetic
uguucacguaaggcgac

SEQ ID NO: 21646 - RNA, 17 nt, Artificial Sequence
  Synthetic
ccgggugggugggcgac

SEQ ID NO: 21647 - RNA, 17 nt, Artificial Sequence
  Synthetic
ccagggacgagugcgac

SEQ ID NO: 21648 - RNA, 17 nt, Artificial Sequence
  Synthetic
cggccgaggggccggac

SEQ ID NO: 21649 - RNA, 17 nt, Artificial Sequence
  Synthetic
guggacuuuaucuggac

SEQ ID NO: 21650 - RNA, 17 nt, Artificial Sequence
  Synthetic
gggggggacgcguggac

SEQ ID NO: 21651 - RNA, 17 nt, Artificial Sequence
  Synthetic
gccgcgccccccgugac

SEQ ID NO: 21652 - RNA, 17 nt, Artificial Sequence
  Synthetic
ccugucgcccacccacc

SEQ ID NO: 21653 - RNA, 17 nt, Artificial Sequence
  Synthetic
uucccgucugguccacc

SEQ ID NO: 21654 - RNA, 17 nt, Artificial Sequence
  Synthetic
cgaggaugacgacgacc

SEQ ID NO: 21655 - RNA, 17 nt, Artificial Sequence
  Synthetic
cgggaaacauggcgacc

SEQ ID NO: 21656 - RNA, 17 nt, Artificial Sequence
  Synthetic
agcagggggcgucgacc

SEQ ID NO: 21657 - RNA, 17 nt, Artificial Sequence
  Synthetic
gaacaugcuguucgacc

SEQ ID NO: 21658 - RNA, 17 nt, Artificial Sequence
  Synthetic
gggucccgggcccaccc

SEQ ID NO: 21659 - RNA, 17 nt, Artificial Sequence
  Synthetic
gcagggggcgucgaccc

SEQ ID NO: 21660 - RNA, 17 nt, Artificial Sequence
  Synthetic
cccgcgguaccugaccc

SEQ ID NO: 21661 - RNA, 17 nt, Artificial Sequence
  Synthetic
cccaaccccaacccccc

SEQ ID NO: 21662 - RNA, 17 nt, Artificial Sequence
  Synthetic
ucaccgugugccccccc

SEQ ID NO: 21663 - RNA, 17 nt, Artificial Sequence
  Synthetic
cccuggccgcgcccccc

SEQ ID NO: 21664 - RNA, 17 nt, Artificial Sequence
  Synthetic
gaucagcgacucccccc

SEQ ID NO: 21665 - RNA, 17 nt, Artificial Sequence
  Synthetic
cccgcgccccggccccc

SEQ ID NO: 21666 - RNA, 17 nt, Artificial Sequence
  Synthetic
gcuccgccccccgcccc

SEQ ID NO: 21667 - RNA, 17 nt, Artificial Sequence
  Synthetic
gcggccggcuccgcccc

SEQ ID NO: 21668 - RNA, 17 nt, Artificial Sequence
  Synthetic
ccccgcgccccggcccc

SEQ ID NO: 21669 - RNA, 17 nt, Artificial Sequence
  Synthetic
ggcuccgccccccgccc

SEQ ID NO: 21670 - RNA, 17 nt, Artificial Sequence
  Synthetic
ggcggccggcuccgccc

SEQ ID NO: 21671 - RNA, 17 nt, Artificial Sequence
  Synthetic
gcccggcccccgcgccc

SEQ ID NO: 21672 - RNA, 17 nt, Artificial Sequence
  Synthetic
cacccuagugggcgccc

SEQ ID NO: 21673 - RNA, 17 nt, Artificial Sequence
  Synthetic
gcccgcggggacggccc

SEQ ID NO: 21674 - RNA, 17 nt, Artificial Sequence
  Synthetic
ggaggaggacgcggccc

SEQ ID NO: 21675 - RNA, 17 nt, Artificial Sequence
  Synthetic
gcgcgggggccgggccc

SEQ ID NO: 21676 - RNA, 17 nt, Artificial Sequence
  Synthetic
gcggacgcggggggccc

SEQ ID NO: 21677 - RNA, 17 nt, Artificial Sequence
  Synthetic
gcggccagggugggccc

SEQ ID NO: 21678 - RNA, 17 nt, Artificial Sequence
  Synthetic
cggggccgucggugccc

SEQ ID NO: 21679 - RNA, 17 nt, Artificial Sequence
  Synthetic
cgcccacuagggugccc

SEQ ID NO: 21680 - RNA, 17 nt, Artificial Sequence
  Synthetic
ccucuugucucccuccc

SEQ ID NO: 21681 - RNA, 17 nt, Artificial Sequence
  Synthetic
cgacgcccccugcuccc

SEQ ID NO: 21682 - RNA, 17 nt, Artificial Sequence
  Synthetic
ccagucgcacucguccc

SEQ ID NO: 21683 - RNA, 17 nt, Artificial Sequence
  Synthetic
uuguuuucccucguccc

SEQ ID NO: 21684 - RNA, 17 nt, Artificial Sequence
  Synthetic
cugcgggccgcgguccc

SEQ ID NO: 21685 - RNA, 17 nt, Artificial Sequence
  Synthetic
gacgucagggggguccc

SEQ ID NO: 21686 - RNA, 17 nt, Artificial Sequence
  Synthetic
gugcggcggcuccagcc

SEQ ID NO: 21687 - RNA, 17 nt, Artificial Sequence
  Synthetic
gaccgcggcccgcagcc

SEQ ID NO: 21688 - RNA, 17 nt, Artificial Sequence
  Synthetic
gggcggggggcggagcc

SEQ ID NO: 21689 - RNA, 17 nt, Artificial Sequence
  Synthetic
gguucgcggccugagcc

SEQ ID NO: 21690 - RNA, 17 nt, Artificial Sequence
  Synthetic
ugcccacccuccacgcc

SEQ ID NO: 21691 - RNA, 17 nt, Artificial Sequence
  Synthetic
ccgccucuuccgccgcc

SEQ ID NO: 21692 - RNA, 17 nt, Artificial Sequence
  Synthetic
ccaccgucgcacgcgcc

SEQ ID NO: 21693 - RNA, 17 nt, Artificial Sequence
  Synthetic
gccuguggggagaggcc

SEQ ID NO: 21694 - RNA, 17 nt, Artificial Sequence
  Synthetic
gccgggggggcgcggcc

SEQ ID NO: 21695 - RNA, 17 nt, Artificial Sequence
  Synthetic
cccuccgacucagggcc

SEQ ID NO: 21696 - RNA, 17 nt, Artificial Sequence
  Synthetic
gaggcgcgggucgggcc

SEQ ID NO: 21697 - RNA, 17 nt, Artificial Sequence
  Synthetic
gcgccgccuccggggcc

SEQ ID NO: 21698 - RNA, 17 nt, Artificial Sequence
  Synthetic
gcuccgccccgggggcc

SEQ ID NO: 21699 - RNA, 17 nt, Artificial Sequence
  Synthetic
gccggggcgcgggggcc

SEQ ID NO: 21700 - RNA, 17 nt, Artificial Sequence
  Synthetic
cgcggacgcggggggcc

SEQ ID NO: 21701 - RNA, 17 nt, Artificial Sequence
  Synthetic
cgcggcucgggggggcc

SEQ ID NO: 21702 - RNA, 17 nt, Artificial Sequence
  Synthetic
cgcggccagggugggcc

SEQ ID NO: 21703 - RNA, 17 nt, Artificial Sequence
  Synthetic
cccgcggcgcccaugcc

SEQ ID NO: 21704 - RNA, 17 nt, Artificial Sequence
  Synthetic
agaacagagucugugcc

SEQ ID NO: 21705 - RNA, 17 nt, Artificial Sequence
  Synthetic
ggccgaggaagugugcc

SEQ ID NO: 21706 - RNA, 17 nt, Artificial Sequence
  Synthetic
ggacugccugcccaucc

SEQ ID NO: 21707 - RNA, 17 nt, Artificial Sequence
  Synthetic
gggcgucuggccccucc

SEQ ID NO: 21708 - RNA, 17 nt, Artificial Sequence
  Synthetic
gugcgagcgccgccucc

SEQ ID NO: 21709 - RNA, 17 nt, Artificial Sequence
  Synthetic
cguccguggugggcucc

SEQ ID NO: 21710 - RNA, 17 nt, Artificial Sequence
  Synthetic
gcaggcugcggaagucc

SEQ ID NO: 21711 - RNA, 17 nt, Artificial Sequence
  Synthetic
auuguuuucccucgucc

SEQ ID NO: 21712 - RNA, 17 nt, Artificial Sequence
  Synthetic
ggacgucaggggggucc

SEQ ID NO: 21713 - RNA, 17 nt, Artificial Sequence
  Synthetic
cggggcguacguggucc

SEQ ID NO: 21714 - RNA, 17 nt, Artificial Sequence
  Synthetic
cucggcacccguggucc

SEQ ID NO: 21715 - RNA, 17 nt, Artificial Sequence
  Synthetic
uccccgucuccaugucc

SEQ ID NO: 21716 - RNA, 17 nt, Artificial Sequence
  Synthetic
gccacgcggagacuucc

SEQ ID NO: 21717 - RNA, 17 nt, Artificial Sequence
  Synthetic
cgcguggcgcgucuucc

SEQ ID NO: 21718 - RNA, 17 nt, Artificial Sequence
  Synthetic
ggggggagggguuuucc

SEQ ID NO: 21719 - RNA, 17 nt, Artificial Sequence
  Synthetic
ucacgcagccccccagc

SEQ ID NO: 21720 - RNA, 17 nt, Artificial Sequence
  Synthetic
ggugcggcggcuccagc

SEQ ID NO: 21721 - RNA, 17 nt, Artificial Sequence
  Synthetic
ggaccgcggcccgcagc

SEQ ID NO: 21722 - RNA, 17 nt, Artificial Sequence
  Synthetic
cgccgccucugucgagc

SEQ ID NO: 21723 - RNA, 17 nt, Artificial Sequence
  Synthetic
ggcccccggggcggagc

SEQ ID NO: 21724 - RNA, 17 nt, Artificial Sequence
  Synthetic
aggcggcggaggggagc

SEQ ID NO: 21725 - RNA, 17 nt, Artificial Sequence
  Synthetic
cccgugguccggggagc

SEQ ID NO: 21726 - RNA, 17 nt, Artificial Sequence
  Synthetic
ccgcggucucggggagc

SEQ ID NO: 21727 - RNA, 17 nt, Artificial Sequence
  Synthetic
cuguuccacuccgacgc

SEQ ID NO: 21728 - RNA, 17 nt, Artificial Sequence
  Synthetic
gacgcggccgcggacgc

SEQ ID NO: 21729 - RNA, 17 nt, Artificial Sequence
  Synthetic
cugcuccccgagaccgc

SEQ ID NO: 21730 - RNA, 17 nt, Artificial Sequence
  Synthetic
acgggugccgagaccgc

SEQ ID NO: 21731 - RNA, 17 nt, Artificial Sequence
  Synthetic
ccagggucagguaccgc

SEQ ID NO: 21732 - RNA, 17 nt, Artificial Sequence
  Synthetic
ggugcugaacgacccgc

SEQ ID NO: 21733 - RNA, 17 nt, Artificial Sequence
  Synthetic
ucggccccgacccccgc

SEQ ID NO: 21734 - RNA, 17 nt, Artificial Sequence
  Synthetic
uaccgcccgccccccgc

SEQ ID NO: 21735 - RNA, 17 nt, Artificial Sequence
  Synthetic
gaagaggcggcccccgc

SEQ ID NO: 21736 - RNA, 17 nt, Artificial Sequence
  Synthetic
uccggggccguccccgc

SEQ ID NO: 21737 - RNA, 17 nt, Artificial Sequence
  Synthetic
cgcgugaggccgcccgc

SEQ ID NO: 21738 - RNA, 17 nt, Artificial Sequence
  Synthetic
gccgccucuuccgccgc

SEQ ID NO: 21739 - RNA, 17 nt, Artificial Sequence
  Synthetic
gcgagccgcggcgccgc

SEQ ID NO: 21740 - RNA, 17 nt, Artificial Sequence
  Synthetic
ggagggggcggcgccgc

SEQ ID NO: 21741 - RNA, 17 nt, Artificial Sequence
  Synthetic
ccuggcaugggcgccgc

SEQ ID NO: 21742 - RNA, 17 nt, Artificial Sequence
  Synthetic
cgcugcuucugggccgc

SEQ ID NO: 21743 - RNA, 17 nt, Artificial Sequence
  Synthetic
acacggcgcgcguccgc

SEQ ID NO: 21744 - RNA, 17 nt, Artificial Sequence
  Synthetic
cggcccagaagcagcgc

SEQ ID NO: 21745 - RNA, 17 nt, Artificial Sequence
  Synthetic
cggggccacggccgcgc

SEQ ID NO: 21746 - RNA, 17 nt, Artificial Sequence
  Synthetic
gccgcgcgggggcgcgc

SEQ ID NO: 21747 - RNA, 17 nt, Artificial Sequence
  Synthetic
gcgucccccccucgcgc

SEQ ID NO: 21748 - RNA, 17 nt, Artificial Sequence
  Synthetic
guccgaggaagaggcgc

SEQ ID NO: 21749 - RNA, 17 nt, Artificial Sequence
  Synthetic
ggggagcggggcggcgc

SEQ ID NO: 21750 - RNA, 17 nt, Artificial Sequence
  Synthetic
cccgggggccggggcgc

SEQ ID NO: 21751 - RNA, 17 nt, Artificial Sequence
  Synthetic
ucugcgugggggggcgc

SEQ ID NO: 21752 - RNA, 17 nt, Artificial Sequence
  Synthetic
ggccuguggggagaggc

SEQ ID NO: 21753 - RNA, 17 nt, Artificial Sequence
  Synthetic
guuguugaagcggaggc

SEQ ID NO: 21754 - RNA, 17 nt, Artificial Sequence
  Synthetic
gggccgcgguccccggc

SEQ ID NO: 21755 - RNA, 17 nt, Artificial Sequence
  Synthetic
cccccccucgcgccggc

SEQ ID NO: 21756 - RNA, 17 nt, Artificial Sequence
  Synthetic
uccgagccgcggccggc

SEQ ID NO: 21757 - RNA, 17 nt, Artificial Sequence
  Synthetic
ggcgcggggcguccggc

SEQ ID NO: 21758 - RNA, 17 nt, Artificial Sequence
  Synthetic
gcuguccgagccgcggc

SEQ ID NO: 21759 - RNA, 17 nt, Artificial Sequence
  Synthetic
uccgcggggcgggcggc

SEQ ID NO: 21760 - RNA, 17 nt, Artificial Sequence
  Synthetic
ccccuccgacucagggc

SEQ ID NO: 21761 - RNA, 17 nt, Artificial Sequence
  Synthetic
gaggaggccgucagggc

SEQ ID NO: 21762 - RNA, 17 nt, Artificial Sequence
  Synthetic
cgccccccgugacgggc

SEQ ID NO: 21763 - RNA, 17 nt, Artificial Sequence
  Synthetic
cuuccgccuccucgggc

SEQ ID NO: 21764 - RNA, 17 nt, Artificial Sequence
  Synthetic
cggggcggccgaggggc

SEQ ID NO: 21765 - RNA, 17 nt, Artificial Sequence
  Synthetic
cgcggggggcccggggc

SEQ ID NO: 21766 - RNA, 17 nt, Artificial Sequence
  Synthetic
gcgcgcguccgcggggc

SEQ ID NO: 21767 - RNA, 17 nt, Artificial Sequence
  Synthetic
ggcuccgccccgggggc

SEQ ID NO: 21768 - RNA, 17 nt, Artificial Sequence
  Synthetic
ggccggggcgcgggggc

SEQ ID NO: 21769 - RNA, 17 nt, Artificial Sequence
  Synthetic
uuguuugcaaggggggc

SEQ ID NO: 21770 - RNA, 17 nt, Artificial Sequence
  Synthetic
ggcguccggcggggggc

SEQ ID NO: 21771 - RNA, 17 nt, Artificial Sequence
  Synthetic
gcgcggcucgggggggc

SEQ ID NO: 21772 - RNA, 17 nt, Artificial Sequence
  Synthetic
agacccccgagaugggc

SEQ ID NO: 21773 - RNA, 17 nt, Artificial Sequence
  Synthetic
ccauguccaggaugggc

SEQ ID NO: 21774 - RNA, 17 nt, Artificial Sequence
  Synthetic
cgcggcucgcgacuggc

SEQ ID NO: 21775 - RNA, 17 nt, Artificial Sequence
  Synthetic
cuccucggccuccaugc

SEQ ID NO: 21776 - RNA, 17 nt, Artificial Sequence
  Synthetic
gcccucuuggccccugc

SEQ ID NO: 21777 - RNA, 17 nt, Artificial Sequence
  Synthetic
cauggcgacccggcugc

SEQ ID NO: 21778 - RNA, 17 nt, Artificial Sequence
  Synthetic
aagaacagagucugugc

SEQ ID NO: 21779 - RNA, 17 nt, Artificial Sequence
  Synthetic
uggagacggggaacauc

SEQ ID NO: 21780 - RNA, 17 nt, Artificial Sequence
  Synthetic
cccccucggcgcccauc

SEQ ID NO: 21781 - RNA, 17 nt, Artificial Sequence
  Synthetic
gggggucguucacgauc

SEQ ID NO: 21782 - RNA, 17 nt, Artificial Sequence
  Synthetic
cggccguggacuuuauc

SEQ ID NO: 21783 - RNA, 17 nt, Artificial Sequence
  Synthetic
cacccccccuccgacuc

SEQ ID NO: 21784 - RNA, 17 nt, Artificial Sequence
  Synthetic
ggggccgucggguacuc

SEQ ID NO: 21785 - RNA, 17 nt, Artificial Sequence
  Synthetic
cgcggcgccgcccccuc

SEQ ID NO: 21786 - RNA, 17 nt, Artificial Sequence
  Synthetic
ggggcgucuggccccuc

SEQ ID NO: 21787 - RNA, 17 nt, Artificial Sequence
  Synthetic
cggaguggaacagccuc

SEQ ID NO: 21788 - RNA, 17 nt, Artificial Sequence
  Synthetic
cgugcgagcgccgccuc

SEQ ID NO: 21789 - RNA, 17 nt, Artificial Sequence
  Synthetic
uccgcuuccgccuccuc

SEQ ID NO: 21790 - RNA, 17 nt, Artificial Sequence
  Synthetic
acgguggcgcgcggcuc

SEQ ID NO: 21791 - RNA, 17 nt, Artificial Sequence
  Synthetic
ucguccguggugggcuc

SEQ ID NO: 21792 - RNA, 17 nt, Artificial Sequence
  Synthetic
gcacucgucccuggcuc

SEQ ID NO: 21793 - RNA, 17 nt, Artificial Sequence
  Synthetic
cgcuaccugcccaucuc

SEQ ID NO: 21794 - RNA, 17 nt, Artificial Sequence
  Synthetic
ugguuacccgcggucuc

SEQ ID NO: 21795 - RNA, 17 nt, Artificial Sequence
  Synthetic
aggccgccgaggacguc

SEQ ID NO: 21796 - RNA, 17 nt, Artificial Sequence
  Synthetic
ugacaagggggcccguc

SEQ ID NO: 21797 - RNA, 17 nt, Artificial Sequence
  Synthetic
ucgccauguuucccguc

SEQ ID NO: 21798 - RNA, 17 nt, Artificial Sequence
  Synthetic
aggccgaggaggccguc

SEQ ID NO: 21799 - RNA, 17 nt, Artificial Sequence
  Synthetic
ccgacgcgggggccguc

SEQ ID NO: 21800 - RNA, 17 nt, Artificial Sequence
  Synthetic
gcguccgcggccgcguc

SEQ ID NO: 21801 - RNA, 17 nt, Artificial Sequence
  Synthetic
ggggggcgcggggcguc

SEQ ID NO: 21802 - RNA, 17 nt, Artificial Sequence
  Synthetic
gcgccgcggggggcguc

SEQ ID NO: 21803 - RNA, 17 nt, Artificial Sequence
  Synthetic
ugugcccccccaggguc

SEQ ID NO: 21804 - RNA, 17 nt, Artificial Sequence
  Synthetic
aggaagaggcgcggguc

SEQ ID NO: 21805 - RNA, 17 nt, Artificial Sequence
  Synthetic
cggccuccaugcggguc

SEQ ID NO: 21806 - RNA, 17 nt, Artificial Sequence
  Synthetic
cggcccccgcggggguc

SEQ ID NO: 21807 - RNA, 17 nt, Artificial Sequence
  Synthetic
ucucggcacccgugguc

SEQ ID NO: 21808 - RNA, 17 nt, Artificial Sequence
  Synthetic
cgccacgcggagacuuc

SEQ ID NO: 21809 - RNA, 17 nt, Artificial Sequence
  Synthetic
ggcccccgcgcugcuuc

SEQ ID NO: 21810 - RNA, 17 nt, Artificial Sequence
  Synthetic
ccgcguggcgcgucuuc

SEQ ID NO: 21811 - RNA, 17 nt, Artificial Sequence
  Synthetic
ccugggagggagacaag

SEQ ID NO: 21812 - RNA, 17 nt, Artificial Sequence
  Synthetic
gcgggucuguugacaag

SEQ ID NO: 21813 - RNA, 17 nt, Artificial Sequence
  Synthetic
cgccggcaggggccaag

SEQ ID NO: 21814 - RNA, 17 nt, Artificial Sequence
  Synthetic
ucucuguuguuugcaag

SEQ ID NO: 21815 - RNA, 17 nt, Artificial Sequence
  Synthetic
cggugcguccgaggaag

SEQ ID NO: 21816 - RNA, 17 nt, Artificial Sequence
  Synthetic
agaggcagaggaggaag

SEQ ID NO: 21817 - RNA, 17 nt, Artificial Sequence
  Synthetic
cggggccgaggaggaag

SEQ ID NO: 21818 - RNA, 17 nt, Artificial Sequence
  Synthetic
gcccgaggaggcggaag

SEQ ID NO: 21819 - RNA, 17 nt, Artificial Sequence
  Synthetic
ggccccggcggcggaag

SEQ ID NO: 21820 - RNA, 17 nt, Artificial Sequence
  Synthetic
gguugggguuguugaag

SEQ ID NO: 21821 - RNA, 17 nt, Artificial Sequence
  Synthetic
cgccuccugcucgacag

SEQ ID NO: 21822 - RNA, 17 nt, Artificial Sequence
  Synthetic
ccacgggggucauccag

SEQ ID NO: 21823 - RNA, 17 nt, Artificial Sequence
  Synthetic
accaccaccaacagcag

SEQ ID NO: 21824 - RNA, 17 nt, Artificial Sequence
  Synthetic
cgugguccggggagcag

SEQ ID NO: 21825 - RNA, 17 nt, Artificial Sequence
  Synthetic
cgcgcccccccacgcag

SEQ ID NO: 21826 - RNA, 17 nt, Artificial Sequence
  Synthetic
cgaggaggaagaggcag

SEQ ID NO: 21827 - RNA, 17 nt, Artificial Sequence
  Synthetic
cccccucgcgccggcag

SEQ ID NO: 21828 - RNA, 17 nt, Artificial Sequence
  Synthetic
ucuggacgggcaaucag

SEQ ID NO: 21829 - RNA, 17 nt, Artificial Sequence
  Synthetic
gccgccgaggacgucag

SEQ ID NO: 21830 - RNA, 17 nt, Artificial Sequence
  Synthetic
gcccgaugggcgccgag

SEQ ID NO: 21831 - RNA, 17 nt, Artificial Sequence
  Synthetic
gaggcggggcggccgag

SEQ ID NO: 21832 - RNA, 17 nt, Artificial Sequence
  Synthetic
gccccugccggcgcgag

SEQ ID NO: 21833 - RNA, 17 nt, Artificial Sequence
  Synthetic
ccccaacccccccggag

SEQ ID NO: 21834 - RNA, 17 nt, Artificial Sequence
  Synthetic
gcggggcggcgccggag

SEQ ID NO: 21835 - RNA, 17 nt, Artificial Sequence
  Synthetic
cgacagaggcggcggag

SEQ ID NO: 21836 - RNA, 17 nt, Artificial Sequence
  Synthetic
ccggcccugagucggag

SEQ ID NO: 21837 - RNA, 17 nt, Artificial Sequence
  Synthetic
cggcccccgcgucggag

SEQ ID NO: 21838 - RNA, 17 nt, Artificial Sequence
  Synthetic
gaggcggcggaggggag

SEQ ID NO: 21839 - RNA, 17 nt, Artificial Sequence
  Synthetic
gcguggacuggggggag

SEQ ID NO: 21840 - RNA, 17 nt, Artificial Sequence
  Synthetic
ggggggccuguggggag

SEQ ID NO: 21841 - RNA, 17 nt, Artificial Sequence
  Synthetic
cgaccagggcacccuag

SEQ ID NO: 21842 - RNA, 17 nt, Artificial Sequence
  Synthetic
acagcauguuccccacg

SEQ ID NO: 21843 - RNA, 17 nt, Artificial Sequence
  Synthetic
ccggaagacgcgccacg

SEQ ID NO: 21844 - RNA, 17 nt, Artificial Sequence
  Synthetic
cggcgcucgcacgcacg

SEQ ID NO: 21845 - RNA, 17 nt, Artificial Sequence
  Synthetic
acucggggggcaucacg

SEQ ID NO: 21846 - RNA, 17 nt, Artificial Sequence
  Synthetic
ugaacaagacuaucacg

SEQ ID NO: 21847 - RNA, 17 nt, Artificial Sequence
  Synthetic
acgccccgcccgucacg

SEQ ID NO: 21848 - RNA, 17 nt, Artificial Sequence
  Synthetic
uccuggacauggagacg

SEQ ID NO: 21849 - RNA, 17 nt, Artificial Sequence
  Synthetic
gcgcgcgggucccgacg

SEQ ID NO: 21850 - RNA, 17 nt, Artificial Sequence
  Synthetic
gcuguuccacuccgacg

SEQ ID NO: 21851 - RNA, 17 nt, Artificial Sequence
  Synthetic
ggaagcggaggaggacg

SEQ ID NO: 21852 - RNA, 17 nt, Artificial Sequence
  Synthetic
ggagcccaccacggacg

SEQ ID NO: 21853 - RNA, 17 nt, Artificial Sequence
  Synthetic
cgacgcggccgcggacg

SEQ ID NO: 21854 - RNA, 17 nt, Artificial Sequence
  Synthetic
ggcgucgacccgggacg

SEQ ID NO: 21855 - RNA, 17 nt, Artificial Sequence
  Synthetic
gaacaucggggcguacg

SEQ ID NO: 21856 - RNA, 17 nt, Artificial Sequence
  Synthetic
ccugcuccccgagaccg

SEQ ID NO: 21857 - RNA, 17 nt, Artificial Sequence
  Synthetic
gcuccagccggggaccg

SEQ ID NO: 21858 - RNA, 17 nt, Artificial Sequence
  Synthetic
cccagggucagguaccg

SEQ ID NO: 21859 - RNA, 17 nt, Artificial Sequence
  Synthetic
ugcggucucggcacccg

SEQ ID NO: 21860 - RNA, 17 nt, Artificial Sequence
  Synthetic
caucacgugguuacccg

SEQ ID NO: 21861 - RNA, 17 nt, Artificial Sequence
  Synthetic
cucggccccgacccccg

SEQ ID NO: 21862 - RNA, 17 nt, Artificial Sequence
  Synthetic
ccucuggaugacccccg

SEQ ID NO: 21863 - RNA, 17 nt, Artificial Sequence
  Synthetic
gggccagacgccccccg

SEQ ID NO: 21864 - RNA, 17 nt, Artificial Sequence
  Synthetic
uccccacaggccccccg

SEQ ID NO: 21865 - RNA, 17 nt, Artificial Sequence
  Synthetic
ccgcgccccggcccccg

SEQ ID NO: 21866 - RNA, 17 nt, Artificial Sequence
  Synthetic
ggaagaggcggcccccg

SEQ ID NO: 21867 - RNA, 17 nt, Artificial Sequence
  Synthetic
cacuuccucggcccccg

SEQ ID NO: 21868 - RNA, 17 nt, Artificial Sequence
  Synthetic
gccggccgcccgccccg

SEQ ID NO: 21869 - RNA, 17 nt, Artificial Sequence
  Synthetic
cggccggcuccgccccg

SEQ ID NO: 21870 - RNA, 17 nt, Artificial Sequence
  Synthetic
aucagcgguucgccccg

SEQ ID NO: 21871 - RNA, 17 nt, Artificial Sequence
  Synthetic
uuccggggccguccccg

SEQ ID NO: 21872 - RNA, 17 nt, Artificial Sequence
  Synthetic
accgacggccccgcccg

SEQ ID NO: 21873 - RNA, 17 nt, Artificial Sequence
  Synthetic
gcgcgugaggccgcccg

SEQ ID NO: 21874 - RNA, 17 nt, Artificial Sequence
  Synthetic
cggacgcggggggcccg

SEQ ID NO: 21875 - RNA, 17 nt, Artificial Sequence
  Synthetic
gggcacgggcccucccg

SEQ ID NO: 21876 - RNA, 17 nt, Artificial Sequence
  Synthetic
ugcggcggcuccagccg

SEQ ID NO: 21877 - RNA, 17 nt, Artificial Sequence
  Synthetic
gggcgcuguccgagccg

SEQ ID NO: 21878 - RNA, 17 nt, Artificial Sequence
  Synthetic
ccgccagucgcgagccg

SEQ ID NO: 21879 - RNA, 17 nt, Artificial Sequence
  Synthetic
cgccucuuccgccgccg

SEQ ID NO: 21880 - RNA, 17 nt, Artificial Sequence
  Synthetic
agaggcggaggccgccg

SEQ ID NO: 21881 - RNA, 17 nt, Artificial Sequence
  Synthetic
cgccccccgcggcgccg

SEQ ID NO: 21882 - RNA, 17 nt, Artificial Sequence
  Synthetic
cgcgagccgcggcgccg

SEQ ID NO: 21883 - RNA, 17 nt, Artificial Sequence
  Synthetic
cggagggggcggcgccg

SEQ ID NO: 21884 - RNA, 17 nt, Artificial Sequence
  Synthetic
gccuggcaugggcgccg

SEQ ID NO: 21885 - RNA, 17 nt, Artificial Sequence
  Synthetic
uggcccgaugggcgccg

SEQ ID NO: 21886 - RNA, 17 nt, Artificial Sequence
  Synthetic
ccuguggggagaggccg

SEQ ID NO: 21887 - RNA, 17 nt, Artificial Sequence
  Synthetic
gacccgcauggaggccg

SEQ ID NO: 21888 - RNA, 17 nt, Artificial Sequence
  Synthetic
cagggcgggcacggccg

SEQ ID NO: 21889 - RNA, 17 nt, Artificial Sequence
  Synthetic
agccccccagccggccg

SEQ ID NO: 21890 - RNA, 17 nt, Artificial Sequence
  Synthetic
gggucccgacgcggccg

SEQ ID NO: 21891 - RNA, 17 nt, Artificial Sequence
  Synthetic
gcgcccccgcgcggccg

SEQ ID NO: 21892 - RNA, 17 nt, Artificial Sequence
  Synthetic
cggaggcggggcggccg

SEQ ID NO: 21893 - RNA, 17 nt, Artificial Sequence
  Synthetic
ccuccgacucagggccg

SEQ ID NO: 21894 - RNA, 17 nt, Artificial Sequence
  Synthetic
gacccggcugcgggccg

SEQ ID NO: 21895 - RNA, 17 nt, Artificial Sequence
  Synthetic
cgcgggggucggggccg

SEQ ID NO: 21896 - RNA, 17 nt, Artificial Sequence
  Synthetic
cuccgccccgggggccg

SEQ ID NO: 21897 - RNA, 17 nt, Artificial Sequence
  Synthetic
cugggccgcgggggccg

SEQ ID NO: 21898 - RNA, 17 nt, Artificial Sequence
  Synthetic
aagcagcgcgggggccg

SEQ ID NO: 21899 - RNA, 17 nt, Artificial Sequence
  Synthetic
gcgcugcuucugggccg

SEQ ID NO: 21900 - RNA, 17 nt, Artificial Sequence
  Synthetic
ggcgucuggccccuccg

SEQ ID NO: 21901 - RNA, 17 nt, Artificial Sequence
  Synthetic
ugcgagcgccgccuccg

SEQ ID NO: 21902 - RNA, 17 nt, Artificial Sequence
  Synthetic
cgggccccccgcguccg

SEQ ID NO: 21903 - RNA, 17 nt, Artificial Sequence
  Synthetic
cacacggcgcgcguccg

SEQ ID NO: 21904 - RNA, 17 nt, Artificial Sequence
  Synthetic
aggcggcggugcguccg

SEQ ID NO: 21905 - RNA, 17 nt, Artificial Sequence
  Synthetic
gucgucauccucguccg

SEQ ID NO: 21906 - RNA, 17 nt, Artificial Sequence
  Synthetic
ucggcacccgugguccg

SEQ ID NO: 21907 - RNA, 17 nt, Artificial Sequence
  Synthetic
ccacgcggagacuuccg

SEQ ID NO: 21908 - RNA, 17 nt, Artificial Sequence
  Synthetic
gcggcccagaagcagcg

SEQ ID NO: 21909 - RNA, 17 nt, Artificial Sequence
  Synthetic
ggcggcggaggggagcg

SEQ ID NO: 21910 - RNA, 17 nt, Artificial Sequence
  Synthetic
cucgggggucucuagcg

SEQ ID NO: 21911 - RNA, 17 nt, Artificial Sequence
  Synthetic
uguuccacuccgacgcg

SEQ ID NO: 21912 - RNA, 17 nt, Artificial Sequence
  Synthetic
acgcggccgcggacgcg

SEQ ID NO: 21913 - RNA, 17 nt, Artificial Sequence
  Synthetic
cgcgagggggggacgcg

SEQ ID NO: 21914 - RNA, 17 nt, Artificial Sequence
  Synthetic
cagggucagguaccgcg

SEQ ID NO: 21915 - RNA, 17 nt, Artificial Sequence
  Synthetic
cggccccgacccccgcg

SEQ ID NO: 21916 - RNA, 17 nt, Artificial Sequence
  Synthetic
acccgcgcgcccccgcg

SEQ ID NO: 21917 - RNA, 17 nt, Artificial Sequence
  Synthetic
aagaggcggcccccgcg

SEQ ID NO: 21918 - RNA, 17 nt, Artificial Sequence
  Synthetic
gcgugaggccgcccgcg

SEQ ID NO: 21919 - RNA, 17 nt, Artificial Sequence
  Synthetic
cgagccgcggcgccgcg

SEQ ID NO: 21920 - RNA, 17 nt, Artificial Sequence
  Synthetic
cuggcaugggcgccgcg

SEQ ID NO: 21921 - RNA, 17 nt, Artificial Sequence
  Synthetic
acggggccacggccgcg

SEQ ID NO: 21922 - RNA, 17 nt, Artificial Sequence
  Synthetic
gcugcuucugggccgcg

SEQ ID NO: 21923 - RNA, 17 nt, Artificial Sequence
  Synthetic
ccccggaagucuccgcg

SEQ ID NO: 21924 - RNA, 17 nt, Artificial Sequence
  Synthetic
cacggcgcgcguccgcg

SEQ ID NO: 21925 - RNA, 17 nt, Artificial Sequence
  Synthetic
ggcccagaagcagcgcg

SEQ ID NO: 21926 - RNA, 17 nt, Artificial Sequence
  Synthetic
ggggccacggccgcgcg

SEQ ID NO: 21927 - RNA, 17 nt, Artificial Sequence
  Synthetic
uggccccugccggcgcg

SEQ ID NO: 21928 - RNA, 17 nt, Artificial Sequence
  Synthetic
ccgggggccggggcgcg

SEQ ID NO: 21929 - RNA, 17 nt, Artificial Sequence
  Synthetic
ggccgcgcgggggcgcg

SEQ ID NO: 21930 - RNA, 17 nt, Artificial Sequence
  Synthetic
cugcgugggggggcgcg

SEQ ID NO: 21931 - RNA, 17 nt, Artificial Sequence
  Synthetic
cgugcgacgguggcgcg

SEQ ID NO: 21932 - RNA, 17 nt, Artificial Sequence
  Synthetic
cguccgaggaagaggcg

SEQ ID NO: 21933 - RNA, 17 nt, Artificial Sequence
  Synthetic
uuguugaagcggaggcg

SEQ ID NO: 21934 - RNA, 17 nt, Artificial Sequence
  Synthetic
gcgcggggcguccggcg

SEQ ID NO: 21935 - RNA, 17 nt, Artificial Sequence
  Synthetic
gccccccgugacgggcg

SEQ ID NO: 21936 - RNA, 17 nt, Artificial Sequence
  Synthetic
cucgggggggccgggcg

SEQ ID NO: 21937 - RNA, 17 nt, Artificial Sequence
  Synthetic
uuccgccuccucgggcg

SEQ ID NO: 21938 - RNA, 17 nt, Artificial Sequence
  Synthetic
gcggggggcccggggcg

SEQ ID NO: 21939 - RNA, 17 nt, Artificial Sequence
  Synthetic
ccccgggggccggggcg

SEQ ID NO: 21940 - RNA, 17 nt, Artificial Sequence
  Synthetic
gcccgucacggggggcg

SEQ ID NO: 21941 - RNA, 17 nt, Artificial Sequence
  Synthetic
ucagggccgggggggcg

SEQ ID NO: 21942 - RNA, 17 nt, Artificial Sequence
  Synthetic
cucugcgugggggggcg

SEQ ID NO: 21943 - RNA, 17 nt, Artificial Sequence
  Synthetic
gcggcggcgccucugcg

SEQ ID NO: 21944 - RNA, 17 nt, Artificial Sequence
  Synthetic
ggagacggggaacaucg

SEQ ID NO: 21945 - RNA, 17 nt, Artificial Sequence
  Synthetic
gggccgucggguacucg

SEQ ID NO: 21946 - RNA, 17 nt, Artificial Sequence
  Synthetic
cgguggcgcgcggcucg

SEQ ID NO: 21947 - RNA, 17 nt, Artificial Sequence
  Synthetic
gcuaccugcccaucucg

SEQ ID NO: 21948 - RNA, 17 nt, Artificial Sequence
  Synthetic
gguuacccgcggucucg

SEQ ID NO: 21949 - RNA, 17 nt, Artificial Sequence
  Synthetic
ggcccccgcgggggucg

SEQ ID NO: 21950 - RNA, 17 nt, Artificial Sequence
  Synthetic
acucuguucuugguucg

SEQ ID NO: 21951 - RNA, 17 nt, Artificial Sequence
  Synthetic
cgggucuguugacaagg

SEQ ID NO: 21952 - RNA, 17 nt, Artificial Sequence
  Synthetic
cucuguuguuugcaagg

SEQ ID NO: 21953 - RNA, 17 nt, Artificial Sequence
  Synthetic
cgccucugucgagcagg

SEQ ID NO: 21954 - RNA, 17 nt, Artificial Sequence
  Synthetic
gugguccggggagcagg

SEQ ID NO: 21955 - RNA, 17 nt, Artificial Sequence
  Synthetic
ccgccgaggacgucagg

SEQ ID NO: 21956 - RNA, 17 nt, Artificial Sequence
  Synthetic
ggcagaggaggaagagg

SEQ ID NO: 21957 - RNA, 17 nt, Artificial Sequence
  Synthetic
cccggcggcggaagagg

SEQ ID NO: 21958 - RNA, 17 nt, Artificial Sequence
  Synthetic
cuccugcucgacagagg

SEQ ID NO: 21959 - RNA, 17 nt, Artificial Sequence
  Synthetic
ggaggaagaggcagagg

SEQ ID NO: 21960 - RNA, 17 nt, Artificial Sequence
  Synthetic
gacggccccgcccgagg

SEQ ID NO: 21961 - RNA, 17 nt, Artificial Sequence
  Synthetic
cccgaugggcgccgagg

SEQ ID NO: 21962 - RNA, 17 nt, Artificial Sequence
  Synthetic
ccgcauggaggccgagg

SEQ ID NO: 21963 - RNA, 17 nt, Artificial Sequence
  Synthetic
gggggucggggccgagg

SEQ ID NO: 21964 - RNA, 17 nt, Artificial Sequence
  Synthetic
ccccugccggcgcgagg

SEQ ID NO: 21965 - RNA, 17 nt, Artificial Sequence
  Synthetic
cucugucgagcaggagg

SEQ ID NO: 21966 - RNA, 17 nt, Artificial Sequence
  Synthetic
ggccccgcccgaggagg

SEQ ID NO: 21967 - RNA, 17 nt, Artificial Sequence
  Synthetic
gggccgggccccggagg

SEQ ID NO: 21968 - RNA, 17 nt, Artificial Sequence
  Synthetic
cggggcggcgccggagg

SEQ ID NO: 21969 - RNA, 17 nt, Artificial Sequence
  Synthetic
ggaggcggaagcggagg

SEQ ID NO: 21970 - RNA, 17 nt, Artificial Sequence
  Synthetic
gguuguugaagcggagg

SEQ ID NO: 21971 - RNA, 17 nt, Artificial Sequence
  Synthetic
cggcccugagucggagg

SEQ ID NO: 21972 - RNA, 17 nt, Artificial Sequence
  Synthetic
cagcauguuccccacgg

SEQ ID NO: 21973 - RNA, 17 nt, Artificial Sequence
  Synthetic
gaacaagacuaucacgg

SEQ ID NO: 21974 - RNA, 17 nt, Artificial Sequence
  Synthetic
cgccccgcccgucacgg

SEQ ID NO: 21975 - RNA, 17 nt, Artificial Sequence
  Synthetic
ccgggcgcgugcgacgg

SEQ ID NO: 21976 - RNA, 17 nt, Artificial Sequence
  Synthetic
aaccccaacccccccgg

SEQ ID NO: 21977 - RNA, 17 nt, Artificial Sequence
  Synthetic
ggccggcuccgccccgg

SEQ ID NO: 21978 - RNA, 17 nt, Artificial Sequence
  Synthetic
ggaggacgcggccccgg

SEQ ID NO: 21979 - RNA, 17 nt, Artificial Sequence
  Synthetic
cgggggccgggccccgg

SEQ ID NO: 21980 - RNA, 17 nt, Artificial Sequence
  Synthetic
gagcggggcggcgccgg

SEQ ID NO: 21981 - RNA, 17 nt, Artificial Sequence
  Synthetic
cuguggggagaggccgg

SEQ ID NO: 21982 - RNA, 17 nt, Artificial Sequence
  Synthetic
cuccgacucagggccgg

SEQ ID NO: 21983 - RNA, 17 nt, Artificial Sequence
  Synthetic
gcgucuggccccuccgg

SEQ ID NO: 21984 - RNA, 17 nt, Artificial Sequence
  Synthetic
gggcgcggggcguccgg

SEQ ID NO: 21985 - RNA, 17 nt, Artificial Sequence
  Synthetic
cgaggaggcggaagcgg

SEQ ID NO: 21986 - RNA, 17 nt, Artificial Sequence
  Synthetic
ugggguuguugaagcgg

SEQ ID NO: 21987 - RNA, 17 nt, Artificial Sequence
  Synthetic
accaccaacagcagcgg

SEQ ID NO: 21988 - RNA, 17 nt, Artificial Sequence
  Synthetic
guuccacuccgacgcgg

SEQ ID NO: 21989 - RNA, 17 nt, Artificial Sequence
  Synthetic
cgcggccgcggacgcgg

SEQ ID NO: 21990 - RNA, 17 nt, Artificial Sequence
  Synthetic
ggccccgacccccgcgg

SEQ ID NO: 21991 - RNA, 17 nt, Artificial Sequence
  Synthetic
agaggcggcccccgcgg

SEQ ID NO: 21992 - RNA, 17 nt, Artificial Sequence
  Synthetic
gagccgcggcgccgcgg

SEQ ID NO: 21993 - RNA, 17 nt, Artificial Sequence
  Synthetic
uggcaugggcgccgcgg

SEQ ID NO: 21994 - RNA, 17 nt, Artificial Sequence
  Synthetic
cugcuucugggccgcgg

SEQ ID NO: 21995 - RNA, 17 nt, Artificial Sequence
  Synthetic
gcccagaagcagcgcgg

SEQ ID NO: 21996 - RNA, 17 nt, Artificial Sequence
  Synthetic
gggccacggccgcgcgg

SEQ ID NO: 21997 - RNA, 17 nt, Artificial Sequence
  Synthetic
cgggggccggggcgcgg

SEQ ID NO: 21998 - RNA, 17 nt, Artificial Sequence
  Synthetic
cgucacggggggcgcgg

SEQ ID NO: 21999 - RNA, 17 nt, Artificial Sequence
  Synthetic
agaggaggaagaggcgg

SEQ ID NO: 22000 - RNA, 17 nt, Artificial Sequence
  Synthetic
cugcucgacagaggcgg

SEQ ID NO: 22001 - RNA, 17 nt, Artificial Sequence
  Synthetic
ugucgagcaggaggcgg

SEQ ID NO: 22002 - RNA, 17 nt, Artificial Sequence
  Synthetic
ggacgcggccccggcgg

SEQ ID NO: 22003 - RNA, 17 nt, Artificial Sequence
  Synthetic
cgcggggcguccggcgg

SEQ ID NO: 22004 - RNA, 17 nt, Artificial Sequence
  Synthetic
accaacagcagcggcgg

SEQ ID NO: 22005 - RNA, 17 nt, Artificial Sequence
  Synthetic
cucgacagaggcggcgg

SEQ ID NO: 22006 - RNA, 17 nt, Artificial Sequence
  Synthetic
aacagcagcggcggcgg

SEQ ID NO: 22007 - RNA, 17 nt, Artificial Sequence
  Synthetic
cggggggcccggggcgg

SEQ ID NO: 22008 - RNA, 17 nt, Artificial Sequence
  Synthetic
cggggagcagggugcgg

SEQ ID NO: 22009 - RNA, 17 nt, Artificial Sequence
  Synthetic
ggccgucggguacucgg

SEQ ID NO: 22010 - RNA, 17 nt, Artificial Sequence
  Synthetic
cccccugacguccucgg

SEQ ID NO: 22011 - RNA, 17 nt, Artificial Sequence
  Synthetic
gguggcgcgcggcucgg

SEQ ID NO: 22012 - RNA, 17 nt, Artificial Sequence
  Synthetic
cuaccugcccaucucgg

SEQ ID NO: 22013 - RNA, 17 nt, Artificial Sequence
  Synthetic
ccccggcccugagucgg

SEQ ID NO: 22014 - RNA, 17 nt, Artificial Sequence
  Synthetic
ucuguuguuugcaaggg

SEQ ID NO: 22015 - RNA, 17 nt, Artificial Sequence
  Synthetic
ggggggcgcggccaggg

SEQ ID NO: 22016 - RNA, 17 nt, Artificial Sequence
  Synthetic
cgccgaggacgucaggg

SEQ ID NO: 22017 - RNA, 17 nt, Artificial Sequence
  Synthetic
cgaggaggccgucaggg

SEQ ID NO: 22018 - RNA, 17 nt, Artificial Sequence
  Synthetic
ggcaggggccaagaggg

SEQ ID NO: 22019 - RNA, 17 nt, Artificial Sequence
  Synthetic
ccgaugggcgccgaggg

SEQ ID NO: 22020 - RNA, 17 nt, Artificial Sequence
  Synthetic
agcgcgggggccgaggg

SEQ ID NO: 22021 - RNA, 17 nt, Artificial Sequence
  Synthetic
cccugccggcgcgaggg

SEQ ID NO: 22022 - RNA, 17 nt, Artificial Sequence
  Synthetic
ggcccugagucggaggg

SEQ ID NO: 22023 - RNA, 17 nt, Artificial Sequence
  Synthetic
gggccgggcguggaggg

SEQ ID NO: 22024 - RNA, 17 nt, Artificial Sequence
  Synthetic
gccccgcccgucacggg

SEQ ID NO: 22025 - RNA, 17 nt, Artificial Sequence
  Synthetic
gcgccccccgugacggg

SEQ ID NO: 22026 - RNA, 17 nt, Artificial Sequence
  Synthetic
uguggggagaggccggg

SEQ ID NO: 22027 - RNA, 17 nt, Artificial Sequence
  Synthetic
uccgacucagggccggg

SEQ ID NO: 22028 - RNA, 17 nt, Artificial Sequence
  Synthetic
cgucuggccccuccggg

SEQ ID NO: 22029 - RNA, 17 nt, Artificial Sequence
  Synthetic
ccguggugggcuccggg

SEQ ID NO: 22030 - RNA, 17 nt, Artificial Sequence
  Synthetic
gcggccgcggacgcggg

SEQ ID NO: 22031 - RNA, 17 nt, Artificial Sequence
  Synthetic
ggggccguccccgcggg

SEQ ID NO: 22032 - RNA, 17 nt, Artificial Sequence
  Synthetic
agccgcggcgccgcggg

SEQ ID NO: 22033 - RNA, 17 nt, Artificial Sequence
  Synthetic
gggggcggcgccgcggg

SEQ ID NO: 22034 - RNA, 17 nt, Artificial Sequence
  Synthetic
ggcaugggcgccgcggg

SEQ ID NO: 22035 - RNA, 17 nt, Artificial Sequence
  Synthetic
gcggggcguccggcggg

SEQ ID NO: 22036 - RNA, 17 nt, Artificial Sequence
  Synthetic
ggggggcccggggcggg

SEQ ID NO: 22037 - RNA, 17 nt, Artificial Sequence
  Synthetic
cgcguccgcggggcggg

SEQ ID NO: 22038 - RNA, 17 nt, Artificial Sequence
  Synthetic
guccggcggggggcggg

SEQ ID NO: 22039 - RNA, 17 nt, Artificial Sequence
  Synthetic
gccgucggguacucggg

SEQ ID NO: 22040 - RNA, 17 nt, Artificial Sequence
  Synthetic
gcuuccgccuccucggg

SEQ ID NO: 22041 - RNA, 17 nt, Artificial Sequence
  Synthetic
guggcgcgcggcucggg

SEQ ID NO: 22042 - RNA, 17 nt, Artificial Sequence
  Synthetic
ccugccggcgcgagggg

SEQ ID NO: 22043 - RNA, 17 nt, Artificial Sequence
  Synthetic
gcccugagucggagggg

SEQ ID NO: 22044 - RNA, 17 nt, Artificial Sequence
  Synthetic
cgccccggcccccgggg

SEQ ID NO: 22045 - RNA, 17 nt, Artificial Sequence
  Synthetic
acgcggggggcccgggg

SEQ ID NO: 22046 - RNA, 17 nt, Artificial Sequence
  Synthetic
guggggagaggccgggg

SEQ ID NO: 22047 - RNA, 17 nt, Artificial Sequence
  Synthetic
ccgacucagggccgggg

SEQ ID NO: 22048 - RNA, 17 nt, Artificial Sequence
  Synthetic
gucuggccccuccgggg

SEQ ID NO: 22049 - RNA, 17 nt, Artificial Sequence
  Synthetic
ggcggaggggagcgggg

SEQ ID NO: 22050 - RNA, 17 nt, Artificial Sequence
  Synthetic
ggcgcgcguccgcgggg

SEQ ID NO: 22051 - RNA, 17 nt, Artificial Sequence
  Synthetic
uugaagcggaggcgggg

SEQ ID NO: 22052 - RNA, 17 nt, Artificial Sequence
  Synthetic
uggcgcgcggcucgggg

SEQ ID NO: 22053 - RNA, 17 nt, Artificial Sequence
  Synthetic
ggcggcgccggaggggg

SEQ ID NO: 22054 - RNA, 17 nt, Artificial Sequence
  Synthetic
guuguuugcaagggggg

SEQ ID NO: 22055 - RNA, 17 nt, Artificial Sequence
  Synthetic
gggcguccggcgggggg

SEQ ID NO: 22056 - RNA, 17 nt, Artificial Sequence
  Synthetic
gggcccggggcgggggg

SEQ ID NO: 22057 - RNA, 17 nt, Artificial Sequence
  Synthetic
acgcguggacugggggg

SEQ ID NO: 22058 - RNA, 17 nt, Artificial Sequence
  Synthetic
gguaccugacccugggg

SEQ ID NO: 22059 - RNA, 17 nt, Artificial Sequence
  Synthetic
ggcgccucugcgugggg

SEQ ID NO: 22060 - RNA, 17 nt, Artificial Sequence
  Synthetic
gggacgcguggacuggg

SEQ ID NO: 22061 - RNA, 17 nt, Artificial Sequence
  Synthetic
cgguaccugacccuggg

SEQ ID NO: 22062 - RNA, 17 nt, Artificial Sequence
  Synthetic
gccgucggugcccuggg

SEQ ID NO: 22063 - RNA, 17 nt, Artificial Sequence
  Synthetic
agccgcggccggcuggg

SEQ ID NO: 22064 - RNA, 17 nt, Artificial Sequence
  Synthetic
cggcgccucugcguggg

SEQ ID NO: 22065 - RNA, 17 nt, Artificial Sequence
  Synthetic
ggugggcuccggguggg

SEQ ID NO: 22066 - RNA, 17 nt, Artificial Sequence
  Synthetic
cccccagacccgcaugg

SEQ ID NO: 22067 - RNA, 17 nt, Artificial Sequence
  Synthetic
ccgcggcucgcgacugg

SEQ ID NO: 22068 - RNA, 17 nt, Artificial Sequence
  Synthetic
ggggacgcguggacugg

SEQ ID NO: 22069 - RNA, 17 nt, Artificial Sequence
  Synthetic
gcgguaccugacccugg

SEQ ID NO: 22070 - RNA, 17 nt, Artificial Sequence
  Synthetic
ggcguacgugguccugg

SEQ ID NO: 22071 - RNA, 17 nt, Artificial Sequence
  Synthetic
gagccgcggccggcugg

SEQ ID NO: 22072 - RNA, 17 nt, Artificial Sequence
  Synthetic
ccuccaugcgggucugg

SEQ ID NO: 22073 - RNA, 17 nt, Artificial Sequence
  Synthetic
gucauccucguccgugg

SEQ ID NO: 22074 - RNA, 17 nt, Artificial Sequence
  Synthetic
gggggggccgggcgugg

SEQ ID NO: 22075 - RNA, 17 nt, Artificial Sequence
  Synthetic
gcggcgccucugcgugg

SEQ ID NO: 22076 - RNA, 17 nt, Artificial Sequence
  Synthetic
gccgcugcuguuggugg

SEQ ID NO: 22077 - RNA, 17 nt, Artificial Sequence
  Synthetic
gccgccgcugcuguugg

SEQ ID NO: 22078 - RNA, 17 nt, Artificial Sequence
  Synthetic
ccuccucggccuccaug

SEQ ID NO: 22079 - RNA, 17 nt, Artificial Sequence
  Synthetic
agucgcugaucacuaug

SEQ ID NO: 22080 - RNA, 17 nt, Artificial Sequence
  Synthetic
agggacgagugcgacug

SEQ ID NO: 22081 - RNA, 17 nt, Artificial Sequence
  Synthetic
gggggacgcguggacug

SEQ ID NO: 22082 - RNA, 17 nt, Artificial Sequence
  Synthetic
cgcgguaccugacccug

SEQ ID NO: 22083 - RNA, 17 nt, Artificial Sequence
  Synthetic
uggacuuccgcagccug

SEQ ID NO: 22084 - RNA, 17 nt, Artificial Sequence
  Synthetic
gcgccgcggggggccug

SEQ ID NO: 22085 - RNA, 17 nt, Artificial Sequence
  Synthetic
gccgagaccgcaggcug

SEQ ID NO: 22086 - RNA, 17 nt, Artificial Sequence
  Synthetic
acauggcgacccggcug

SEQ ID NO: 22087 - RNA, 17 nt, Artificial Sequence
  Synthetic
cgagccgcggccggcug

SEQ ID NO: 22088 - RNA, 17 nt, Artificial Sequence
  Synthetic
gccuccaugcgggucug

SEQ ID NO: 22089 - RNA, 17 nt, Artificial Sequence
  Synthetic
ucuggaugacccccgug

SEQ ID NO: 22090 - RNA, 17 nt, Artificial Sequence
  Synthetic
guguuacugcugccgug

SEQ ID NO: 22091 - RNA, 17 nt, Artificial Sequence
  Synthetic
ugggcagguagcgcgug

SEQ ID NO: 22092 - RNA, 17 nt, Artificial Sequence
  Synthetic
ggcggcgccucugcgug

SEQ ID NO: 22093 - RNA, 17 nt, Artificial Sequence
  Synthetic
ugggggggcacacggug

SEQ ID NO: 22094 - RNA, 17 nt, Artificial Sequence
  Synthetic
ucucggggagcagggug

SEQ ID NO: 22095 - RNA, 17 nt, Artificial Sequence
  Synthetic
gccgcggggggccugug

SEQ ID NO: 22096 - RNA, 17 nt, Artificial Sequence
  Synthetic
ccccuccggggggguug

SEQ ID NO: 22097 - RNA, 17 nt, Artificial Sequence
  Synthetic
cggggggguugggguug

SEQ ID NO: 22098 - RNA, 17 nt, Artificial Sequence
  Synthetic
gguugggguugggguug

SEQ ID NO: 22099 - RNA, 17 nt, Artificial Sequence
  Synthetic
auggagacggggaacau

SEQ ID NO: 22100 - RNA, 17 nt, Artificial Sequence
  Synthetic
ccccccucggcgcccau

SEQ ID NO: 22101 - RNA, 17 nt, Artificial Sequence
  Synthetic
ggggcggagccuggcau

SEQ ID NO: 22102 - RNA, 17 nt, Artificial Sequence
  Synthetic
cuagagacccccgagau

SEQ ID NO: 22103 - RNA, 17 nt, Artificial Sequence
  Synthetic
ugggggucguucacgau

SEQ ID NO: 22104 - RNA, 17 nt, Artificial Sequence
  Synthetic
cugccguguggcccgau

SEQ ID NO: 22105 - RNA, 17 nt, Artificial Sequence
  Synthetic
gucuccauguccaggau

SEQ ID NO: 22106 - RNA, 17 nt, Artificial Sequence
  Synthetic
gagucgcugaucacuau

SEQ ID NO: 22107 - RNA, 17 nt, Artificial Sequence
  Synthetic
aguccagggcgcccacu

SEQ ID NO: 22108 - RNA, 17 nt, Artificial Sequence
  Synthetic
cagggacgagugcgacu

SEQ ID NO: 22109 - RNA, 17 nt, Artificial Sequence
  Synthetic
ggggggacgcguggacu

SEQ ID NO: 22110 - RNA, 17 nt, Artificial Sequence
  Synthetic
gggggccgucggguacu

SEQ ID NO: 22111 - RNA, 17 nt, Artificial Sequence
  Synthetic
ccgcgguaccugacccu

SEQ ID NO: 22112 - RNA, 17 nt, Artificial Sequence
  Synthetic
ucggacagcgccccccu

SEQ ID NO: 22113 - RNA, 17 nt, Artificial Sequence
  Synthetic
gggcccguccggccccu

SEQ ID NO: 22114 - RNA, 17 nt, Artificial Sequence
  Synthetic
ggggccgucggugcccu

SEQ ID NO: 22115 - RNA, 17 nt, Artificial Sequence
  Synthetic
caagaggaaaccucccu

SEQ ID NO: 22116 - RNA, 17 nt, Artificial Sequence
  Synthetic
cuccgcuuccgccuccu

SEQ ID NO: 22117 - RNA, 17 nt, Artificial Sequence
  Synthetic
cgcccugacggccuccu

SEQ ID NO: 22118 - RNA, 17 nt, Artificial Sequence
  Synthetic
cucugccucuuccuccu

SEQ ID NO: 22119 - RNA, 17 nt, Artificial Sequence
  Synthetic
gaccccccugacguccu

SEQ ID NO: 22120 - RNA, 17 nt, Artificial Sequence
  Synthetic
uuccgggcacacuuccu

SEQ ID NO: 22121 - RNA, 17 nt, Artificial Sequence
  Synthetic
gacccgcgccucuuccu

SEQ ID NO: 22122 - RNA, 17 nt, Artificial Sequence
  Synthetic
gugcugaacgacccgcu

SEQ ID NO: 22123 - RNA, 17 nt, Artificial Sequence
  Synthetic
ccgagccgcggccggcu

SEQ ID NO: 22124 - RNA, 17 nt, Artificial Sequence
  Synthetic
cccagccggccgcggcu

SEQ ID NO: 22125 - RNA, 17 nt, Artificial Sequence
  Synthetic
gacgguggcgcgcggcu

SEQ ID NO: 22126 - RNA, 17 nt, Artificial Sequence
  Synthetic
gcgcuaccugcccaucu

SEQ ID NO: 22127 - RNA, 17 nt, Artificial Sequence
  Synthetic
gugcgucgccgcccucu

SEQ ID NO: 22128 - RNA, 17 nt, Artificial Sequence
  Synthetic
gugguuacccgcggucu

SEQ ID NO: 22129 - RNA, 17 nt, Artificial Sequence
  Synthetic
uccgcagccugcggucu

SEQ ID NO: 22130 - RNA, 17 nt, Artificial Sequence
  Synthetic
ggccuccaugcgggucu

SEQ ID NO: 22131 - RNA, 17 nt, Artificial Sequence
  Synthetic
gcccccgcgcugcuucu

SEQ ID NO: 22132 - RNA, 17 nt, Artificial Sequence
  Synthetic
ggcacagacucuguucu

SEQ ID NO: 22133 - RNA, 17 nt, Artificial Sequence
  Synthetic
cccccccggcccugagu

SEQ ID NO: 22134 - RNA, 17 nt, Artificial Sequence
  Synthetic
gaccagggcacccuagu

SEQ ID NO: 22135 - RNA, 17 nt, Artificial Sequence
  Synthetic
cucuggaugacccccgu

SEQ ID NO: 22136 - RNA, 17 nt, Artificial Sequence
  Synthetic
uccucgggcggggccgu

SEQ ID NO: 22137 - RNA, 17 nt, Artificial Sequence
  Synthetic
uccgacgcgggggccgu

SEQ ID NO: 22138 - RNA, 17 nt, Artificial Sequence
  Synthetic
cccgacggcccccgcgu

SEQ ID NO: 22139 - RNA, 17 nt, Artificial Sequence
  Synthetic
cgcguccgcggccgcgu

SEQ ID NO: 22140 - RNA, 17 nt, Artificial Sequence
  Synthetic
cggcggcgccucugcgu

SEQ ID NO: 22141 - RNA, 17 nt, Artificial Sequence
  Synthetic
gggggcgcggccagggu

SEQ ID NO: 22142 - RNA, 17 nt, Artificial Sequence
  Synthetic
ggccgggcguggagggu

SEQ ID NO: 22143 - RNA, 17 nt, Artificial Sequence
  Synthetic
cguggugggcuccgggu

SEQ ID NO: 22144 - RNA, 17 nt, Artificial Sequence
  Synthetic
gaggaagaggcgcgggu

SEQ ID NO: 22145 - RNA, 17 nt, Artificial Sequence
  Synthetic
gcggcccccgcgggggu

SEQ ID NO: 22146 - RNA, 17 nt, Artificial Sequence
  Synthetic
ggccccuccgggggggu

SEQ ID NO: 22147 - RNA, 17 nt, Artificial Sequence
  Synthetic
uccggggggguuggggu

SEQ ID NO: 22148 - RNA, 17 nt, Artificial Sequence
  Synthetic
gggguugggguuggggu

SEQ ID NO: 22149 - RNA, 17 nt, Artificial Sequence
  Synthetic
gugggcuccgggugggu

SEQ ID NO: 22150 - RNA, 17 nt, Artificial Sequence
  Synthetic
ucauccucguccguggu

SEQ ID NO: 22151 - RNA, 17 nt, Artificial Sequence
  Synthetic
cgccgcggggggccugu

SEQ ID NO: 22152 - RNA, 17 nt, Artificial Sequence
  Synthetic
gccgccgccgcugcugu

SEQ ID NO: 22153 - RNA, 17 nt, Artificial Sequence
  Synthetic
gcuguuggugguggugu

SEQ ID NO: 22154 - RNA, 17 nt, Artificial Sequence
  Synthetic
gccccuccggggggguu

SEQ ID NO: 22155 - RNA, 17 nt, Artificial Sequence
  Synthetic
ccggggggguugggguu

SEQ ID NO: 22156 - RNA, 17 nt, Artificial Sequence
  Synthetic
ggguugggguugggguu

SEQ ID NO: 22157 - RNA, 20 nt, Artificial Sequence
  Synthetic
gggggcgggucuguugacaa

SEQ ID NO: 22158 - RNA, 20 nt, Artificial Sequence
  Synthetic
ggggucucuguuguuugcaa

SEQ ID NO: 22159 - RNA, 20 nt, Artificial Sequence
  Synthetic
gguggaccagacgggaaaca

SEQ ID NO: 22160 - RNA, 20 nt, Artificial Sequence
  Synthetic
ucggcgcccaucgggccaca

SEQ ID NO: 22161 - RNA, 20 nt, Artificial Sequence
  Synthetic
ccugacccugggggggcaca

SEQ ID NO: 22162 - RNA, 20 nt, Artificial Sequence
  Synthetic
acgagugcgacuggggcaca

SEQ ID NO: 22163 - RNA, 20 nt, Artificial Sequence
  Synthetic
cuuguucacguaaggcgaca

SEQ ID NO: 22164 - RNA, 20 nt, Artificial Sequence
  Synthetic
cuccgggugggugggcgaca

SEQ ID NO: 22165 - RNA, 20 nt, Artificial Sequence
  Synthetic
cugccugcccauccuggaca

SEQ ID NO: 22166 - RNA, 20 nt, Artificial Sequence
  Synthetic
ggggggcgggucuguugaca

SEQ ID NO: 22167 - RNA, 20 nt, Artificial Sequence
  Synthetic
cacccacccggagcccacca

SEQ ID NO: 22168 - RNA, 20 nt, Artificial Sequence
  Synthetic
gggaacaugcuguucgacca

SEQ ID NO: 22169 - RNA, 20 nt, Artificial Sequence
  Synthetic
gcccccugcuccccggacca

SEQ ID NO: 22170 - RNA, 20 nt, Artificial Sequence
  Synthetic
ccucaccgugugccccccca

SEQ ID NO: 22171 - RNA, 20 nt, Artificial Sequence
  Synthetic
gucgaacagcauguucccca

SEQ ID NO: 22172 - RNA, 20 nt, Artificial Sequence
  Synthetic
uuccucuugucucccuccca

SEQ ID NO: 22173 - RNA, 20 nt, Artificial Sequence
  Synthetic
uugguucgcggccugagcca

SEQ ID NO: 22174 - RNA, 20 nt, Artificial Sequence
  Synthetic
gggccgggggggcgcggcca

SEQ ID NO: 22175 - RNA, 20 nt, Artificial Sequence
  Synthetic
cgcucgcacgcacggggcca

SEQ ID NO: 22176 - RNA, 20 nt, Artificial Sequence
  Synthetic
gcccguccagauaaagucca

SEQ ID NO: 22177 - RNA, 20 nt, Artificial Sequence
  Synthetic
ccgcaggcugcggaagucca

SEQ ID NO: 22178 - RNA, 20 nt, Artificial Sequence
  Synthetic
cacccgugguccggggagca

SEQ ID NO: 22179 - RNA, 20 nt, Artificial Sequence
  Synthetic
acccgcggucucggggagca

SEQ ID NO: 22180 - RNA, 20 nt, Artificial Sequence
  Synthetic
ggaggcggcgcucgcacgca

SEQ ID NO: 22181 - RNA, 20 nt, Artificial Sequence
  Synthetic
gaacgacccccagacccgca

SEQ ID NO: 22182 - RNA, 20 nt, Artificial Sequence
  Synthetic
gucccccccucgcgccggca

SEQ ID NO: 22183 - RNA, 20 nt, Artificial Sequence
  Synthetic
ggaggccgucagggcgggca

SEQ ID NO: 22184 - RNA, 20 nt, Artificial Sequence
  Synthetic
ccgggcguggagggugggca

SEQ ID NO: 22185 - RNA, 20 nt, Artificial Sequence
  Synthetic
gcggggggcggagccuggca

SEQ ID NO: 22186 - RNA, 20 nt, Artificial Sequence
  Synthetic
uggggucucuguuguuugca

SEQ ID NO: 22187 - RNA, 20 nt, Artificial Sequence
  Synthetic
uuacgugaacaagacuauca

SEQ ID NO: 22188 - RNA, 20 nt, Artificial Sequence
  Synthetic
cgcacccccccuccgacuca

SEQ ID NO: 22189 - RNA, 20 nt, Artificial Sequence
  Synthetic
ggaggccgccgaggacguca

SEQ ID NO: 22190 - RNA, 20 nt, Artificial Sequence
  Synthetic
gugagacgccccgcccguca

SEQ ID NO: 22191 - RNA, 20 nt, Artificial Sequence
  Synthetic
ggaggccgaggaggccguca

SEQ ID NO: 22192 - RNA, 20 nt, Artificial Sequence
  Synthetic
cgcgccggcaggggccaaga

SEQ ID NO: 22193 - RNA, 20 nt, Artificial Sequence
  Synthetic
cgugguccugguggaccaga

SEQ ID NO: 22194 - RNA, 20 nt, Artificial Sequence
  Synthetic
cacgcuagagacccccgaga

SEQ ID NO: 22195 - RNA, 20 nt, Artificial Sequence
  Synthetic
gcccauccuggacauggaga

SEQ ID NO: 22196 - RNA, 20 nt, Artificial Sequence
  Synthetic
ggggcgucgacccgggacga

SEQ ID NO: 22197 - RNA, 20 nt, Artificial Sequence
  Synthetic
ucucccucccagggcaccga

SEQ ID NO: 22198 - RNA, 20 nt, Artificial Sequence
  Synthetic
gaugccccccgaguacccga

SEQ ID NO: 22199 - RNA, 20 nt, Artificial Sequence
  Synthetic
acugcugccguguggcccga

SEQ ID NO: 22200 - RNA, 20 nt, Artificial Sequence
  Synthetic
uguggcccgaugggcgccga

SEQ ID NO: 22201 - RNA, 20 nt, Artificial Sequence
  Synthetic
agcggaggcggggcggccga

SEQ ID NO: 22202 - RNA, 20 nt, Artificial Sequence
  Synthetic
agaagcagcgcgggggccga

SEQ ID NO: 22203 - RNA, 20 nt, Artificial Sequence
  Synthetic
cuuggccccugccggcgcga

SEQ ID NO: 22204 - RNA, 20 nt, Artificial Sequence
  Synthetic
ucugugccgggcgcgugcga

SEQ ID NO: 22205 - RNA, 20 nt, Artificial Sequence
  Synthetic
ccccgucuccauguccagga

SEQ ID NO: 22206 - RNA, 20 nt, Artificial Sequence
  Synthetic
ccaaccccaacccccccgga

SEQ ID NO: 22207 - RNA, 20 nt, Artificial Sequence
  Synthetic
gggagcggggcggcgccgga

SEQ ID NO: 22208 - RNA, 20 nt, Artificial Sequence
  Synthetic
ggggcggccgaggggccgga

SEQ ID NO: 22209 - RNA, 20 nt, Artificial Sequence
  Synthetic
ugcucgacagaggcggcgga

SEQ ID NO: 22210 - RNA, 20 nt, Artificial Sequence
  Synthetic
ccccccggcccugagucgga

SEQ ID NO: 22211 - RNA, 20 nt, Artificial Sequence
  Synthetic
gagggggcggcgccgcggga

SEQ ID NO: 22212 - RNA, 20 nt, Artificial Sequence
  Synthetic
ggggucguucacgaucggga

SEQ ID NO: 22213 - RNA, 20 nt, Artificial Sequence
  Synthetic
cgugaggccgcccgcgggga

SEQ ID NO: 22214 - RNA, 20 nt, Artificial Sequence
  Synthetic
ggacgcguggacugggggga

SEQ ID NO: 22215 - RNA, 20 nt, Artificial Sequence
  Synthetic
gggccgucggugcccuggga

SEQ ID NO: 22216 - RNA, 20 nt, Artificial Sequence
  Synthetic
ggccguggacuuuaucugga

SEQ ID NO: 22217 - RNA, 20 nt, Artificial Sequence
  Synthetic
ucgggggggccgggcgugga

SEQ ID NO: 22218 - RNA, 20 nt, Artificial Sequence
  Synthetic
cacggccgugcccgcccuga

SEQ ID NO: 22219 - RNA, 20 nt, Artificial Sequence
  Synthetic
cgccgccgcgccccccguga

SEQ ID NO: 22220 - RNA, 20 nt, Artificial Sequence
  Synthetic
ccugggggggcacacgguga

SEQ ID NO: 22221 - RNA, 20 nt, Artificial Sequence
  Synthetic
gaaguccagggcgcccacua

SEQ ID NO: 22222 - RNA, 20 nt, Artificial Sequence
  Synthetic
gggggagucgcugaucacua

SEQ ID NO: 22223 - RNA, 20 nt, Artificial Sequence
  Synthetic
gugauagucuuguucacgua

SEQ ID NO: 22224 - RNA, 20 nt, Artificial Sequence
  Synthetic
cccccugcuccccggaccac

SEQ ID NO: 22225 - RNA, 20 nt, Artificial Sequence
  Synthetic
cccccccggccucuccccac

SEQ ID NO: 22226 - RNA, 20 nt, Artificial Sequence
  Synthetic
ucgaacagcauguuccccac

SEQ ID NO: 22227 - RNA, 20 nt, Artificial Sequence
  Synthetic
gaggcggcgcucgcacgcac

SEQ ID NO: 22228 - RNA, 20 nt, Artificial Sequence
  Synthetic
cgggcguggagggugggcac

SEQ ID NO: 22229 - RNA, 20 nt, Artificial Sequence
  Synthetic
uacgugaacaagacuaucac

SEQ ID NO: 22230 - RNA, 20 nt, Artificial Sequence
  Synthetic
ugagacgccccgcccgucac

SEQ ID NO: 22231 - RNA, 20 nt, Artificial Sequence
  Synthetic
gugguccugguggaccagac

SEQ ID NO: 22232 - RNA, 20 nt, Artificial Sequence
  Synthetic
cccauccuggacauggagac

SEQ ID NO: 22233 - RNA, 20 nt, Artificial Sequence
  Synthetic
gcggcgccgcggcucgcgac

SEQ ID NO: 22234 - RNA, 20 nt, Artificial Sequence
  Synthetic
ucuuguucacguaaggcgac

SEQ ID NO: 22235 - RNA, 20 nt, Artificial Sequence
  Synthetic
gcuccgggugggugggcgac

SEQ ID NO: 22236 - RNA, 20 nt, Artificial Sequence
  Synthetic
gagccagggacgagugcgac

SEQ ID NO: 22237 - RNA, 20 nt, Artificial Sequence
  Synthetic
gggcggccgaggggccggac

SEQ ID NO: 22238 - RNA, 20 nt, Artificial Sequence
  Synthetic
gccguggacuuuaucuggac

SEQ ID NO: 22239 - RNA, 20 nt, Artificial Sequence
  Synthetic
cgagggggggacgcguggac

SEQ ID NO: 22240 - RNA, 20 nt, Artificial Sequence
  Synthetic
gccgccgcgccccccgugac

SEQ ID NO: 22241 - RNA, 20 nt, Artificial Sequence
  Synthetic
ggcccugucgcccacccacc

SEQ ID NO: 22242 - RNA, 20 nt, Artificial Sequence
  Synthetic
uguuucccgucugguccacc

SEQ ID NO: 22243 - RNA, 20 nt, Artificial Sequence
  Synthetic
ggacgaggaugacgacgacc

SEQ ID NO: 22244 - RNA, 20 nt, Artificial Sequence
  Synthetic
agacgggaaacauggcgacc

SEQ ID NO: 22245 - RNA, 20 nt, Artificial Sequence
  Synthetic
gggagcagggggcgucgacc

SEQ ID NO: 22246 - RNA, 20 nt, Artificial Sequence
  Synthetic
ggggaacaugcuguucgacc

SEQ ID NO: 22247 - RNA, 20 nt, Artificial Sequence
  Synthetic
ggggggucccgggcccaccc

SEQ ID NO: 22248 - RNA, 20 nt, Artificial Sequence
  Synthetic
ggagcagggggcgucgaccc

SEQ ID NO: 22249 - RNA, 20 nt, Artificial Sequence
  Synthetic
cgccccgcgguaccugaccc

SEQ ID NO: 22250 - RNA, 20 nt, Artificial Sequence
  Synthetic
aaccccaaccccaacccccc

SEQ ID NO: 22251 - RNA, 20 nt, Artificial Sequence
  Synthetic
cccucaccgugugccccccc

SEQ ID NO: 22252 - RNA, 20 nt, Artificial Sequence
  Synthetic
ccacccuggccgcgcccccc

SEQ ID NO: 22253 - RNA, 20 nt, Artificial Sequence
  Synthetic
agugaucagcgacucccccc

SEQ ID NO: 22254 - RNA, 20 nt, Artificial Sequence
  Synthetic
gcccccgcgccccggccccc

SEQ ID NO: 22255 - RNA, 20 nt, Artificial Sequence
  Synthetic
caggcuccgccccccgcccc

SEQ ID NO: 22256 - RNA, 20 nt, Artificial Sequence
  Synthetic
cgggcggccggcuccgcccc

SEQ ID NO: 22257 - RNA, 20 nt, Artificial Sequence
  Synthetic
ggcccccgcgccccggcccc

SEQ ID NO: 22258 - RNA, 20 nt, Artificial Sequence
  Synthetic
ccaggcuccgccccccgccc

SEQ ID NO: 22259 - RNA, 20 nt, Artificial Sequence
  Synthetic
gcgggcggccggcuccgccc

SEQ ID NO: 22260 - RNA, 20 nt, Artificial Sequence
  Synthetic
ggggcccggcccccgcgccc

SEQ ID NO: 22261 - RNA, 20 nt, Artificial Sequence
  Synthetic
gggcacccuagugggcgccc

SEQ ID NO: 22262 - RNA, 20 nt, Artificial Sequence
  Synthetic
gccgcccgcggggacggccc

SEQ ID NO: 22263 - RNA, 20 nt, Artificial Sequence
  Synthetic
agcggaggaggacgcggccc

SEQ ID NO: 22264 - RNA, 20 nt, Artificial Sequence
  Synthetic
ggggcgcgggggccgggccc

SEQ ID NO: 22265 - RNA, 20 nt, Artificial Sequence
  Synthetic
gccgcggacgcggggggccc

SEQ ID NO: 22266 - RNA, 20 nt, Artificial Sequence
  Synthetic
ggcgcggccagggugggccc

SEQ ID NO: 22267 - RNA, 20 nt, Artificial Sequence
  Synthetic
gggcggggccgucggugccc

SEQ ID NO: 22268 - RNA, 20 nt, Artificial Sequence
  Synthetic
gggcgcccacuagggugccc

SEQ ID NO: 22269 - RNA, 20 nt, Artificial Sequence
  Synthetic
uuuccucuugucucccuccc

SEQ ID NO: 22270 - RNA, 20 nt, Artificial Sequence
  Synthetic
ggucgacgcccccugcuccc

SEQ ID NO: 22271 - RNA, 20 nt, Artificial Sequence
  Synthetic
gccccagucgcacucguccc

SEQ ID NO: 22272 - RNA, 20 nt, Artificial Sequence
  Synthetic
uuauuguuuucccucguccc

SEQ ID NO: 22273 - RNA, 20 nt, Artificial Sequence
  Synthetic
cggcugcgggccgcgguccc

SEQ ID NO: 22274 - RNA, 20 nt, Artificial Sequence
  Synthetic
gaggacgucagggggguccc

SEQ ID NO: 22275 - RNA, 20 nt, Artificial Sequence
  Synthetic
agggugcggcggcuccagcc

SEQ ID NO: 22276 - RNA, 20 nt, Artificial Sequence
  Synthetic
ggggaccgcggcccgcagcc

SEQ ID NO: 22277 - RNA, 20 nt, Artificial Sequence
  Synthetic
ccggggcggggggcggagcc

SEQ ID NO: 22278 - RNA, 20 nt, Artificial Sequence
  Synthetic
cuugguucgcggccugagcc

SEQ ID NO: 22279 - RNA, 20 nt, Artificial Sequence
  Synthetic
ccgugcccacccuccacgcc

SEQ ID NO: 22280 - RNA, 20 nt, Artificial Sequence
  Synthetic
gggccgccucuuccgccgcc

SEQ ID NO: 22281 - RNA, 20 nt, Artificial Sequence
  Synthetic
gcgccaccgucgcacgcgcc

SEQ ID NO: 22282 - RNA, 20 nt, Artificial Sequence
  Synthetic
ggggccuguggggagaggcc

SEQ ID NO: 22283 - RNA, 20 nt, Artificial Sequence
  Synthetic
agggccgggggggcgcggcc

SEQ ID NO: 22284 - RNA, 20 nt, Artificial Sequence
  Synthetic
ccccccuccgacucagggcc

SEQ ID NO: 22285 - RNA, 20 nt, Artificial Sequence
  Synthetic
gaagaggcgcgggucgggcc

SEQ ID NO: 22286 - RNA, 20 nt, Artificial Sequence
  Synthetic
cgagcgccgccuccggggcc

SEQ ID NO: 22287 - RNA, 20 nt, Artificial Sequence
  Synthetic
ccggcuccgccccgggggcc

SEQ ID NO: 22288 - RNA, 20 nt, Artificial Sequence
  Synthetic
ggggccggggcgcgggggcc

SEQ ID NO: 22289 - RNA, 20 nt, Artificial Sequence
  Synthetic
ggccgcggacgcggggggcc

SEQ ID NO: 22290 - RNA, 20 nt, Artificial Sequence
  Synthetic
gcgcgcggcucgggggggcc

SEQ ID NO: 22291 - RNA, 20 nt, Artificial Sequence
  Synthetic
gggcgcggccagggugggcc

SEQ ID NO: 22292 - RNA, 20 nt, Artificial Sequence
  Synthetic
ccccccgcggcgcccaugcc

SEQ ID NO: 22293 - RNA, 20 nt, Artificial Sequence
  Synthetic
ccaagaacagagucugugcc

SEQ ID NO: 22294 - RNA, 20 nt, Artificial Sequence
  Synthetic
gggggccgaggaagugugcc

SEQ ID NO: 22295 - RNA, 20 nt, Artificial Sequence
  Synthetic
gggggacugccugcccaucc

SEQ ID NO: 22296 - RNA, 20 nt, Artificial Sequence
  Synthetic
ggggggcgucuggccccucc

SEQ ID NO: 22297 - RNA, 20 nt, Artificial Sequence
  Synthetic
ugcgugcgagcgccgccucc

SEQ ID NO: 22298 - RNA, 20 nt, Artificial Sequence
  Synthetic
ccucguccguggugggcucc

SEQ ID NO: 22299 - RNA, 20 nt, Artificial Sequence
  Synthetic
accgcaggcugcggaagucc

SEQ ID NO: 22300 - RNA, 20 nt, Artificial Sequence
  Synthetic
cgaggacgucaggggggucc

SEQ ID NO: 22301 - RNA, 20 nt, Artificial Sequence
  Synthetic
caucggggcguacguggucc

SEQ ID NO: 22302 - RNA, 20 nt, Artificial Sequence
  Synthetic
ggucucggcacccguggucc

SEQ ID NO: 22303 - RNA, 20 nt, Artificial Sequence
  Synthetic
uguuccccgucuccaugucc

SEQ ID NO: 22304 - RNA, 20 nt, Artificial Sequence
  Synthetic
cgcgccacgcggagacuucc

SEQ ID NO: 22305 - RNA, 20 nt, Artificial Sequence
  Synthetic
cuccgcguggcgcgucuucc

SEQ ID NO: 22306 - RNA, 20 nt, Artificial Sequence
  Synthetic
acuggggggagggguuuucc

SEQ ID NO: 22307 - RNA, 20 nt, Artificial Sequence
  Synthetic
gucucacgcagccccccagc

SEQ ID NO: 22308 - RNA, 20 nt, Artificial Sequence
  Synthetic
cagggugcggcggcuccagc

SEQ ID NO: 22309 - RNA, 20 nt, Artificial Sequence
  Synthetic
cggggaccgcggcccgcagc

SEQ ID NO: 22310 - RNA, 20 nt, Artificial Sequence
  Synthetic
cuccgccgccucugucgagc

SEQ ID NO: 22311 - RNA, 20 nt, Artificial Sequence
  Synthetic
cccggcccccggggcggagc

SEQ ID NO: 22312 - RNA, 20 nt, Artificial Sequence
  Synthetic
cagaggcggcggaggggagc

SEQ ID NO: 22313 - RNA, 20 nt, Artificial Sequence
  Synthetic
gcacccgugguccggggagc

SEQ ID NO: 22314 - RNA, 20 nt, Artificial Sequence
  Synthetic
uacccgcggucucggggagc

SEQ ID NO: 22315 - RNA, 20 nt, Artificial Sequence
  Synthetic
aggcuguuccacuccgacgc

SEQ ID NO: 22316 - RNA, 20 nt, Artificial Sequence
  Synthetic
cccgacgcggccgcggacgc

SEQ ID NO: 22317 - RNA, 20 nt, Artificial Sequence
  Synthetic
acccugcuccccgagaccgc

SEQ ID NO: 22318 - RNA, 20 nt, Artificial Sequence
  Synthetic
accacgggugccgagaccgc

SEQ ID NO: 22319 - RNA, 20 nt, Artificial Sequence
  Synthetic
cccccagggucagguaccgc

SEQ ID NO: 22320 - RNA, 20 nt, Artificial Sequence
  Synthetic
gauggugcugaacgacccgc

SEQ ID NO: 22321 - RNA, 20 nt, Artificial Sequence
  Synthetic
uccucggccccgacccccgc

SEQ ID NO: 22322 - RNA, 20 nt, Artificial Sequence
  Synthetic
acguaccgcccgccccccgc

SEQ ID NO: 22323 - RNA, 20 nt, Artificial Sequence
  Synthetic
gcggaagaggcggcccccgc

SEQ ID NO: 22324 - RNA, 20 nt, Artificial Sequence
  Synthetic
acuuccggggccguccccgc

SEQ ID NO: 22325 - RNA, 20 nt, Artificial Sequence
  Synthetic
uagcgcgugaggccgcccgc

SEQ ID NO: 22326 - RNA, 20 nt, Artificial Sequence
  Synthetic
ggggccgccucuuccgccgc

SEQ ID NO: 22327 - RNA, 20 nt, Artificial Sequence
  Synthetic
gucgcgagccgcggcgccgc

SEQ ID NO: 22328 - RNA, 20 nt, Artificial Sequence
  Synthetic
gccggagggggcggcgccgc

SEQ ID NO: 22329 - RNA, 20 nt, Artificial Sequence
  Synthetic
gagccuggcaugggcgccgc

SEQ ID NO: 22330 - RNA, 20 nt, Artificial Sequence
  Synthetic
ccgcgcugcuucugggccgc

SEQ ID NO: 22331 - RNA, 20 nt, Artificial Sequence
  Synthetic
ggcacacggcgcgcguccgc

SEQ ID NO: 22332 - RNA, 20 nt, Artificial Sequence
  Synthetic
ccgcggcccagaagcagcgc

SEQ ID NO: 22333 - RNA, 20 nt, Artificial Sequence
  Synthetic
gcacggggccacggccgcgc

SEQ ID NO: 22334 - RNA, 20 nt, Artificial Sequence
  Synthetic
acggccgcgcgggggcgcgc

SEQ ID NO: 22335 - RNA, 20 nt, Artificial Sequence
  Synthetic
cacgcgucccccccucgcgc

SEQ ID NO: 22336 - RNA, 20 nt, Artificial Sequence
  Synthetic
ugcguccgaggaagaggcgc

SEQ ID NO: 22337 - RNA, 20 nt, Artificial Sequence
  Synthetic
ggaggggagcggggcggcgc

SEQ ID NO: 22338 - RNA, 20 nt, Artificial Sequence
  Synthetic
cgccccgggggccggggcgc

SEQ ID NO: 22339 - RNA, 20 nt, Artificial Sequence
  Synthetic
gccucugcgugggggggcgc

SEQ ID NO: 22340 - RNA, 20 nt, Artificial Sequence
  Synthetic
gggggccuguggggagaggc

SEQ ID NO: 22341 - RNA, 20 nt, Artificial Sequence
  Synthetic
gggguuguugaagcggaggc

SEQ ID NO: 22342 - RNA, 20 nt, Artificial Sequence
  Synthetic
ugcgggccgcgguccccggc

SEQ ID NO: 22343 - RNA, 20 nt, Artificial Sequence
  Synthetic
cgucccccccucgcgccggc

SEQ ID NO: 22344 - RNA, 20 nt, Artificial Sequence
  Synthetic
cuguccgagccgcggccggc

SEQ ID NO: 22345 - RNA, 20 nt, Artificial Sequence
  Synthetic
gggggcgcggggcguccggc

SEQ ID NO: 22346 - RNA, 20 nt, Artificial Sequence
  Synthetic
ggcgcuguccgagccgcggc

SEQ ID NO: 22347 - RNA, 20 nt, Artificial Sequence
  Synthetic
gcguccgcggggcgggcggc

SEQ ID NO: 22348 - RNA, 20 nt, Artificial Sequence
  Synthetic
cccccccuccgacucagggc

SEQ ID NO: 22349 - RNA, 20 nt, Artificial Sequence
  Synthetic
gccgaggaggccgucagggc

SEQ ID NO: 22350 - RNA, 20 nt, Artificial Sequence
  Synthetic
ccgcgccccccgugacgggc

SEQ ID NO: 22351 - RNA, 20 nt, Artificial Sequence
  Synthetic
ccgcuuccgccuccucgggc

SEQ ID NO: 22352 - RNA, 20 nt, Artificial Sequence
  Synthetic
aggcggggcggccgaggggc

SEQ ID NO: 22353 - RNA, 20 nt, Artificial Sequence
  Synthetic
ggacgcggggggcccggggc

SEQ ID NO: 22354 - RNA, 20 nt, Artificial Sequence
  Synthetic
acggcgcgcguccgcggggc

SEQ ID NO: 22355 - RNA, 20 nt, Artificial Sequence
  Synthetic
gccggcuccgccccgggggc

SEQ ID NO: 22356 - RNA, 20 nt, Artificial Sequence
  Synthetic
gggggccggggcgcgggggc

SEQ ID NO: 22357 - RNA, 20 nt, Artificial Sequence
  Synthetic
cuguuguuugcaaggggggc

SEQ ID NO: 22358 - RNA, 20 nt, Artificial Sequence
  Synthetic
cggggcguccggcggggggc

SEQ ID NO: 22359 - RNA, 20 nt, Artificial Sequence
  Synthetic
ggcgcgcggcucgggggggc

SEQ ID NO: 22360 - RNA, 20 nt, Artificial Sequence
  Synthetic
uagagacccccgagaugggc

SEQ ID NO: 22361 - RNA, 20 nt, Artificial Sequence
  Synthetic
ucuccauguccaggaugggc

SEQ ID NO: 22362 - RNA, 20 nt, Artificial Sequence
  Synthetic
cgccgcggcucgcgacuggc

SEQ ID NO: 22363 - RNA, 20 nt, Artificial Sequence
  Synthetic
ggccuccucggccuccaugc

SEQ ID NO: 22364 - RNA, 20 nt, Artificial Sequence
  Synthetic
gccgcccucuuggccccugc

SEQ ID NO: 22365 - RNA, 20 nt, Artificial Sequence
  Synthetic
aaacauggcgacccggcugc

SEQ ID NO: 22366 - RNA, 20 nt, Artificial Sequence
  Synthetic
accaagaacagagucugugc

SEQ ID NO: 22367 - RNA, 20 nt, Artificial Sequence
  Synthetic
acauggagacggggaacauc

SEQ ID NO: 22368 - RNA, 20 nt, Artificial Sequence
  Synthetic
cgccccccucggcgcccauc

SEQ ID NO: 22369 - RNA, 20 nt, Artificial Sequence
  Synthetic
ucugggggucguucacgauc

SEQ ID NO: 22370 - RNA, 20 nt, Artificial Sequence
  Synthetic
gcacggccguggacuuuauc

SEQ ID NO: 22371 - RNA, 20 nt, Artificial Sequence
  Synthetic
acgcacccccccuccgacuc

SEQ ID NO: 22372 - RNA, 20 nt, Artificial Sequence
  Synthetic
gcgggggccgucggguacuc

SEQ ID NO: 22373 - RNA, 20 nt, Artificial Sequence
  Synthetic
ucccgcggcgccgcccccuc

SEQ ID NO: 22374 - RNA, 20 nt, Artificial Sequence
  Synthetic
cggggggcgucuggccccuc

SEQ ID NO: 22375 - RNA, 20 nt, Artificial Sequence
  Synthetic
cgucggaguggaacagccuc

SEQ ID NO: 22376 - RNA, 20 nt, Artificial Sequence
  Synthetic
gugcgugcgagcgccgccuc

SEQ ID NO: 22377 - RNA, 20 nt, Artificial Sequence
  Synthetic
uccuccgcuuccgccuccuc

SEQ ID NO: 22378 - RNA, 20 nt, Artificial Sequence
  Synthetic
gcgacgguggcgcgcggcuc

SEQ ID NO: 22379 - RNA, 20 nt, Artificial Sequence
  Synthetic
uccucguccguggugggcuc

SEQ ID NO: 22380 - RNA, 20 nt, Artificial Sequence
  Synthetic
gucgcacucgucccuggcuc

SEQ ID NO: 22381 - RNA, 20 nt, Artificial Sequence
  Synthetic
acgcgcuaccugcccaucuc

SEQ ID NO: 22382 - RNA, 20 nt, Artificial Sequence
  Synthetic
acgugguuacccgcggucuc

SEQ ID NO: 22383 - RNA, 20 nt, Artificial Sequence
  Synthetic
cggaggccgccgaggacguc

SEQ ID NO: 22384 - RNA, 20 nt, Artificial Sequence
  Synthetic
uguugacaagggggcccguc

SEQ ID NO: 22385 - RNA, 20 nt, Artificial Sequence
  Synthetic
gggucgccauguuucccguc

SEQ ID NO: 22386 - RNA, 20 nt, Artificial Sequence
  Synthetic
uggaggccgaggaggccguc

SEQ ID NO: 22387 - RNA, 20 nt, Artificial Sequence
  Synthetic
acuccgacgcgggggccguc

SEQ ID NO: 22388 - RNA, 20 nt, Artificial Sequence
  Synthetic
cccgcguccgcggccgcguc

SEQ ID NO: 22389 - RNA, 20 nt, Artificial Sequence
  Synthetic
gugggggggcgcggggcguc

SEQ ID NO: 22390 - RNA, 20 nt, Artificial Sequence
  Synthetic
gcggcgccgcggggggcguc

SEQ ID NO: 22391 - RNA, 20 nt, Artificial Sequence
  Synthetic
ccgugugcccccccaggguc

SEQ ID NO: 22392 - RNA, 20 nt, Artificial Sequence
  Synthetic
ccgaggaagaggcgcggguc

SEQ ID NO: 22393 - RNA, 20 nt, Artificial Sequence
  Synthetic
ccucggccuccaugcggguc

SEQ ID NO: 22394 - RNA, 20 nt, Artificial Sequence
  Synthetic
aggcggcccccgcggggguc

SEQ ID NO: 22395 - RNA, 20 nt, Artificial Sequence
  Synthetic
cggucucggcacccgugguc

SEQ ID NO: 22396 - RNA, 20 nt, Artificial Sequence
  Synthetic
acgcgccacgcggagacuuc

SEQ ID NO: 22397 - RNA, 20 nt, Artificial Sequence
  Synthetic
cucggcccccgcgcugcuuc

SEQ ID NO: 22398 - RNA, 20 nt, Artificial Sequence
  Synthetic
ucuccgcguggcgcgucuuc

SEQ ID NO: 22399 - RNA, 20 nt, Artificial Sequence
  Synthetic
ugcccugggagggagacaag

SEQ ID NO: 22400 - RNA, 20 nt, Artificial Sequence
  Synthetic
ggggcgggucuguugacaag

SEQ ID NO: 22401 - RNA, 20 nt, Artificial Sequence
  Synthetic
ucgcgccggcaggggccaag

SEQ ID NO: 22402 - RNA, 20 nt, Artificial Sequence
  Synthetic
gggucucuguuguuugcaag

SEQ ID NO: 22403 - RNA, 20 nt, Artificial Sequence
  Synthetic
cggcggugcguccgaggaag

SEQ ID NO: 22404 - RNA, 20 nt, Artificial Sequence
  Synthetic
ggaagaggcagaggaggaag

SEQ ID NO: 22405 - RNA, 20 nt, Artificial Sequence
  Synthetic
ggucggggccgaggaggaag

SEQ ID NO: 22406 - RNA, 20 nt, Artificial Sequence
  Synthetic
cccgcccgaggaggcggaag

SEQ ID NO: 22407 - RNA, 20 nt, Artificial Sequence
  Synthetic
cgcggccccggcggcggaag

SEQ ID NO: 22408 - RNA, 20 nt, Artificial Sequence
  Synthetic
ugggguugggguuguugaag

SEQ ID NO: 22409 - RNA, 20 nt, Artificial Sequence
  Synthetic
cgccgccuccugcucgacag

SEQ ID NO: 22410 - RNA, 20 nt, Artificial Sequence
  Synthetic
uccccacgggggucauccag

SEQ ID NO: 22411 - RNA, 20 nt, Artificial Sequence
  Synthetic
aacaccaccaccaacagcag

SEQ ID NO: 22412 - RNA, 20 nt, Artificial Sequence
  Synthetic
acccgugguccggggagcag

SEQ ID NO: 22413 - RNA, 20 nt, Artificial Sequence
  Synthetic
ccccgcgcccccccacgcag

SEQ ID NO: 22414 - RNA, 20 nt, Artificial Sequence
  Synthetic
ggccgaggaggaagaggcag

SEQ ID NO: 22415 - RNA, 20 nt, Artificial Sequence
  Synthetic
ucccccccucgcgccggcag

SEQ ID NO: 22416 - RNA, 20 nt, Artificial Sequence
  Synthetic
uuaucuggacgggcaaucag

SEQ ID NO: 22417 - RNA, 20 nt, Artificial Sequence
  Synthetic
gaggccgccgaggacgucag

SEQ ID NO: 22418 - RNA, 20 nt, Artificial Sequence
  Synthetic
guggcccgaugggcgccgag

SEQ ID NO: 22419 - RNA, 20 nt, Artificial Sequence
  Synthetic
gcggaggcggggcggccgag

SEQ ID NO: 22420 - RNA, 20 nt, Artificial Sequence
  Synthetic
uuggccccugccggcgcgag

SEQ ID NO: 22421 - RNA, 20 nt, Artificial Sequence
  Synthetic
caaccccaacccccccggag

SEQ ID NO: 22422 - RNA, 20 nt, Artificial Sequence
  Synthetic
ggagcggggcggcgccggag

SEQ ID NO: 22423 - RNA, 20 nt, Artificial Sequence
  Synthetic
gcucgacagaggcggcggag

SEQ ID NO: 22424 - RNA, 20 nt, Artificial Sequence
  Synthetic
cccccggcccugagucggag

SEQ ID NO: 22425 - RNA, 20 nt, Artificial Sequence
  Synthetic
cgacggcccccgcgucggag

SEQ ID NO: 22426 - RNA, 20 nt, Artificial Sequence
  Synthetic
acagaggcggcggaggggag

SEQ ID NO: 22427 - RNA, 20 nt, Artificial Sequence
  Synthetic
gacgcguggacuggggggag

SEQ ID NO: 22428 - RNA, 20 nt, Artificial Sequence
  Synthetic
cgcggggggccuguggggag

SEQ ID NO: 22429 - RNA, 20 nt, Artificial Sequence
  Synthetic
guucgaccagggcacccuag

SEQ ID NO: 22430 - RNA, 20 nt, Artificial Sequence
  Synthetic
cgaacagcauguuccccacg

SEQ ID NO: 22431 - RNA, 20 nt, Artificial Sequence
  Synthetic
ugcccggaagacgcgccacg

SEQ ID NO: 22432 - RNA, 20 nt, Artificial Sequence
  Synthetic
aggcggcgcucgcacgcacg

SEQ ID NO: 22433 - RNA, 20 nt, Artificial Sequence
  Synthetic
gguacucggggggcaucacg

SEQ ID NO: 22434 - RNA, 20 nt, Artificial Sequence
  Synthetic
acgugaacaagacuaucacg

SEQ ID NO: 22435 - RNA, 20 nt, Artificial Sequence
  Synthetic
gagacgccccgcccgucacg

SEQ ID NO: 22436 - RNA, 20 nt, Artificial Sequence
  Synthetic
ccauccuggacauggagacg

SEQ ID NO: 22437 - RNA, 20 nt, Artificial Sequence
  Synthetic
ggggcgcgcgggucccgacg

SEQ ID NO: 22438 - RNA, 20 nt, Artificial Sequence
  Synthetic
gaggcuguuccacuccgacg

SEQ ID NO: 22439 - RNA, 20 nt, Artificial Sequence
  Synthetic
ggcggaagcggaggaggacg

SEQ ID NO: 22440 - RNA, 20 nt, Artificial Sequence
  Synthetic
cccggagcccaccacggacg

SEQ ID NO: 22441 - RNA, 20 nt, Artificial Sequence
  Synthetic
ucccgacgcggccgcggacg

SEQ ID NO: 22442 - RNA, 20 nt, Artificial Sequence
  Synthetic
gggggcgucgacccgggacg

SEQ ID NO: 22443 - RNA, 20 nt, Artificial Sequence
  Synthetic
ggggaacaucggggcguacg

SEQ ID NO: 22444 - RNA, 20 nt, Artificial Sequence
  Synthetic
cacccugcuccccgagaccg

SEQ ID NO: 22445 - RNA, 20 nt, Artificial Sequence
  Synthetic
gcggcuccagccggggaccg

SEQ ID NO: 22446 - RNA, 20 nt, Artificial Sequence
  Synthetic
ccccccagggucagguaccg

SEQ ID NO: 22447 - RNA, 20 nt, Artificial Sequence
  Synthetic
gccugcggucucggcacccg

SEQ ID NO: 22448 - RNA, 20 nt, Artificial Sequence
  Synthetic
gggcaucacgugguuacccg

SEQ ID NO: 22449 - RNA, 20 nt, Artificial Sequence
  Synthetic
cuccucggccccgacccccg

SEQ ID NO: 22450 - RNA, 20 nt, Artificial Sequence
  Synthetic
cagccucuggaugacccccg

SEQ ID NO: 22451 - RNA, 20 nt, Artificial Sequence
  Synthetic
gaggggccagacgccccccg

SEQ ID NO: 22452 - RNA, 20 nt, Artificial Sequence
  Synthetic
cucuccccacaggccccccg

SEQ ID NO: 22453 - RNA, 20 nt, Artificial Sequence
  Synthetic
cccccgcgccccggcccccg

SEQ ID NO: 22454 - RNA, 20 nt, Artificial Sequence
  Synthetic
ggcggaagaggcggcccccg

SEQ ID NO: 22455 - RNA, 20 nt, Artificial Sequence
  Synthetic
gcacacuuccucggcccccg

SEQ ID NO: 22456 - RNA, 20 nt, Artificial Sequence
  Synthetic
ggagccggccgcccgccccg

SEQ ID NO: 22457 - RNA, 20 nt, Artificial Sequence
  Synthetic
gggcggccggcuccgccccg

SEQ ID NO: 22458 - RNA, 20 nt, Artificial Sequence
  Synthetic
gcaaucagcgguucgccccg

SEQ ID NO: 22459 - RNA, 20 nt, Artificial Sequence
  Synthetic
gacuuccggggccguccccg

SEQ ID NO: 22460 - RNA, 20 nt, Artificial Sequence
  Synthetic
ggcaccgacggccccgcccg

SEQ ID NO: 22461 - RNA, 20 nt, Artificial Sequence
  Synthetic
guagcgcgugaggccgcccg

SEQ ID NO: 22462 - RNA, 20 nt, Artificial Sequence
  Synthetic
ccgcggacgcggggggcccg

SEQ ID NO: 22463 - RNA, 20 nt, Artificial Sequence
  Synthetic
ggugggcacgggcccucccg

SEQ ID NO: 22464 - RNA, 20 nt, Artificial Sequence
  Synthetic
gggugcggcggcuccagccg

SEQ ID NO: 22465 - RNA, 20 nt, Artificial Sequence
  Synthetic
ggggggcgcuguccgagccg

SEQ ID NO: 22466 - RNA, 20 nt, Artificial Sequence
  Synthetic
cucccgccagucgcgagccg

SEQ ID NO: 22467 - RNA, 20 nt, Artificial Sequence
  Synthetic
ggccgccucuuccgccgccg

SEQ ID NO: 22468 - RNA, 20 nt, Artificial Sequence
  Synthetic
ggaagaggcggaggccgccg

SEQ ID NO: 22469 - RNA, 20 nt, Artificial Sequence
  Synthetic
agacgccccccgcggcgccg

SEQ ID NO: 22470 - RNA, 20 nt, Artificial Sequence
  Synthetic
agucgcgagccgcggcgccg

SEQ ID NO: 22471 - RNA, 20 nt, Artificial Sequence
  Synthetic
cgccggagggggcggcgccg

SEQ ID NO: 22472 - RNA, 20 nt, Artificial Sequence
  Synthetic
ggagccuggcaugggcgccg

SEQ ID NO: 22473 - RNA, 20 nt, Artificial Sequence
  Synthetic
guguggcccgaugggcgccg

SEQ ID NO: 22474 - RNA, 20 nt, Artificial Sequence
  Synthetic
gggccuguggggagaggccg

SEQ ID NO: 22475 - RNA, 20 nt, Artificial Sequence
  Synthetic
ccagacccgcauggaggccg

SEQ ID NO: 22476 - RNA, 20 nt, Artificial Sequence
  Synthetic
cgucagggcgggcacggccg

SEQ ID NO: 22477 - RNA, 20 nt, Artificial Sequence
  Synthetic
cgcagccccccagccggccg

SEQ ID NO: 22478 - RNA, 20 nt, Artificial Sequence
  Synthetic
cgcgggucccgacgcggccg

SEQ ID NO: 22479 - RNA, 20 nt, Artificial Sequence
  Synthetic
cgcgcgcccccgcgcggccg

SEQ ID NO: 22480 - RNA, 20 nt, Artificial Sequence
  Synthetic
aagcggaggcggggcggccg

SEQ ID NO: 22481 - RNA, 20 nt, Artificial Sequence
  Synthetic
cccccuccgacucagggccg

SEQ ID NO: 22482 - RNA, 20 nt, Artificial Sequence
  Synthetic
ggcgacccggcugcgggccg

SEQ ID NO: 22483 - RNA, 20 nt, Artificial Sequence
  Synthetic
ccccgcgggggucggggccg

SEQ ID NO: 22484 - RNA, 20 nt, Artificial Sequence
  Synthetic
cggcuccgccccgggggccg

SEQ ID NO: 22485 - RNA, 20 nt, Artificial Sequence
  Synthetic
cuucugggccgcgggggccg

SEQ ID NO: 22486 - RNA, 20 nt, Artificial Sequence
  Synthetic
cagaagcagcgcgggggccg

SEQ ID NO: 22487 - RNA, 20 nt, Artificial Sequence
  Synthetic
cccgcgcugcuucugggccg

SEQ ID NO: 22488 - RNA, 20 nt, Artificial Sequence
  Synthetic
gggggcgucuggccccuccg

SEQ ID NO: 22489 - RNA, 20 nt, Artificial Sequence
  Synthetic
gcgugcgagcgccgccuccg

SEQ ID NO: 22490 - RNA, 20 nt, Artificial Sequence
  Synthetic
ccccgggccccccgcguccg

SEQ ID NO: 22491 - RNA, 20 nt, Artificial Sequence
  Synthetic
gggcacacggcgcgcguccg

SEQ ID NO: 22492 - RNA, 20 nt, Artificial Sequence
  Synthetic
aggaggcggcggugcguccg

SEQ ID NO: 22493 - RNA, 20 nt, Artificial Sequence
  Synthetic
gucgucgucauccucguccg

SEQ ID NO: 22494 - RNA, 20 nt, Artificial Sequence
  Synthetic
gucucggcacccgugguccg

SEQ ID NO: 22495 - RNA, 20 nt, Artificial Sequence
  Synthetic
gcgccacgcggagacuuccg

SEQ ID NO: 22496 - RNA, 20 nt, Artificial Sequence
  Synthetic
cccgcggcccagaagcagcg

SEQ ID NO: 22497 - RNA, 20 nt, Artificial Sequence
  Synthetic
agaggcggcggaggggagcg

SEQ ID NO: 22498 - RNA, 20 nt, Artificial Sequence
  Synthetic
caucucgggggucucuagcg

SEQ ID NO: 22499 - RNA, 20 nt, Artificial Sequence
  Synthetic
ggcuguuccacuccgacgcg

SEQ ID NO: 22500 - RNA, 20 nt, Artificial Sequence
  Synthetic
ccgacgcggccgcggacgcg

SEQ ID NO: 22501 - RNA, 20 nt, Artificial Sequence
  Synthetic
cggcgcgagggggggacgcg

SEQ ID NO: 22502 - RNA, 20 nt, Artificial Sequence
  Synthetic
ccccagggucagguaccgcg

SEQ ID NO: 22503 - RNA, 20 nt, Artificial Sequence
  Synthetic
ccucggccccgacccccgcg

SEQ ID NO: 22504 - RNA, 20 nt, Artificial Sequence
  Synthetic
gggacccgcgcgcccccgcg

SEQ ID NO: 22505 - RNA, 20 nt, Artificial Sequence
  Synthetic
cggaagaggcggcccccgcg

SEQ ID NO: 22506 - RNA, 20 nt, Artificial Sequence
  Synthetic
agcgcgugaggccgcccgcg

SEQ ID NO: 22507 - RNA, 20 nt, Artificial Sequence
  Synthetic
ucgcgagccgcggcgccgcg

SEQ ID NO: 22508 - RNA, 20 nt, Artificial Sequence
  Synthetic
agccuggcaugggcgccgcg

SEQ ID NO: 22509 - RNA, 20 nt, Artificial Sequence
  Synthetic
cgcacggggccacggccgcg

SEQ ID NO: 22510 - RNA, 20 nt, Artificial Sequence
  Synthetic
cgcgcugcuucugggccgcg

SEQ ID NO: 22511 - RNA, 20 nt, Artificial Sequence
  Synthetic
cggccccggaagucuccgcg

SEQ ID NO: 22512 - RNA, 20 nt, Artificial Sequence
  Synthetic
gcacacggcgcgcguccgcg

SEQ ID NO: 22513 - RNA, 20 nt, Artificial Sequence
  Synthetic
cgcggcccagaagcagcgcg

SEQ ID NO: 22514 - RNA, 20 nt, Artificial Sequence
  Synthetic
cacggggccacggccgcgcg

SEQ ID NO: 22515 - RNA, 20 nt, Artificial Sequence
  Synthetic
ucuuggccccugccggcgcg

SEQ ID NO: 22516 - RNA, 20 nt, Artificial Sequence
  Synthetic
gccccgggggccggggcgcg

SEQ ID NO: 22517 - RNA, 20 nt, Artificial Sequence
  Synthetic
cacggccgcgcgggggcgcg

SEQ ID NO: 22518 - RNA, 20 nt, Artificial Sequence
  Synthetic
ccucugcgugggggggcgcg

SEQ ID NO: 22519 - RNA, 20 nt, Artificial Sequence
  Synthetic
gcgcgugcgacgguggcgcg

SEQ ID NO: 22520 - RNA, 20 nt, Artificial Sequence
  Synthetic
gugcguccgaggaagaggcg

SEQ ID NO: 22521 - RNA, 20 nt, Artificial Sequence
  Synthetic
ggguuguugaagcggaggcg

SEQ ID NO: 22522 - RNA, 20 nt, Artificial Sequence
  Synthetic
ggggcgcggggcguccggcg

SEQ ID NO: 22523 - RNA, 20 nt, Artificial Sequence
  Synthetic
cgcgccccccgugacgggcg

SEQ ID NO: 22524 - RNA, 20 nt, Artificial Sequence
  Synthetic
cggcucgggggggccgggcg

SEQ ID NO: 22525 - RNA, 20 nt, Artificial Sequence
  Synthetic
cgcuuccgccuccucgggcg

SEQ ID NO: 22526 - RNA, 20 nt, Artificial Sequence
  Synthetic
gacgcggggggcccggggcg

SEQ ID NO: 22527 - RNA, 20 nt, Artificial Sequence
  Synthetic
ccgccccgggggccggggcg

SEQ ID NO: 22528 - RNA, 20 nt, Artificial Sequence
  Synthetic
cccgcccgucacggggggcg

SEQ ID NO: 22529 - RNA, 20 nt, Artificial Sequence
  Synthetic
gacucagggccgggggggcg

SEQ ID NO: 22530 - RNA, 20 nt, Artificial Sequence
  Synthetic
cgccucugcgugggggggcg

SEQ ID NO: 22531 - RNA, 20 nt, Artificial Sequence
  Synthetic
ggcgcggcggcgccucugcg

SEQ ID NO: 22532 - RNA, 20 nt, Artificial Sequence
  Synthetic
cauggagacggggaacaucg

SEQ ID NO: 22533 - RNA, 20 nt, Artificial Sequence
  Synthetic
cgggggccgucggguacucg

SEQ ID NO: 22534 - RNA, 20 nt, Artificial Sequence
  Synthetic
cgacgguggcgcgcggcucg

SEQ ID NO: 22535 - RNA, 20 nt, Artificial Sequence
  Synthetic
cgcgcuaccugcccaucucg

SEQ ID NO: 22536 - RNA, 20 nt, Artificial Sequence
  Synthetic
cgugguuacccgcggucucg

SEQ ID NO: 22537 - RNA, 20 nt, Artificial Sequence
  Synthetic
ggcggcccccgcgggggucg

SEQ ID NO: 22538 - RNA, 20 nt, Artificial Sequence
  Synthetic
cagacucuguucuugguucg

SEQ ID NO: 22539 - RNA, 20 nt, Artificial Sequence
  Synthetic
gggcgggucuguugacaagg

SEQ ID NO: 22540 - RNA, 20 nt, Artificial Sequence
  Synthetic
ggucucuguuguuugcaagg

SEQ ID NO: 22541 - RNA, 20 nt, Artificial Sequence
  Synthetic
cgccgccucugucgagcagg

SEQ ID NO: 22542 - RNA, 20 nt, Artificial Sequence
  Synthetic
cccgugguccggggagcagg

SEQ ID NO: 22543 - RNA, 20 nt, Artificial Sequence
  Synthetic
aggccgccgaggacgucagg

SEQ ID NO: 22544 - RNA, 20 nt, Artificial Sequence
  Synthetic
agaggcagaggaggaagagg

SEQ ID NO: 22545 - RNA, 20 nt, Artificial Sequence
  Synthetic
ggccccggcggcggaagagg

SEQ ID NO: 22546 - RNA, 20 nt, Artificial Sequence
  Synthetic
cgccuccugcucgacagagg

SEQ ID NO: 22547 - RNA, 20 nt, Artificial Sequence
  Synthetic
cgaggaggaagaggcagagg

SEQ ID NO: 22548 - RNA, 20 nt, Artificial Sequence
  Synthetic
accgacggccccgcccgagg

SEQ ID NO: 22549 - RNA, 20 nt, Artificial Sequence
  Synthetic
uggcccgaugggcgccgagg

SEQ ID NO: 22550 - RNA, 20 nt, Artificial Sequence
  Synthetic
gacccgcauggaggccgagg

SEQ ID NO: 22551 - RNA, 20 nt, Artificial Sequence
  Synthetic
cgcgggggucggggccgagg

SEQ ID NO: 22552 - RNA, 20 nt, Artificial Sequence
  Synthetic
uggccccugccggcgcgagg

SEQ ID NO: 22553 - RNA, 20 nt, Artificial Sequence
  Synthetic
cgccucugucgagcaggagg

SEQ ID NO: 22554 - RNA, 20 nt, Artificial Sequence
  Synthetic
gacggccccgcccgaggagg

SEQ ID NO: 22555 - RNA, 20 nt, Artificial Sequence
  Synthetic
cgggggccgggccccggagg

SEQ ID NO: 22556 - RNA, 20 nt, Artificial Sequence
  Synthetic
gagcggggcggcgccggagg

SEQ ID NO: 22557 - RNA, 20 nt, Artificial Sequence
  Synthetic
cgaggaggcggaagcggagg

SEQ ID NO: 22558 - RNA, 20 nt, Artificial Sequence
  Synthetic
ugggguuguugaagcggagg

SEQ ID NO: 22559 - RNA, 20 nt, Artificial Sequence
  Synthetic
ccccggcccugagucggagg

SEQ ID NO: 22560 - RNA, 20 nt, Artificial Sequence
  Synthetic
gaacagcauguuccccacgg

SEQ ID NO: 22561 - RNA, 20 nt, Artificial Sequence
  Synthetic
cgugaacaagacuaucacgg

SEQ ID NO: 22562 - RNA, 20 nt, Artificial Sequence
  Synthetic
agacgccccgcccgucacgg

SEQ ID NO: 22563 - RNA, 20 nt, Artificial Sequence
  Synthetic
gugccgggcgcgugcgacgg

SEQ ID NO: 22564 - RNA, 20 nt, Artificial Sequence
  Synthetic
cccaaccccaacccccccgg

SEQ ID NO: 22565 - RNA, 20 nt, Artificial Sequence
  Synthetic
ggcggccggcuccgccccgg

SEQ ID NO: 22566 - RNA, 20 nt, Artificial Sequence
  Synthetic
ggaggaggacgcggccccgg

SEQ ID NO: 22567 - RNA, 20 nt, Artificial Sequence
  Synthetic
gcgcgggggccgggccccgg

SEQ ID NO: 22568 - RNA, 20 nt, Artificial Sequence
  Synthetic
ggggagcggggcggcgccgg

SEQ ID NO: 22569 - RNA, 20 nt, Artificial Sequence
  Synthetic
ggccuguggggagaggccgg

SEQ ID NO: 22570 - RNA, 20 nt, Artificial Sequence
  Synthetic
ccccuccgacucagggccgg

SEQ ID NO: 22571 - RNA, 20 nt, Artificial Sequence
  Synthetic
ggggcgucuggccccuccgg

SEQ ID NO: 22572 - RNA, 20 nt, Artificial Sequence
  Synthetic
ggggggcgcggggcguccgg

SEQ ID NO: 22573 - RNA, 20 nt, Artificial Sequence
  Synthetic
gcccgaggaggcggaagcgg

SEQ ID NO: 22574 - RNA, 20 nt, Artificial Sequence
  Synthetic
gguugggguuguugaagcgg

SEQ ID NO: 22575 - RNA, 20 nt, Artificial Sequence
  Synthetic
accaccaccaacagcagcgg

SEQ ID NO: 22576 - RNA, 20 nt, Artificial Sequence
  Synthetic
gcuguuccacuccgacgcgg

SEQ ID NO: 22577 - RNA, 20 nt, Artificial Sequence
  Synthetic
cgacgcggccgcggacgcgg

SEQ ID NO: 22578 - RNA, 20 nt, Artificial Sequence
  Synthetic
cucggccccgacccccgcgg

SEQ ID NO: 22579 - RNA, 20 nt, Artificial Sequence
  Synthetic
ggaagaggcggcccccgcgg

SEQ ID NO: 22580 - RNA, 20 nt, Artificial Sequence
  Synthetic
cgcgagccgcggcgccgcgg

SEQ ID NO: 22581 - RNA, 20 nt, Artificial Sequence
  Synthetic
gccuggcaugggcgccgcgg

SEQ ID NO: 22582 - RNA, 20 nt, Artificial Sequence
  Synthetic
gcgcugcuucugggccgcgg

SEQ ID NO: 22583 - RNA, 20 nt, Artificial Sequence
  Synthetic
gcggcccagaagcagcgcgg

SEQ ID NO: 22584 - RNA, 20 nt, Artificial Sequence
  Synthetic
acggggccacggccgcgcgg

SEQ ID NO: 22585 - RNA, 20 nt, Artificial Sequence
  Synthetic
ccccgggggccggggcgcgg

SEQ ID NO: 22586 - RNA, 20 nt, Artificial Sequence
  Synthetic
gcccgucacggggggcgcgg

SEQ ID NO: 22587 - RNA, 20 nt, Artificial Sequence
  Synthetic
ggcagaggaggaagaggcgg

SEQ ID NO: 22588 - RNA, 20 nt, Artificial Sequence
  Synthetic
cuccugcucgacagaggcgg

SEQ ID NO: 22589 - RNA, 20 nt, Artificial Sequence
  Synthetic
cucugucgagcaggaggcgg

SEQ ID NO: 22590 - RNA, 20 nt, Artificial Sequence
  Synthetic
ggaggacgcggccccggcgg

SEQ ID NO: 22591 - RNA, 20 nt, Artificial Sequence
  Synthetic
gggcgcggggcguccggcgg

SEQ ID NO: 22592 - RNA, 20 nt, Artificial Sequence
  Synthetic
accaccaacagcagcggcgg

SEQ ID NO: 22593 - RNA, 20 nt, Artificial Sequence
  Synthetic
cugcucgacagaggcggcgg

SEQ ID NO: 22594 - RNA, 20 nt, Artificial Sequence
  Synthetic
accaacagcagcggcggcgg

SEQ ID NO: 22595 - RNA, 20 nt, Artificial Sequence
  Synthetic
acgcggggggcccggggcgg

SEQ ID NO: 22596 - RNA, 20 nt, Artificial Sequence
  Synthetic
ucucggggagcagggugcgg

SEQ ID NO: 22597 - RNA, 20 nt, Artificial Sequence
  Synthetic
gggggccgucggguacucgg

SEQ ID NO: 22598 - RNA, 20 nt, Artificial Sequence
  Synthetic
gaccccccugacguccucgg

SEQ ID NO: 22599 - RNA, 20 nt, Artificial Sequence
  Synthetic
gacgguggcgcgcggcucgg

SEQ ID NO: 22600 - RNA, 20 nt, Artificial Sequence
  Synthetic
gcgcuaccugcccaucucgg

SEQ ID NO: 22601 - RNA, 20 nt, Artificial Sequence
  Synthetic
cccccccggcccugagucgg

SEQ ID NO: 22602 - RNA, 20 nt, Artificial Sequence
  Synthetic
gucucuguuguuugcaaggg

SEQ ID NO: 22603 - RNA, 20 nt, Artificial Sequence
  Synthetic
ccgggggggcgcggccaggg

SEQ ID NO: 22604 - RNA, 20 nt, Artificial Sequence
  Synthetic
ggccgccgaggacgucaggg

SEQ ID NO: 22605 - RNA, 20 nt, Artificial Sequence
  Synthetic
ggccgaggaggccgucaggg

SEQ ID NO: 22606 - RNA, 20 nt, Artificial Sequence
  Synthetic
gccggcaggggccaagaggg

SEQ ID NO: 22607 - RNA, 20 nt, Artificial Sequence
  Synthetic
ggcccgaugggcgccgaggg

SEQ ID NO: 22608 - RNA, 20 nt, Artificial Sequence
  Synthetic
agcagcgcgggggccgaggg

SEQ ID NO: 22609 - RNA, 20 nt, Artificial Sequence
  Synthetic
ggccccugccggcgcgaggg

SEQ ID NO: 22610 - RNA, 20 nt, Artificial Sequence
  Synthetic
cccggcccugagucggaggg

SEQ ID NO: 22611 - RNA, 20 nt, Artificial Sequence
  Synthetic
ggggggccgggcguggaggg

SEQ ID NO: 22612 - RNA, 20 nt, Artificial Sequence
  Synthetic
gacgccccgcccgucacggg

SEQ ID NO: 22613 - RNA, 20 nt, Artificial Sequence
  Synthetic
gccgcgccccccgugacggg

SEQ ID NO: 22614 - RNA, 20 nt, Artificial Sequence
  Synthetic
gccuguggggagaggccggg

SEQ ID NO: 22615 - RNA, 20 nt, Artificial Sequence
  Synthetic
cccuccgacucagggccggg

SEQ ID NO: 22616 - RNA, 20 nt, Artificial Sequence
  Synthetic
gggcgucuggccccuccggg

SEQ ID NO: 22617 - RNA, 20 nt, Artificial Sequence
  Synthetic
cguccguggugggcuccggg

SEQ ID NO: 22618 - RNA, 20 nt, Artificial Sequence
  Synthetic
gacgcggccgcggacgcggg

SEQ ID NO: 22619 - RNA, 20 nt, Artificial Sequence
  Synthetic
uccggggccguccccgcggg

SEQ ID NO: 22620 - RNA, 20 nt, Artificial Sequence
  Synthetic
gcgagccgcggcgccgcggg

SEQ ID NO: 22621 - RNA, 20 nt, Artificial Sequence
  Synthetic
ggagggggcggcgccgcggg

SEQ ID NO: 22622 - RNA, 20 nt, Artificial Sequence
  Synthetic
ccuggcaugggcgccgcggg

SEQ ID NO: 22623 - RNA, 20 nt, Artificial Sequence
  Synthetic
ggcgcggggcguccggcggg

SEQ ID NO: 22624 - RNA, 20 nt, Artificial Sequence
  Synthetic
cgcggggggcccggggcggg

SEQ ID NO: 22625 - RNA, 20 nt, Artificial Sequence
  Synthetic
gcgcgcguccgcggggcggg

SEQ ID NO: 22626 - RNA, 20 nt, Artificial Sequence
  Synthetic
ggcguccggcggggggcggg

SEQ ID NO: 22627 - RNA, 20 nt, Artificial Sequence
  Synthetic
ggggccgucggguacucggg

SEQ ID NO: 22628 - RNA, 20 nt, Artificial Sequence
  Synthetic
uccgcuuccgccuccucggg

SEQ ID NO: 22629 - RNA, 20 nt, Artificial Sequence
  Synthetic
acgguggcgcgcggcucggg

SEQ ID NO: 22630 - RNA, 20 nt, Artificial Sequence
  Synthetic
gccccugccggcgcgagggg

SEQ ID NO: 22631 - RNA, 20 nt, Artificial Sequence
  Synthetic
ccggcccugagucggagggg

SEQ ID NO: 22632 - RNA, 20 nt, Artificial Sequence
  Synthetic
ccgcgccccggcccccgggg

SEQ ID NO: 22633 - RNA, 20 nt, Artificial Sequence
  Synthetic
cggacgcggggggcccgggg

SEQ ID NO: 22634 - RNA, 20 nt, Artificial Sequence
  Synthetic
ccuguggggagaggccgggg

SEQ ID NO: 22635 - RNA, 20 nt, Artificial Sequence
  Synthetic
ccuccgacucagggccgggg

SEQ ID NO: 22636 - RNA, 20 nt, Artificial Sequence
  Synthetic
ggcgucuggccccuccgggg

SEQ ID NO: 22637 - RNA, 20 nt, Artificial Sequence
  Synthetic
ggcggcggaggggagcgggg

SEQ ID NO: 22638 - RNA, 20 nt, Artificial Sequence
  Synthetic
cacggcgcgcguccgcgggg

SEQ ID NO: 22639 - RNA, 20 nt, Artificial Sequence
  Synthetic
uuguugaagcggaggcgggg

SEQ ID NO: 22640 - RNA, 20 nt, Artificial Sequence
  Synthetic
cgguggcgcgcggcucgggg

SEQ ID NO: 22641 - RNA, 20 nt, Artificial Sequence
  Synthetic
cggggcggcgccggaggggg

SEQ ID NO: 22642 - RNA, 20 nt, Artificial Sequence
  Synthetic
ucuguuguuugcaagggggg

SEQ ID NO: 22643 - RNA, 20 nt, Artificial Sequence
  Synthetic
gcggggcguccggcgggggg

SEQ ID NO: 22644 - RNA, 20 nt, Artificial Sequence
  Synthetic
ggggggcccggggcgggggg

SEQ ID NO: 22645 - RNA, 20 nt, Artificial Sequence
  Synthetic
gggacgcguggacugggggg

SEQ ID NO: 22646 - RNA, 20 nt, Artificial Sequence
  Synthetic
cgcgguaccugacccugggg

SEQ ID NO: 22647 - RNA, 20 nt, Artificial Sequence
  Synthetic
ggcggcgccucugcgugggg

SEQ ID NO: 22648 - RNA, 20 nt, Artificial Sequence
  Synthetic
ggggggacgcguggacuggg

SEQ ID NO: 22649 - RNA, 20 nt, Artificial Sequence
  Synthetic
ccgcgguaccugacccuggg

SEQ ID NO: 22650 - RNA, 20 nt, Artificial Sequence
  Synthetic
ggggccgucggugcccuggg

SEQ ID NO: 22651 - RNA, 20 nt, Artificial Sequence
  Synthetic
ccgagccgcggccggcuggg

SEQ ID NO: 22652 - RNA, 20 nt, Artificial Sequence
  Synthetic
cggcggcgccucugcguggg

SEQ ID NO: 22653 - RNA, 20 nt, Artificial Sequence
  Synthetic
cguggugggcuccggguggg

SEQ ID NO: 22654 - RNA, 20 nt, Artificial Sequence
  Synthetic
cgacccccagacccgcaugg

SEQ ID NO: 22655 - RNA, 20 nt, Artificial Sequence
  Synthetic
gcgccgcggcucgcgacugg

SEQ ID NO: 22656 - RNA, 20 nt, Artificial Sequence
  Synthetic
gggggggacgcguggacugg

SEQ ID NO: 22657 - RNA, 20 nt, Artificial Sequence
  Synthetic
cccgcgguaccugacccugg

SEQ ID NO: 22658 - RNA, 20 nt, Artificial Sequence
  Synthetic
cggggcguacgugguccugg

SEQ ID NO: 22659 - RNA, 20 nt, Artificial Sequence
  Synthetic
uccgagccgcggccggcugg

SEQ ID NO: 22660 - RNA, 20 nt, Artificial Sequence
  Synthetic
cggccuccaugcgggucugg

SEQ ID NO: 22661 - RNA, 20 nt, Artificial Sequence
  Synthetic
gucgucauccucguccgugg

SEQ ID NO: 22662 - RNA, 20 nt, Artificial Sequence
  Synthetic
cucgggggggccgggcgugg

SEQ ID NO: 22663 - RNA, 20 nt, Artificial Sequence
  Synthetic
gcggcggcgccucugcgugg

SEQ ID NO: 22664 - RNA, 20 nt, Artificial Sequence
  Synthetic
gccgccgcugcuguuggugg

SEQ ID NO: 22665 - RNA, 20 nt, Artificial Sequence
  Synthetic
gccgccgccgcugcuguugg

SEQ ID NO: 22666 - RNA, 20 nt, Artificial Sequence
  Synthetic
cggccuccucggccuccaug

SEQ ID NO: 22667 - RNA, 20 nt, Artificial Sequence
  Synthetic
gggagucgcugaucacuaug

SEQ ID NO: 22668 - RNA, 20 nt, Artificial Sequence
  Synthetic
gccagggacgagugcgacug

SEQ ID NO: 22669 - RNA, 20 nt, Artificial Sequence
  Synthetic
agggggggacgcguggacug

SEQ ID NO: 22670 - RNA, 20 nt, Artificial Sequence
  Synthetic
ccccgcgguaccugacccug

SEQ ID NO: 22671 - RNA, 20 nt, Artificial Sequence
  Synthetic
cccuggacuuccgcagccug

SEQ ID NO: 22672 - RNA, 20 nt, Artificial Sequence
  Synthetic
ugggcgccgcggggggccug

SEQ ID NO: 22673 - RNA, 20 nt, Artificial Sequence
  Synthetic
ggugccgagaccgcaggcug

SEQ ID NO: 22674 - RNA, 20 nt, Artificial Sequence
  Synthetic
gaaacauggcgacccggcug

SEQ ID NO: 22675 - RNA, 20 nt, Artificial Sequence
  Synthetic
guccgagccgcggccggcug

SEQ ID NO: 22676 - RNA, 20 nt, Artificial Sequence
  Synthetic
ucggccuccaugcgggucug

SEQ ID NO: 22677 - RNA, 20 nt, Artificial Sequence
  Synthetic
gccucuggaugacccccgug

SEQ ID NO: 22678 - RNA, 20 nt, Artificial Sequence
  Synthetic
uugguguuacugcugccgug

SEQ ID NO: 22679 - RNA, 20 nt, Artificial Sequence
  Synthetic
agaugggcagguagcgcgug

SEQ ID NO: 22680 - RNA, 20 nt, Artificial Sequence
  Synthetic
cgcggcggcgccucugcgug

SEQ ID NO: 22681 - RNA, 20 nt, Artificial Sequence
  Synthetic
cccugggggggcacacggug

SEQ ID NO: 22682 - RNA, 20 nt, Artificial Sequence
  Synthetic
cggucucggggagcagggug

SEQ ID NO: 22683 - RNA, 20 nt, Artificial Sequence
  Synthetic
ggcgccgcggggggccugug

SEQ ID NO: 22684 - RNA, 20 nt, Artificial Sequence
  Synthetic
uggccccuccggggggguug

SEQ ID NO: 22685 - RNA, 20 nt, Artificial Sequence
  Synthetic
cuccggggggguugggguug

SEQ ID NO: 22686 - RNA, 20 nt, Artificial Sequence
  Synthetic
ggggguugggguugggguug

SEQ ID NO: 22687 - RNA, 20 nt, Artificial Sequence
  Synthetic
gacauggagacggggaacau

SEQ ID NO: 22688 - RNA, 20 nt, Artificial Sequence
  Synthetic
gcgccccccucggcgcccau

SEQ ID NO: 22689 - RNA, 20 nt, Artificial Sequence
  Synthetic
cggggggcggagccuggcau

SEQ ID NO: 22690 - RNA, 20 nt, Artificial Sequence
  Synthetic
acgcuagagacccccgagau

SEQ ID NO: 22691 - RNA, 20 nt, Artificial Sequence
  Synthetic
gucugggggucguucacgau

SEQ ID NO: 22692 - RNA, 20 nt, Artificial Sequence
  Synthetic
cugcugccguguggcccgau

SEQ ID NO: 22693 - RNA, 20 nt, Artificial Sequence
  Synthetic
cccgucuccauguccaggau

SEQ ID NO: 22694 - RNA, 20 nt, Artificial Sequence
  Synthetic
ggggagucgcugaucacuau

SEQ ID NO: 22695 - RNA, 20 nt, Artificial Sequence
  Synthetic
ggaaguccagggcgcccacu

SEQ ID NO: 22696 - RNA, 20 nt, Artificial Sequence
  Synthetic
agccagggacgagugcgacu

SEQ ID NO: 22697 - RNA, 20 nt, Artificial Sequence
  Synthetic
gagggggggacgcguggacu

SEQ ID NO: 22698 - RNA, 20 nt, Artificial Sequence
  Synthetic
cgcgggggccgucggguacu

SEQ ID NO: 22699 - RNA, 20 nt, Artificial Sequence
  Synthetic
gccccgcgguaccugacccu

SEQ ID NO: 22700 - RNA, 20 nt, Artificial Sequence
  Synthetic
ggcucggacagcgccccccu

SEQ ID NO: 22701 - RNA, 20 nt, Artificial Sequence
  Synthetic
agggggcccguccggccccu

SEQ ID NO: 22702 - RNA, 20 nt, Artificial Sequence
  Synthetic
ggcggggccgucggugcccu

SEQ ID NO: 22703 - RNA, 20 nt, Artificial Sequence
  Synthetic
agacaagaggaaaccucccu

SEQ ID NO: 22704 - RNA, 20 nt, Artificial Sequence
  Synthetic
cuccuccgcuuccgccuccu

SEQ ID NO: 22705 - RNA, 20 nt, Artificial Sequence
  Synthetic
gcccgcccugacggccuccu

SEQ ID NO: 22706 - RNA, 20 nt, Artificial Sequence
  Synthetic
cuccucugccucuuccuccu

SEQ ID NO: 22707 - RNA, 20 nt, Artificial Sequence
  Synthetic
cgggaccccccugacguccu

SEQ ID NO: 22708 - RNA, 20 nt, Artificial Sequence
  Synthetic
gucuuccgggcacacuuccu

SEQ ID NO: 22709 - RNA, 20 nt, Artificial Sequence
  Synthetic
cccgacccgcgccucuuccu

SEQ ID NO: 22710 - RNA, 20 nt, Artificial Sequence
  Synthetic
auggugcugaacgacccgcu

SEQ ID NO: 22711 - RNA, 20 nt, Artificial Sequence
  Synthetic
uguccgagccgcggccggcu

SEQ ID NO: 22712 - RNA, 20 nt, Artificial Sequence
  Synthetic
ccccccagccggccgcggcu

SEQ ID NO: 22713 - RNA, 20 nt, Artificial Sequence
  Synthetic
ugcgacgguggcgcgcggcu

SEQ ID NO: 22714 - RNA, 20 nt, Artificial Sequence
  Synthetic
cacgcgcuaccugcccaucu

SEQ ID NO: 22715 - RNA, 20 nt, Artificial Sequence
  Synthetic
ggggugcgucgccgcccucu

SEQ ID NO: 22716 - RNA, 20 nt, Artificial Sequence
  Synthetic
cacgugguuacccgcggucu

SEQ ID NO: 22717 - RNA, 20 nt, Artificial Sequence
  Synthetic
acuuccgcagccugcggucu

SEQ ID NO: 22718 - RNA, 20 nt, Artificial Sequence
  Synthetic
cucggccuccaugcgggucu

SEQ ID NO: 22719 - RNA, 20 nt, Artificial Sequence
  Synthetic
ucggcccccgcgcugcuucu

SEQ ID NO: 22720 - RNA, 20 nt, Artificial Sequence
  Synthetic
cccggcacagacucuguucu

SEQ ID NO: 22721 - RNA, 20 nt, Artificial Sequence
  Synthetic
gcgcccccccggcccugagu

SEQ ID NO: 22722 - RNA, 20 nt, Artificial Sequence
  Synthetic
uucgaccagggcacccuagu

SEQ ID NO: 22723 - RNA, 20 nt, Artificial Sequence
  Synthetic
agccucuggaugacccccgu

SEQ ID NO: 22724 - RNA, 20 nt, Artificial Sequence
  Synthetic
gccuccucgggcggggccgu

SEQ ID NO: 22725 - RNA, 20 nt, Artificial Sequence
  Synthetic
cacuccgacgcgggggccgu

SEQ ID NO: 22726 - RNA, 20 nt, Artificial Sequence
  Synthetic
guacccgacggcccccgcgu

SEQ ID NO: 22727 - RNA, 20 nt, Artificial Sequence
  Synthetic
ccccgcguccgcggccgcgu

SEQ ID NO: 22728 - RNA, 20 nt, Artificial Sequence
  Synthetic
gcgcggcggcgccucugcgu

SEQ ID NO: 22729 - RNA, 20 nt, Artificial Sequence
  Synthetic
cgggggggcgcggccagggu

SEQ ID NO: 22730 - RNA, 20 nt, Artificial Sequence
  Synthetic
gggggccgggcguggagggu

SEQ ID NO: 22731 - RNA, 20 nt, Artificial Sequence
  Synthetic
guccguggugggcuccgggu

SEQ ID NO: 22732 - RNA, 20 nt, Artificial Sequence
  Synthetic
uccgaggaagaggcgcgggu

SEQ ID NO: 22733 - RNA, 20 nt, Artificial Sequence
  Synthetic
gaggcggcccccgcgggggu

SEQ ID NO: 22734 - RNA, 20 nt, Artificial Sequence
  Synthetic
ucuggccccuccgggggggu

SEQ ID NO: 22735 - RNA, 20 nt, Artificial Sequence
  Synthetic
cccuccggggggguuggggu

SEQ ID NO: 22736 - RNA, 20 nt, Artificial Sequence
  Synthetic
ggggggguugggguuggggu

SEQ ID NO: 22737 - RNA, 20 nt, Artificial Sequence
  Synthetic
guggugggcuccgggugggu

SEQ ID NO: 22738 - RNA, 20 nt, Artificial Sequence
  Synthetic
ucgucauccucguccguggu

SEQ ID NO: 22739 - RNA, 20 nt, Artificial Sequence
  Synthetic
gggcgccgcggggggccugu

SEQ ID NO: 22740 - RNA, 20 nt, Artificial Sequence
  Synthetic
gccgccgccgccgcugcugu

SEQ ID NO: 22741 - RNA, 20 nt, Artificial Sequence
  Synthetic
gcugcuguuggugguggugu

SEQ ID NO: 22742 - RNA, 20 nt, Artificial Sequence
  Synthetic
cuggccccuccggggggguu

SEQ ID NO: 22743 - RNA, 20 nt, Artificial Sequence
  Synthetic
ccuccggggggguugggguu

SEQ ID NO: 22744 - RNA, 20 nt, Artificial Sequence
  Synthetic
gggggguugggguugggguu

SEQ ID NO: 22745 - RNA, 21 nt, Artificial Sequence
  Synthetic
ggggggcgcccccgcaacugc

SEQ ID NO: 22746 - RNA, 22 nt, Artificial Sequence
  Synthetic
gggggggcgcccccgcaacugc

SEQ ID NO: 22747 - RNA, 24 nt, Artificial Sequence
  Synthetic
gagggggggcgcccccgcaacugc

SEQ ID NO: 22748 - RNA, 19 nt, Artificial Sequence
  Synthetic
gugcuguccgccucggagg

SEQ ID NO: 22749 - RNA, 23 nt, Artificial Sequence
  Synthetic
guccgugcuguccgccucggagg

SEQ ID NO: 22750 - RNA, 19 nt, Artificial Sequence
  Synthetic
gcaucccgugcaugaaaac

SEQ ID NO: 22751 - RNA, 18 nt, Artificial Sequence
  Synthetic
gacgugugcgccgugugc

SEQ ID NO: 22752 - RNA, 20 nt, Artificial Sequence
  Synthetic
gcgacgugugcgccgugugc

SEQ ID NO: 22753 - RNA, 21 nt, Artificial Sequence
  Synthetic
ggcgacgugugcgccgugugc

SEQ ID NO: 22754 - RNA, 22 nt, Artificial Sequence
  Synthetic
gggcgacgugugcgccgugugc

SEQ ID NO: 22755 - RNA, 24 nt, Artificial Sequence
  Synthetic
gagggcgacgugugcgccgugugc

SEQ ID NO: 22756 - RNA, 23 nt, Artificial Sequence
  Synthetic
agggggggcgcccccgcaacugc

SEQ ID NO: 22757 - RNA, 18 nt, Artificial Sequence
  Synthetic
ugcuguccgccucggagg

SEQ ID NO: 22758 - RNA, 20 nt, Artificial Sequence
  Synthetic
cgugcuguccgccucggagg

SEQ ID NO: 22759 - RNA, 21 nt, Artificial Sequence
  Synthetic
ccgugcuguccgccucggagg

SEQ ID NO: 22760 - RNA, 22 nt, Artificial Sequence
  Synthetic
uccgugcuguccgccucggagg

SEQ ID NO: 22761 - RNA, 24 nt, Artificial Sequence
  Synthetic
uguccgugcuguccgccucggagg

SEQ ID NO: 22762 - RNA, 18 nt, Artificial Sequence
  Synthetic
caucccgugcaugaaaac

SEQ ID NO: 22763 - RNA, 20 nt, Artificial Sequence
  Synthetic
ugcaucccgugcaugaaaac

SEQ ID NO: 22764 - RNA, 21 nt, Artificial Sequence
  Synthetic
cugcaucccgugcaugaaaac

SEQ ID NO: 22765 - RNA, 22 nt, Artificial Sequence
  Synthetic
ucugcaucccgugcaugaaaac

SEQ ID NO: 22766 - RNA, 23 nt, Artificial Sequence
  Synthetic
uucugcaucccgugcaugaaaac

SEQ ID NO: 22767 - RNA, 24 nt, Artificial Sequence
  Synthetic
cuucugcaucccgugcaugaaaac

SEQ ID NO: 22768 - RNA, 19 nt, Artificial Sequence
  Synthetic
cgacgugugcgccgugugc

SEQ ID NO: 22769 - RNA, 23 nt, Artificial Sequence
  Synthetic
agggcgacgugugcgccgugugc

SEQ ID NO: 22770 - RNA, 18 nt, Artificial Sequence
  Synthetic
cauccagguuuucaugca

SEQ ID NO: 22771 - RNA, 19 nt, Artificial Sequence
  Synthetic
gcauccagguuuucaugca

SEQ ID NO: 22772 - RNA, 20 nt, Artificial Sequence
  Synthetic
ugcauccagguuuucaugca

SEQ ID NO: 22773 - RNA, 21 nt, Artificial Sequence
  Synthetic
uugcauccagguuuucaugca

SEQ ID NO: 22774 - RNA, 22 nt, Artificial Sequence
  Synthetic
auugcauccagguuuucaugca

SEQ ID NO: 22775 - RNA, 23 nt, Artificial Sequence
  Synthetic
aauugcauccagguuuucaugca

SEQ ID NO: 22776 - RNA, 24 nt, Artificial Sequence
  Synthetic
caauugcauccagguuuucaugca

SEQ ID NO: 22777 - RNA, 18 nt, Artificial Sequence
  Synthetic
gggcgcccccgcaacugc

SEQ ID NO: 22778 - RNA, 19 nt, Artificial Sequence
  Synthetic
ggggcgcccccgcaacugc

SEQ ID NO: 22779 - RNA, 20 nt, Artificial Sequence
  Synthetic
gggggcgcccccgcaacugc

SEQ ID NO: 22780 - RNA, 18 nt, Artificial Sequence
  Synthetic
ggggcggcccucaggccg

SEQ ID NO: 22781 - RNA, 19 nt, Artificial Sequence
  Synthetic
gggggcggcccucaggccg

SEQ ID NO: 22782 - RNA, 20 nt, Artificial Sequence
  Synthetic
ugggggcggcccucaggccg

SEQ ID NO: 22783 - RNA, 21 nt, Artificial Sequence
  Synthetic
cugggggcggcccucaggccg

SEQ ID NO: 22784 - RNA, 22 nt, Artificial Sequence
  Synthetic
gcugggggcggcccucaggccg

SEQ ID NO: 22785 - RNA, 23 nt, Artificial Sequence
  Synthetic
cgcugggggcggcccucaggccg

SEQ ID NO: 22786 - RNA, 24 nt, Artificial Sequence
  Synthetic
gcgcugggggcggcccucaggccg

SEQ ID NO: 22787 - RNA, 18 nt, Artificial Sequence
  Synthetic
ccacuucggucuccgccu

SEQ ID NO: 22788 - RNA, 19 nt, Artificial Sequence
  Synthetic
cccacuucggucuccgccu

SEQ ID NO: 22789 - RNA, 20 nt, Artificial Sequence
  Synthetic
ccccacuucggucuccgccu

SEQ ID NO: 22790 - RNA, 21 nt, Artificial Sequence
  Synthetic
cccccacuucggucuccgccu

SEQ ID NO: 22791 - RNA, 22 nt, Artificial Sequence
  Synthetic
ccccccacuucggucuccgccu

SEQ ID NO: 22792 - RNA, 23 nt, Artificial Sequence
  Synthetic
cccccccacuucggucuccgccu

SEQ ID NO: 22793 - RNA, 24 nt, Artificial Sequence
  Synthetic
gcccccccacuucggucuccgccu

SEQ ID NO: 22794 - RNA, 18 nt, Artificial Sequence
  Synthetic
cugcuggggccgcagggc

SEQ ID NO: 22795 - RNA, 19 nt, Artificial Sequence
  Synthetic
gcugcuggggccgcagggc

SEQ ID NO: 22796 - RNA, 20 nt, Artificial Sequence
  Synthetic
ggcugcuggggccgcagggc

SEQ ID NO: 22797 - RNA, 21 nt, Artificial Sequence
  Synthetic
gggcugcuggggccgcagggc

SEQ ID NO: 22798 - RNA, 22 nt, Artificial Sequence
  Synthetic
ggggcugcuggggccgcagggc

SEQ ID NO: 22799 - RNA, 23 nt, Artificial Sequence
  Synthetic
cggggcugcuggggccgcagggc

SEQ ID NO: 22800 - RNA, 24 nt, Artificial Sequence
  Synthetic
acggggcugcuggggccgcagggc

SEQ ID NO: 22801 - RNA, 18 nt, Artificial Sequence
  Synthetic
ccagcuuggcguugcaca

SEQ ID NO: 22802 - RNA, 19 nt, Artificial Sequence
  Synthetic
accagcuuggcguugcaca

SEQ ID NO: 22803 - RNA, 20 nt, Artificial Sequence
  Synthetic
caccagcuuggcguugcaca

SEQ ID NO: 22804 - RNA, 21 nt, Artificial Sequence
  Synthetic
acaccagcuuggcguugcaca

SEQ ID NO: 22805 - RNA, 22 nt, Artificial Sequence
  Synthetic
uacaccagcuuggcguugcaca

SEQ ID NO: 22806 - RNA, 23 nt, Artificial Sequence
  Synthetic
guacaccagcuuggcguugcaca

SEQ ID NO: 22807 - RNA, 24 nt, Artificial Sequence
  Synthetic
gguacaccagcuuggcguugcaca

SEQ ID NO: 22808 - RNA, 18 nt, Artificial Sequence
  Synthetic
cggcaggucucggucgca

SEQ ID NO: 22809 - RNA, 19 nt, Artificial Sequence
  Synthetic
ccggcaggucucggucgca

SEQ ID NO: 22810 - RNA, 20 nt, Artificial Sequence
  Synthetic
uccggcaggucucggucgca

SEQ ID NO: 22811 - RNA, 21 nt, Artificial Sequence
  Synthetic
guccggcaggucucggucgca

SEQ ID NO: 22812 - RNA, 22 nt, Artificial Sequence
  Synthetic
uguccggcaggucucggucgca

SEQ ID NO: 22813 - RNA, 23 nt, Artificial Sequence
  Synthetic
cuguccggcaggucucggucgca

SEQ ID NO: 22814 - RNA, 24 nt, Artificial Sequence
  Synthetic
gcuguccggcaggucucggucgca

SEQ ID NO: 22815 - RNA, 18 nt, Artificial Sequence
  Synthetic
gcagaagcggugcaugca

SEQ ID NO: 22816 - RNA, 19 nt, Artificial Sequence
  Synthetic
ugcagaagcggugcaugca

SEQ ID NO: 22817 - RNA, 20 nt, Artificial Sequence
  Synthetic
augcagaagcggugcaugca

SEQ ID NO: 22818 - RNA, 21 nt, Artificial Sequence
  Synthetic
gaugcagaagcggugcaugca

SEQ ID NO: 22819 - RNA, 22 nt, Artificial Sequence
  Synthetic
ggaugcagaagcggugcaugca

SEQ ID NO: 22820 - RNA, 23 nt, Artificial Sequence
  Synthetic
gggaugcagaagcggugcaugca

SEQ ID NO: 22821 - RNA, 24 nt, Artificial Sequence
  Synthetic
cgggaugcagaagcggugcaugca

SEQ ID NO: 22822 - RNA, 18 nt, Artificial Sequence
  Synthetic
cuccccccguccucucga

SEQ ID NO: 22823 - RNA, 19 nt, Artificial Sequence
  Synthetic
gcuccccccguccucucga

SEQ ID NO: 22824 - RNA, 20 nt, Artificial Sequence
  Synthetic
cgcuccccccguccucucga

SEQ ID NO: 22825 - RNA, 21 nt, Artificial Sequence
  Synthetic
ucgcuccccccguccucucga

SEQ ID NO: 22826 - RNA, 22 nt, Artificial Sequence
  Synthetic
gucgcuccccccguccucucga

SEQ ID NO: 22827 - RNA, 23 nt, Artificial Sequence
  Synthetic
cgucgcuccccccguccucucga

SEQ ID NO: 22828 - RNA, 24 nt, Artificial Sequence
  Synthetic
ucgucgcuccccccguccucucga

SEQ ID NO: 22829 - RNA, 18 nt, Artificial Sequence
  Synthetic
cagaagcggugcaugcac

SEQ ID NO: 22830 - RNA, 19 nt, Artificial Sequence
  Synthetic
gcagaagcggugcaugcac

SEQ ID NO: 22831 - RNA, 20 nt, Artificial Sequence
  Synthetic
ugcagaagcggugcaugcac

SEQ ID NO: 22832 - RNA, 21 nt, Artificial Sequence
  Synthetic
augcagaagcggugcaugcac

SEQ ID NO: 22833 - RNA, 22 nt, Artificial Sequence
  Synthetic
gaugcagaagcggugcaugcac

SEQ ID NO: 22834 - RNA, 23 nt, Artificial Sequence
  Synthetic
ggaugcagaagcggugcaugcac

SEQ ID NO: 22835 - RNA, 24 nt, Artificial Sequence
  Synthetic
gggaugcagaagcggugcaugcac

SEQ ID NO: 22836 - RNA, 18 nt, Artificial Sequence
  Synthetic
cgcggggggggcuccccc

SEQ ID NO: 22837 - RNA, 19 nt, Artificial Sequence
  Synthetic
ucgcggggggggcuccccc

SEQ ID NO: 22838 - RNA, 20 nt, Artificial Sequence
  Synthetic
cucgcggggggggcuccccc

SEQ ID NO: 22839 - RNA, 21 nt, Artificial Sequence
  Synthetic
ccucgcggggggggcuccccc

SEQ ID NO: 22840 - RNA, 22 nt, Artificial Sequence
  Synthetic
uccucgcggggggggcuccccc

SEQ ID NO: 22841 - RNA, 23 nt, Artificial Sequence
  Synthetic
uuccucgcggggggggcuccccc

SEQ ID NO: 22842 - RNA, 24 nt, Artificial Sequence
  Synthetic
cuuccucgcggggggggcuccccc

SEQ ID NO: 22843 - RNA, 18 nt, Artificial Sequence
  Synthetic
guguccgugcuguccgcc

SEQ ID NO: 22844 - RNA, 19 nt, Artificial Sequence
  Synthetic
cguguccgugcuguccgcc

SEQ ID NO: 22845 - RNA, 20 nt, Artificial Sequence
  Synthetic
ccguguccgugcuguccgcc

SEQ ID NO: 22846 - RNA, 21 nt, Artificial Sequence
  Synthetic
uccguguccgugcuguccgcc

SEQ ID NO: 22847 - RNA, 22 nt, Artificial Sequence
  Synthetic
uuccguguccgugcuguccgcc

SEQ ID NO: 22848 - RNA, 23 nt, Artificial Sequence
  Synthetic
guuccguguccgugcuguccgcc

SEQ ID NO: 22849 - RNA, 24 nt, Artificial Sequence
  Synthetic
aguuccguguccgugcuguccgcc

SEQ ID NO: 22850 - RNA, 18 nt, Artificial Sequence
  Synthetic
ugccggggucuuccucgc

SEQ ID NO: 22851 - RNA, 19 nt, Artificial Sequence
  Synthetic
cugccggggucuuccucgc

SEQ ID NO: 22852 - RNA, 20 nt, Artificial Sequence
  Synthetic
acugccggggucuuccucgc

SEQ ID NO: 22853 - RNA, 21 nt, Artificial Sequence
  Synthetic
aacugccggggucuuccucgc

SEQ ID NO: 22854 - RNA, 22 nt, Artificial Sequence
  Synthetic
caacugccggggucuuccucgc

SEQ ID NO: 22855 - RNA, 23 nt, Artificial Sequence
  Synthetic
gcaacugccggggucuuccucgc

SEQ ID NO: 22856 - RNA, 24 nt, Artificial Sequence
  Synthetic
cgcaacugccggggucuuccucgc

SEQ ID NO: 22857 - RNA, 18 nt, Artificial Sequence
  Synthetic
ccggcaggucucggucgc

SEQ ID NO: 22858 - RNA, 19 nt, Artificial Sequence
  Synthetic
uccggcaggucucggucgc

SEQ ID NO: 22859 - RNA, 20 nt, Artificial Sequence
  Synthetic
guccggcaggucucggucgc

SEQ ID NO: 22860 - RNA, 21 nt, Artificial Sequence
  Synthetic
uguccggcaggucucggucgc

SEQ ID NO: 22861 - RNA, 22 nt, Artificial Sequence
  Synthetic
cuguccggcaggucucggucgc

SEQ ID NO: 22862 - RNA, 23 nt, Artificial Sequence
  Synthetic
gcuguccggcaggucucggucgc

SEQ ID NO: 22863 - RNA, 24 nt, Artificial Sequence
  Synthetic
ugcuguccggcaggucucggucgc

SEQ ID NO: 22864 - RNA, 18 nt, Artificial Sequence
  Synthetic
ugcagaagcggugcaugc

SEQ ID NO: 22865 - RNA, 19 nt, Artificial Sequence
  Synthetic
augcagaagcggugcaugc

SEQ ID NO: 22866 - RNA, 20 nt, Artificial Sequence
  Synthetic
gaugcagaagcggugcaugc

SEQ ID NO: 22867 - RNA, 21 nt, Artificial Sequence
  Synthetic
ggaugcagaagcggugcaugc

SEQ ID NO: 22868 - RNA, 22 nt, Artificial Sequence
  Synthetic
gggaugcagaagcggugcaugc

SEQ ID NO: 22869 - RNA, 23 nt, Artificial Sequence
  Synthetic
cgggaugcagaagcggugcaugc

SEQ ID NO: 22870 - RNA, 24 nt, Artificial Sequence
  Synthetic
acgggaugcagaagcggugcaugc

SEQ ID NO: 22871 - RNA, 18 nt, Artificial Sequence
  Synthetic
gcauccagguuuucaugc

SEQ ID NO: 22872 - RNA, 19 nt, Artificial Sequence
  Synthetic
ugcauccagguuuucaugc

SEQ ID NO: 22873 - RNA, 20 nt, Artificial Sequence
  Synthetic
uugcauccagguuuucaugc

SEQ ID NO: 22874 - RNA, 21 nt, Artificial Sequence
  Synthetic
auugcauccagguuuucaugc

SEQ ID NO: 22875 - RNA, 22 nt, Artificial Sequence
  Synthetic
aauugcauccagguuuucaugc

SEQ ID NO: 22876 - RNA, 23 nt, Artificial Sequence
  Synthetic
caauugcauccagguuuucaugc

SEQ ID NO: 22877 - RNA, 24 nt, Artificial Sequence
  Synthetic
gcaauugcauccagguuuucaugc

SEQ ID NO: 22878 - RNA, 18 nt, Artificial Sequence
  Synthetic
gggaaacacccagacauc

SEQ ID NO: 22879 - RNA, 19 nt, Artificial Sequence
  Synthetic
agggaaacacccagacauc

SEQ ID NO: 22880 - RNA, 20 nt, Artificial Sequence
  Synthetic
cagggaaacacccagacauc

SEQ ID NO: 22881 - RNA, 21 nt, Artificial Sequence
  Synthetic
gcagggaaacacccagacauc

SEQ ID NO: 22882 - RNA, 22 nt, Artificial Sequence
  Synthetic
cgcagggaaacacccagacauc

SEQ ID NO: 22883 - RNA, 23 nt, Artificial Sequence
  Synthetic
ucgcagggaaacacccagacauc

SEQ ID NO: 22884 - RNA, 24 nt, Artificial Sequence
  Synthetic
gucgcagggaaacacccagacauc

SEQ ID NO: 22885 - RNA, 18 nt, Artificial Sequence
  Synthetic
gucgcuccccccguccuc

SEQ ID NO: 22886 - RNA, 19 nt, Artificial Sequence
  Synthetic
cgucgcuccccccguccuc

SEQ ID NO: 22887 - RNA, 20 nt, Artificial Sequence
  Synthetic
ucgucgcuccccccguccuc

SEQ ID NO: 22888 - RNA, 21 nt, Artificial Sequence
  Synthetic
cucgucgcuccccccguccuc

SEQ ID NO: 22889 - RNA, 22 nt, Artificial Sequence
  Synthetic
ccucgucgcuccccccguccuc

SEQ ID NO: 22890 - RNA, 23 nt, Artificial Sequence
  Synthetic
cccucgucgcuccccccguccuc

SEQ ID NO: 22891 - RNA, 24 nt, Artificial Sequence
  Synthetic
gcccucgucgcuccccccguccuc

SEQ ID NO: 22892 - RNA, 18 nt, Artificial Sequence
  Synthetic
acugccggggucuuccuc

SEQ ID NO: 22893 - RNA, 19 nt, Artificial Sequence
  Synthetic
aacugccggggucuuccuc

SEQ ID NO: 22894 - RNA, 20 nt, Artificial Sequence
  Synthetic
caacugccggggucuuccuc

SEQ ID NO: 22895 - RNA, 21 nt, Artificial Sequence
  Synthetic
gcaacugccggggucuuccuc

SEQ ID NO: 22896 - RNA, 22 nt, Artificial Sequence
  Synthetic
cgcaacugccggggucuuccuc

SEQ ID NO: 22897 - RNA, 23 nt, Artificial Sequence
  Synthetic
ccgcaacugccggggucuuccuc

SEQ ID NO: 22898 - RNA, 24 nt, Artificial Sequence
  Synthetic
cccgcaacugccggggucuuccuc

SEQ ID NO: 22899 - RNA, 18 nt, Artificial Sequence
  Synthetic
gccggcggguacucgcuc

SEQ ID NO: 22900 - RNA, 19 nt, Artificial Sequence
  Synthetic
ggccggcggguacucgcuc

SEQ ID NO: 22901 - RNA, 20 nt, Artificial Sequence
  Synthetic
aggccggcggguacucgcuc

SEQ ID NO: 22902 - RNA, 21 nt, Artificial Sequence
  Synthetic
caggccggcggguacucgcuc

SEQ ID NO: 22903 - RNA, 22 nt, Artificial Sequence
  Synthetic
ucaggccggcggguacucgcuc

SEQ ID NO: 22904 - RNA, 23 nt, Artificial Sequence
  Synthetic
cucaggccggcggguacucgcuc

SEQ ID NO: 22905 - RNA, 24 nt, Artificial Sequence
  Synthetic
ccucaggccggcggguacucgcuc

SEQ ID NO: 22906 - RNA, 18 nt, Artificial Sequence
  Synthetic
cgcuccccccguccucuc

SEQ ID NO: 22907 - RNA, 19 nt, Artificial Sequence
  Synthetic
ucgcuccccccguccucuc

SEQ ID NO: 22908 - RNA, 20 nt, Artificial Sequence
  Synthetic
gucgcuccccccguccucuc

SEQ ID NO: 22909 - RNA, 21 nt, Artificial Sequence
  Synthetic
cgucgcuccccccguccucuc

SEQ ID NO: 22910 - RNA, 22 nt, Artificial Sequence
  Synthetic
ucgucgcuccccccguccucuc

SEQ ID NO: 22911 - RNA, 23 nt, Artificial Sequence
  Synthetic
cucgucgcuccccccguccucuc

SEQ ID NO: 22912 - RNA, 24 nt, Artificial Sequence
  Synthetic
ccucgucgcuccccccguccucuc

SEQ ID NO: 22913 - RNA, 18 nt, Artificial Sequence
  Synthetic
ggccccagcagccccguc

SEQ ID NO: 22914 - RNA, 19 nt, Artificial Sequence
  Synthetic
cggccccagcagccccguc

SEQ ID NO: 22915 - RNA, 20 nt, Artificial Sequence
  Synthetic
gcggccccagcagccccguc

SEQ ID NO: 22916 - RNA, 21 nt, Artificial Sequence
  Synthetic
ugcggccccagcagccccguc

SEQ ID NO: 22917 - RNA, 22 nt, Artificial Sequence
  Synthetic
cugcggccccagcagccccguc

SEQ ID NO: 22918 - RNA, 23 nt, Artificial Sequence
  Synthetic
ccugcggccccagcagccccguc

SEQ ID NO: 22919 - RNA, 24 nt, Artificial Sequence
  Synthetic
cccugcggccccagcagccccguc

SEQ ID NO: 22920 - RNA, 18 nt, Artificial Sequence
  Synthetic
gaaggugucgcagcgcag

SEQ ID NO: 22921 - RNA, 19 nt, Artificial Sequence
  Synthetic
ggaaggugucgcagcgcag

SEQ ID NO: 22922 - RNA, 20 nt, Artificial Sequence
  Synthetic
gggaaggugucgcagcgcag

SEQ ID NO: 22923 - RNA, 21 nt, Artificial Sequence
  Synthetic
cgggaaggugucgcagcgcag

SEQ ID NO: 22924 - RNA, 22 nt, Artificial Sequence
  Synthetic
acgggaaggugucgcagcgcag

SEQ ID NO: 22925 - RNA, 23 nt, Artificial Sequence
  Synthetic
cacgggaaggugucgcagcgcag

SEQ ID NO: 22926 - RNA, 24 nt, Artificial Sequence
  Synthetic
gcacgggaaggugucgcagcgcag

SEQ ID NO: 22927 - RNA, 18 nt, Artificial Sequence
  Synthetic
uccccccguccucucgag

SEQ ID NO: 22928 - RNA, 19 nt, Artificial Sequence
  Synthetic
cuccccccguccucucgag

SEQ ID NO: 22929 - RNA, 20 nt, Artificial Sequence
  Synthetic
gcuccccccguccucucgag

SEQ ID NO: 22930 - RNA, 21 nt, Artificial Sequence
  Synthetic
cgcuccccccguccucucgag

SEQ ID NO: 22931 - RNA, 22 nt, Artificial Sequence
  Synthetic
ucgcuccccccguccucucgag

SEQ ID NO: 22932 - RNA, 23 nt, Artificial Sequence
  Synthetic
gucgcuccccccguccucucgag

SEQ ID NO: 22933 - RNA, 24 nt, Artificial Sequence
  Synthetic
cgucgcuccccccguccucucgag

SEQ ID NO: 22934 - RNA, 18 nt, Artificial Sequence
  Synthetic
gugcuguccgccucggag

SEQ ID NO: 22935 - RNA, 19 nt, Artificial Sequence
  Synthetic
cgugcuguccgccucggag

SEQ ID NO: 22936 - RNA, 20 nt, Artificial Sequence
  Synthetic
ccgugcuguccgccucggag

SEQ ID NO: 22937 - RNA, 21 nt, Artificial Sequence
  Synthetic
uccgugcuguccgccucggag

SEQ ID NO: 22938 - RNA, 22 nt, Artificial Sequence
  Synthetic
guccgugcuguccgccucggag

SEQ ID NO: 22939 - RNA, 23 nt, Artificial Sequence
  Synthetic
uguccgugcuguccgccucggag

SEQ ID NO: 22940 - RNA, 24 nt, Artificial Sequence
  Synthetic
guguccgugcuguccgccucggag

SEQ ID NO: 22941 - RNA, 18 nt, Artificial Sequence
  Synthetic
gccggggucuuccucgcg

SEQ ID NO: 22942 - RNA, 19 nt, Artificial Sequence
  Synthetic
ugccggggucuuccucgcg

SEQ ID NO: 22943 - RNA, 20 nt, Artificial Sequence
  Synthetic
cugccggggucuuccucgcg

SEQ ID NO: 22944 - RNA, 21 nt, Artificial Sequence
  Synthetic
acugccggggucuuccucgcg

SEQ ID NO: 22945 - RNA, 22 nt, Artificial Sequence
  Synthetic
aacugccggggucuuccucgcg

SEQ ID NO: 22946 - RNA, 23 nt, Artificial Sequence
  Synthetic
caacugccggggucuuccucgcg

SEQ ID NO: 22947 - RNA, 24 nt, Artificial Sequence
  Synthetic
gcaacugccggggucuuccucgcg

SEQ ID NO: 22948 - RNA, 18 nt, Artificial Sequence
  Synthetic
cugccggggucuuccucg

SEQ ID NO: 22949 - RNA, 19 nt, Artificial Sequence
  Synthetic
acugccggggucuuccucg

SEQ ID NO: 22950 - RNA, 20 nt, Artificial Sequence
  Synthetic
aacugccggggucuuccucg

SEQ ID NO: 22951 - RNA, 21 nt, Artificial Sequence
  Synthetic
caacugccggggucuuccucg

SEQ ID NO: 22952 - RNA, 22 nt, Artificial Sequence
  Synthetic
gcaacugccggggucuuccucg

SEQ ID NO: 22953 - RNA, 23 nt, Artificial Sequence
  Synthetic
cgcaacugccggggucuuccucg

SEQ ID NO: 22954 - RNA, 24 nt, Artificial Sequence
  Synthetic
ccgcaacugccggggucuuccucg

SEQ ID NO: 22955 - RNA, 18 nt, Artificial Sequence
  Synthetic
gcuccccccguccucucg

SEQ ID NO: 22956 - RNA, 19 nt, Artificial Sequence
  Synthetic
cgcuccccccguccucucg

SEQ ID NO: 22957 - RNA, 20 nt, Artificial Sequence
  Synthetic
ucgcuccccccguccucucg

SEQ ID NO: 22958 - RNA, 21 nt, Artificial Sequence
  Synthetic
gucgcuccccccguccucucg

SEQ ID NO: 22959 - RNA, 22 nt, Artificial Sequence
  Synthetic
cgucgcuccccccguccucucg

SEQ ID NO: 22960 - RNA, 23 nt, Artificial Sequence
  Synthetic
ucgucgcuccccccguccucucg

SEQ ID NO: 22961 - RNA, 24 nt, Artificial Sequence
  Synthetic
cucgucgcuccccccguccucucg

SEQ ID NO: 22962 - RNA, 18 nt, Artificial Sequence
  Synthetic
uccggcaggucucggucg

SEQ ID NO: 22963 - RNA, 19 nt, Artificial Sequence
  Synthetic
guccggcaggucucggucg

SEQ ID NO: 22964 - RNA, 20 nt, Artificial Sequence
  Synthetic
uguccggcaggucucggucg

SEQ ID NO: 22965 - RNA, 21 nt, Artificial Sequence
  Synthetic
cuguccggcaggucucggucg

SEQ ID NO: 22966 - RNA, 22 nt, Artificial Sequence
  Synthetic
gcuguccggcaggucucggucg

SEQ ID NO: 22967 - RNA, 23 nt, Artificial Sequence
  Synthetic
ugcuguccggcaggucucggucg

SEQ ID NO: 22968 - RNA, 24 nt, Artificial Sequence
  Synthetic
cugcuguccggcaggucucggucg

SEQ ID NO: 22969 - RNA, 18 nt, Artificial Sequence
  Synthetic
aaggugucgcagcgcagg

SEQ ID NO: 22970 - RNA, 19 nt, Artificial Sequence
  Synthetic
gaaggugucgcagcgcagg

SEQ ID NO: 22971 - RNA, 20 nt, Artificial Sequence
  Synthetic
ggaaggugucgcagcgcagg

SEQ ID NO: 22972 - RNA, 21 nt, Artificial Sequence
  Synthetic
gggaaggugucgcagcgcagg

SEQ ID NO: 22973 - RNA, 22 nt, Artificial Sequence
  Synthetic
cgggaaggugucgcagcgcagg

SEQ ID NO: 22974 - RNA, 23 nt, Artificial Sequence
  Synthetic
acgggaaggugucgcagcgcagg

SEQ ID NO: 22975 - RNA, 24 nt, Artificial Sequence
  Synthetic
cacgggaaggugucgcagcgcagg

SEQ ID NO: 22976 - RNA, 18 nt, Artificial Sequence
  Synthetic
ccccccguccucucgagg

SEQ ID NO: 22977 - RNA, 19 nt, Artificial Sequence
  Synthetic
uccccccguccucucgagg

SEQ ID NO: 22978 - RNA, 20 nt, Artificial Sequence
  Synthetic
cuccccccguccucucgagg

SEQ ID NO: 22979 - RNA, 21 nt, Artificial Sequence
  Synthetic
gcuccccccguccucucgagg

SEQ ID NO: 22980 - RNA, 22 nt, Artificial Sequence
  Synthetic
cgcuccccccguccucucgagg

SEQ ID NO: 22981 - RNA, 23 nt, Artificial Sequence
  Synthetic
ucgcuccccccguccucucgagg

SEQ ID NO: 22982 - RNA, 24 nt, Artificial Sequence
  Synthetic
gucgcuccccccguccucucgagg

SEQ ID NO: 22983 - RNA, 18 nt, Artificial Sequence
  Synthetic
ccggggucuuccucgcgg

SEQ ID NO: 22984 - RNA, 19 nt, Artificial Sequence
  Synthetic
gccggggucuuccucgcgg

SEQ ID NO: 22985 - RNA, 20 nt, Artificial Sequence
  Synthetic
ugccggggucuuccucgcgg

SEQ ID NO: 22986 - RNA, 21 nt, Artificial Sequence
  Synthetic
cugccggggucuuccucgcgg

SEQ ID NO: 22987 - RNA, 22 nt, Artificial Sequence
  Synthetic
acugccggggucuuccucgcgg

SEQ ID NO: 22988 - RNA, 23 nt, Artificial Sequence
  Synthetic
aacugccggggucuuccucgcgg

SEQ ID NO: 22989 - RNA, 24 nt, Artificial Sequence
  Synthetic
caacugccggggucuuccucgcgg

SEQ ID NO: 22990 - RNA, 18 nt, Artificial Sequence
  Synthetic
aacacccagacauccggg

SEQ ID NO: 22991 - RNA, 19 nt, Artificial Sequence
  Synthetic
aaacacccagacauccggg

SEQ ID NO: 22992 - RNA, 20 nt, Artificial Sequence
  Synthetic
gaaacacccagacauccggg

SEQ ID NO: 22993 - RNA, 21 nt, Artificial Sequence
  Synthetic
ggaaacacccagacauccggg

SEQ ID NO: 22994 - RNA, 22 nt, Artificial Sequence
  Synthetic
gggaaacacccagacauccggg

SEQ ID NO: 22995 - RNA, 23 nt, Artificial Sequence
  Synthetic
agggaaacacccagacauccggg

SEQ ID NO: 22996 - RNA, 24 nt, Artificial Sequence
  Synthetic
cagggaaacacccagacauccggg

SEQ ID NO: 22997 - RNA, 18 nt, Artificial Sequence
  Synthetic
gcggguacucgcuccggg

SEQ ID NO: 22998 - RNA, 19 nt, Artificial Sequence
  Synthetic
ggcggguacucgcuccggg

SEQ ID NO: 22999 - RNA, 20 nt, Artificial Sequence
  Synthetic
cggcggguacucgcuccggg

SEQ ID NO: 23000 - RNA, 21 nt, Artificial Sequence
  Synthetic
ccggcggguacucgcuccggg

SEQ ID NO: 23001 - RNA, 22 nt, Artificial Sequence
  Synthetic
gccggcggguacucgcuccggg

SEQ ID NO: 23002 - RNA, 23 nt, Artificial Sequence
  Synthetic
ggccggcggguacucgcuccggg

SEQ ID NO: 23003 - RNA, 24 nt, Artificial Sequence
  Synthetic
aggccggcggguacucgcuccggg

SEQ ID NO: 23004 - RNA, 18 nt, Artificial Sequence
  Synthetic
cggggucuuccucgcggg

SEQ ID NO: 23005 - RNA, 19 nt, Artificial Sequence
  Synthetic
ccggggucuuccucgcggg

SEQ ID NO: 23006 - RNA, 20 nt, Artificial Sequence
  Synthetic
gccggggucuuccucgcggg

SEQ ID NO: 23007 - RNA, 21 nt, Artificial Sequence
  Synthetic
ugccggggucuuccucgcggg

SEQ ID NO: 23008 - RNA, 22 nt, Artificial Sequence
  Synthetic
cugccggggucuuccucgcggg

SEQ ID NO: 23009 - RNA, 23 nt, Artificial Sequence
  Synthetic
acugccggggucuuccucgcggg

SEQ ID NO: 23010 - RNA, 24 nt, Artificial Sequence
  Synthetic
aacugccggggucuuccucgcggg

SEQ ID NO: 23011 - RNA, 18 nt, Artificial Sequence
  Synthetic
cggguacucgcuccgggg

SEQ ID NO: 23012 - RNA, 19 nt, Artificial Sequence
  Synthetic
gcggguacucgcuccgggg

SEQ ID NO: 23013 - RNA, 20 nt, Artificial Sequence
  Synthetic
ggcggguacucgcuccgggg

SEQ ID NO: 23014 - RNA, 21 nt, Artificial Sequence
  Synthetic
cggcggguacucgcuccgggg

SEQ ID NO: 23015 - RNA, 22 nt, Artificial Sequence
  Synthetic
ccggcggguacucgcuccgggg

SEQ ID NO: 23016 - RNA, 23 nt, Artificial Sequence
  Synthetic
gccggcggguacucgcuccgggg

SEQ ID NO: 23017 - RNA, 24 nt, Artificial Sequence
  Synthetic
ggccggcggguacucgcuccgggg

SEQ ID NO: 23018 - RNA, 18 nt, Artificial Sequence
  Synthetic
guuuucaugcacgggaug

SEQ ID NO: 23019 - RNA, 19 nt, Artificial Sequence
  Synthetic
gguuuucaugcacgggaug

SEQ ID NO: 23020 - RNA, 20 nt, Artificial Sequence
  Synthetic
agguuuucaugcacgggaug

SEQ ID NO: 23021 - RNA, 21 nt, Artificial Sequence
  Synthetic
cagguuuucaugcacgggaug

SEQ ID NO: 23022 - RNA, 22 nt, Artificial Sequence
  Synthetic
ccagguuuucaugcacgggaug

SEQ ID NO: 23023 - RNA, 23 nt, Artificial Sequence
  Synthetic
uccagguuuucaugcacgggaug

SEQ ID NO: 23024 - RNA, 24 nt, Artificial Sequence
  Synthetic
auccagguuuucaugcacgggaug

SEQ ID NO: 23025 - RNA, 18 nt, Artificial Sequence
  Synthetic
ggggcgcccccgcaacug

SEQ ID NO: 23026 - RNA, 19 nt, Artificial Sequence
  Synthetic
gggggcgcccccgcaacug

SEQ ID NO: 23027 - RNA, 20 nt, Artificial Sequence
  Synthetic
ggggggcgcccccgcaacug

SEQ ID NO: 23028 - RNA, 21 nt, Artificial Sequence
  Synthetic
gggggggcgcccccgcaacug

SEQ ID NO: 23029 - RNA, 22 nt, Artificial Sequence
  Synthetic
agggggggcgcccccgcaacug

SEQ ID NO: 23030 - RNA, 23 nt, Artificial Sequence
  Synthetic
gagggggggcgcccccgcaacug

SEQ ID NO: 23031 - RNA, 24 nt, Artificial Sequence
  Synthetic
cgagggggggcgcccccgcaacug

SEQ ID NO: 23032 - RNA, 18 nt, Artificial Sequence
  Synthetic
agggaaacacccagacau

SEQ ID NO: 23033 - RNA, 19 nt, Artificial Sequence
  Synthetic
cagggaaacacccagacau

SEQ ID NO: 23034 - RNA, 20 nt, Artificial Sequence
  Synthetic
gcagggaaacacccagacau

SEQ ID NO: 23035 - RNA, 21 nt, Artificial Sequence
  Synthetic
cgcagggaaacacccagacau

SEQ ID NO: 23036 - RNA, 22 nt, Artificial Sequence
  Synthetic
ucgcagggaaacacccagacau

SEQ ID NO: 23037 - RNA, 23 nt, Artificial Sequence
  Synthetic
gucgcagggaaacacccagacau

SEQ ID NO: 23038 - RNA, 24 nt, Artificial Sequence
  Synthetic
ggucgcagggaaacacccagacau

SEQ ID NO: 23039 - RNA, 18 nt, Artificial Sequence
  Synthetic
uguccgugcuguccgccu

SEQ ID NO: 23040 - RNA, 19 nt, Artificial Sequence
  Synthetic
guguccgugcuguccgccu

SEQ ID NO: 23041 - RNA, 20 nt, Artificial Sequence
  Synthetic
cguguccgugcuguccgccu

SEQ ID NO: 23042 - RNA, 21 nt, Artificial Sequence
  Synthetic
ccguguccgugcuguccgccu

SEQ ID NO: 23043 - RNA, 22 nt, Artificial Sequence
  Synthetic
uccguguccgugcuguccgccu

SEQ ID NO: 23044 - RNA, 23 nt, Artificial Sequence
  Synthetic
uuccguguccgugcuguccgccu

SEQ ID NO: 23045 - RNA, 24 nt, Artificial Sequence
  Synthetic
guuccguguccgugcuguccgccu

SEQ ID NO: 23046 - RNA, 18 nt, Artificial Sequence
  Synthetic
ggccggcggguacucgcu

SEQ ID NO: 23047 - RNA, 19 nt, Artificial Sequence
  Synthetic
aggccggcggguacucgcu

SEQ ID NO: 23048 - RNA, 20 nt, Artificial Sequence
  Synthetic
caggccggcggguacucgcu

SEQ ID NO: 23049 - RNA, 21 nt, Artificial Sequence
  Synthetic
ucaggccggcggguacucgcu

SEQ ID NO: 23050 - RNA, 22 nt, Artificial Sequence
  Synthetic
cucaggccggcggguacucgcu

SEQ ID NO: 23051 - RNA, 23 nt, Artificial Sequence
  Synthetic
ccucaggccggcggguacucgcu

SEQ ID NO: 23052 - RNA, 24 nt, Artificial Sequence
  Synthetic
cccucaggccggcggguacucgcu

SEQ ID NO: 23053 - RNA, 18 nt, Artificial Sequence
  Synthetic
ucugaggcggagaccgaa

SEQ ID NO: 23054 - RNA, 19 nt, Artificial Sequence
  Synthetic
cucugaggcggagaccgaa

SEQ ID NO: 23055 - RNA, 20 nt, Artificial Sequence
  Synthetic
acucugaggcggagaccgaa

SEQ ID NO: 23056 - RNA, 21 nt, Artificial Sequence
  Synthetic
gacucugaggcggagaccgaa

SEQ ID NO: 23057 - RNA, 22 nt, Artificial Sequence
  Synthetic
cgacucugaggcggagaccgaa

SEQ ID NO: 23058 - RNA, 23 nt, Artificial Sequence
  Synthetic
gcgacucugaggcggagaccgaa

SEQ ID NO: 23059 - RNA, 24 nt, Artificial Sequence
  Synthetic
agcgacucugaggcggagaccgaa

SEQ ID NO: 23060 - RNA, 18 nt, Artificial Sequence
  Synthetic
aggcggacagcacggaca

SEQ ID NO: 23061 - RNA, 19 nt, Artificial Sequence
  Synthetic
gaggcggacagcacggaca

SEQ ID NO: 23062 - RNA, 20 nt, Artificial Sequence
  Synthetic
cgaggcggacagcacggaca

SEQ ID NO: 23063 - RNA, 21 nt, Artificial Sequence
  Synthetic
ccgaggcggacagcacggaca

SEQ ID NO: 23064 - RNA, 22 nt, Artificial Sequence
  Synthetic
uccgaggcggacagcacggaca

SEQ ID NO: 23065 - RNA, 23 nt, Artificial Sequence
  Synthetic
cuccgaggcggacagcacggaca

SEQ ID NO: 23066 - RNA, 24 nt, Artificial Sequence
  Synthetic
ccuccgaggcggacagcacggaca

SEQ ID NO: 23067 - RNA, 18 nt, Artificial Sequence
  Synthetic
acacggaacuguucgaga

SEQ ID NO: 23068 - RNA, 19 nt, Artificial Sequence
  Synthetic
gacacggaacuguucgaga

SEQ ID NO: 23069 - RNA, 20 nt, Artificial Sequence
  Synthetic
ggacacggaacuguucgaga

SEQ ID NO: 23070 - RNA, 21 nt, Artificial Sequence
  Synthetic
cggacacggaacuguucgaga

SEQ ID NO: 23071 - RNA, 22 nt, Artificial Sequence
  Synthetic
acggacacggaacuguucgaga

SEQ ID NO: 23072 - RNA, 23 nt, Artificial Sequence
  Synthetic
cacggacacggaacuguucgaga

SEQ ID NO: 23073 - RNA, 24 nt, Artificial Sequence
  Synthetic
gcacggacacggaacuguucgaga

SEQ ID NO: 23074 - RNA, 18 nt, Artificial Sequence
  Synthetic
gcgacucugaggcggaga

SEQ ID NO: 23075 - RNA, 19 nt, Artificial Sequence
  Synthetic
agcgacucugaggcggaga

SEQ ID NO: 23076 - RNA, 20 nt, Artificial Sequence
  Synthetic
cagcgacucugaggcggaga

SEQ ID NO: 23077 - RNA, 21 nt, Artificial Sequence
  Synthetic
gcagcgacucugaggcggaga

SEQ ID NO: 23078 - RNA, 22 nt, Artificial Sequence
  Synthetic
agcagcgacucugaggcggaga

SEQ ID NO: 23079 - RNA, 23 nt, Artificial Sequence
  Synthetic
cagcagcgacucugaggcggaga

SEQ ID NO: 23080 - RNA, 24 nt, Artificial Sequence
  Synthetic
acagcagcgacucugaggcggaga

SEQ ID NO: 23081 - RNA, 18 nt, Artificial Sequence
  Synthetic
cuggguguuucccugcga

SEQ ID NO: 23082 - RNA, 19 nt, Artificial Sequence
  Synthetic
ucuggguguuucccugcga

SEQ ID NO: 23083 - RNA, 20 nt, Artificial Sequence
  Synthetic
gucuggguguuucccugcga

SEQ ID NO: 23084 - RNA, 21 nt, Artificial Sequence
  Synthetic
ugucuggguguuucccugcga

SEQ ID NO: 23085 - RNA, 22 nt, Artificial Sequence
  Synthetic
augucuggguguuucccugcga

SEQ ID NO: 23086 - RNA, 23 nt, Artificial Sequence
  Synthetic
gaugucuggguguuucccugcga

SEQ ID NO: 23087 - RNA, 24 nt, Artificial Sequence
  Synthetic
ggaugucuggguguuucccugcga

SEQ ID NO: 23088 - RNA, 18 nt, Artificial Sequence
  Synthetic
gggggcgcccccccucga

SEQ ID NO: 23089 - RNA, 19 nt, Artificial Sequence
  Synthetic
cgggggcgcccccccucga

SEQ ID NO: 23090 - RNA, 20 nt, Artificial Sequence
  Synthetic
gcgggggcgcccccccucga

SEQ ID NO: 23091 - RNA, 21 nt, Artificial Sequence
  Synthetic
ugcgggggcgcccccccucga

SEQ ID NO: 23092 - RNA, 22 nt, Artificial Sequence
  Synthetic
uugcgggggcgcccccccucga

SEQ ID NO: 23093 - RNA, 23 nt, Artificial Sequence
  Synthetic
guugcgggggcgcccccccucga

SEQ ID NO: 23094 - RNA, 24 nt, Artificial Sequence
  Synthetic
aguugcgggggcgcccccccucga

SEQ ID NO: 23095 - RNA, 18 nt, Artificial Sequence
  Synthetic
cgcccccccucgagagga

SEQ ID NO: 23096 - RNA, 19 nt, Artificial Sequence
  Synthetic
gcgcccccccucgagagga

SEQ ID NO: 23097 - RNA, 20 nt, Artificial Sequence
  Synthetic
ggcgcccccccucgagagga

SEQ ID NO: 23098 - RNA, 21 nt, Artificial Sequence
  Synthetic
gggcgcccccccucgagagga

SEQ ID NO: 23099 - RNA, 22 nt, Artificial Sequence
  Synthetic
ggggcgcccccccucgagagga

SEQ ID NO: 23100 - RNA, 23 nt, Artificial Sequence
  Synthetic
gggggcgcccccccucgagagga

SEQ ID NO: 23101 - RNA, 24 nt, Artificial Sequence
  Synthetic
cgggggcgcccccccucgagagga

SEQ ID NO: 23102 - RNA, 18 nt, Artificial Sequence
  Synthetic
ggggccgcagggcgugga

SEQ ID NO: 23103 - RNA, 19 nt, Artificial Sequence
  Synthetic
uggggccgcagggcgugga

SEQ ID NO: 23104 - RNA, 20 nt, Artificial Sequence
  Synthetic
cuggggccgcagggcgugga

SEQ ID NO: 23105 - RNA, 21 nt, Artificial Sequence
  Synthetic
gcuggggccgcagggcgugga

SEQ ID NO: 23106 - RNA, 22 nt, Artificial Sequence
  Synthetic
ugcuggggccgcagggcgugga

SEQ ID NO: 23107 - RNA, 23 nt, Artificial Sequence
  Synthetic
cugcuggggccgcagggcgugga

SEQ ID NO: 23108 - RNA, 24 nt, Artificial Sequence
  Synthetic
gcugcuggggccgcagggcgugga

SEQ ID NO: 23109 - RNA, 18 nt, Artificial Sequence
  Synthetic
aagcugguguaccugaua

SEQ ID NO: 23110 - RNA, 19 nt, Artificial Sequence
  Synthetic
caagcugguguaccugaua

SEQ ID NO: 23111 - RNA, 20 nt, Artificial Sequence
  Synthetic
ccaagcugguguaccugaua

SEQ ID NO: 23112 - RNA, 21 nt, Artificial Sequence
  Synthetic
gccaagcugguguaccugaua

SEQ ID NO: 23113 - RNA, 22 nt, Artificial Sequence
  Synthetic
cgccaagcugguguaccugaua

SEQ ID NO: 23114 - RNA, 23 nt, Artificial Sequence
  Synthetic
acgccaagcugguguaccugaua

SEQ ID NO: 23115 - RNA, 24 nt, Artificial Sequence
  Synthetic
aacgccaagcugguguaccugaua

SEQ ID NO: 23116 - RNA, 18 nt, Artificial Sequence
  Synthetic
gaggacggggggagcgac

SEQ ID NO: 23117 - RNA, 19 nt, Artificial Sequence
  Synthetic
agaggacggggggagcgac

SEQ ID NO: 23118 - RNA, 20 nt, Artificial Sequence
  Synthetic
gagaggacggggggagcgac

SEQ ID NO: 23119 - RNA, 21 nt, Artificial Sequence
  Synthetic
cgagaggacggggggagcgac

SEQ ID NO: 23120 - RNA, 22 nt, Artificial Sequence
  Synthetic
ucgagaggacggggggagcgac

SEQ ID NO: 23121 - RNA, 23 nt, Artificial Sequence
  Synthetic
cucgagaggacggggggagcgac

SEQ ID NO: 23122 - RNA, 24 nt, Artificial Sequence
  Synthetic
ccucgagaggacggggggagcgac

SEQ ID NO: 23123 - RNA, 18 nt, Artificial Sequence
  Synthetic
gcccccccucgagaggac

SEQ ID NO: 23124 - RNA, 19 nt, Artificial Sequence
  Synthetic
cgcccccccucgagaggac

SEQ ID NO: 23125 - RNA, 20 nt, Artificial Sequence
  Synthetic
gcgcccccccucgagaggac

SEQ ID NO: 23126 - RNA, 21 nt, Artificial Sequence
  Synthetic
ggcgcccccccucgagaggac

SEQ ID NO: 23127 - RNA, 22 nt, Artificial Sequence
  Synthetic
gggcgcccccccucgagaggac

SEQ ID NO: 23128 - RNA, 23 nt, Artificial Sequence
  Synthetic
ggggcgcccccccucgagaggac

SEQ ID NO: 23129 - RNA, 24 nt, Artificial Sequence
  Synthetic
gggggcgcccccccucgagaggac

SEQ ID NO: 23130 - RNA, 18 nt, Artificial Sequence
  Synthetic
gaggcggacagcacggac

SEQ ID NO: 23131 - RNA, 19 nt, Artificial Sequence
  Synthetic
cgaggcggacagcacggac

SEQ ID NO: 23132 - RNA, 20 nt, Artificial Sequence
  Synthetic
ccgaggcggacagcacggac

SEQ ID NO: 23133 - RNA, 21 nt, Artificial Sequence
  Synthetic
uccgaggcggacagcacggac

SEQ ID NO: 23134 - RNA, 22 nt, Artificial Sequence
  Synthetic
cuccgaggcggacagcacggac

SEQ ID NO: 23135 - RNA, 23 nt, Artificial Sequence
  Synthetic
ccuccgaggcggacagcacggac

SEQ ID NO: 23136 - RNA, 24 nt, Artificial Sequence
  Synthetic
gccuccgaggcggacagcacggac

SEQ ID NO: 23137 - RNA, 18 nt, Artificial Sequence
  Synthetic
cgggggggagcccccccc

SEQ ID NO: 23138 - RNA, 19 nt, Artificial Sequence
  Synthetic
ucgggggggagcccccccc

SEQ ID NO: 23139 - RNA, 20 nt, Artificial Sequence
  Synthetic
cucgggggggagcccccccc

SEQ ID NO: 23140 - RNA, 21 nt, Artificial Sequence
  Synthetic
ucucgggggggagcccccccc

SEQ ID NO: 23141 - RNA, 22 nt, Artificial Sequence
  Synthetic
gucucgggggggagcccccccc

SEQ ID NO: 23142 - RNA, 23 nt, Artificial Sequence
  Synthetic
ggucucgggggggagcccccccc

SEQ ID NO: 23143 - RNA, 24 nt, Artificial Sequence
  Synthetic
cggucucgggggggagcccccccc

SEQ ID NO: 23144 - RNA, 18 nt, Artificial Sequence
  Synthetic
uugcgggggcgccccccc

SEQ ID NO: 23145 - RNA, 19 nt, Artificial Sequence
  Synthetic
guugcgggggcgccccccc

SEQ ID NO: 23146 - RNA, 20 nt, Artificial Sequence
  Synthetic
aguugcgggggcgccccccc

SEQ ID NO: 23147 - RNA, 21 nt, Artificial Sequence
  Synthetic
caguugcgggggcgccccccc

SEQ ID NO: 23148 - RNA, 22 nt, Artificial Sequence
  Synthetic
gcaguugcgggggcgccccccc

SEQ ID NO: 23149 - RNA, 23 nt, Artificial Sequence
  Synthetic
ggcaguugcgggggcgccccccc

SEQ ID NO: 23150 - RNA, 24 nt, Artificial Sequence
  Synthetic
cggcaguugcgggggcgccccccc

SEQ ID NO: 23151 - RNA, 18 nt, Artificial Sequence
  Synthetic
gccuccgaggcggacagc

SEQ ID NO: 23152 - RNA, 19 nt, Artificial Sequence
  Synthetic
cgccuccgaggcggacagc

SEQ ID NO: 23153 - RNA, 20 nt, Artificial Sequence
  Synthetic
ccgccuccgaggcggacagc

SEQ ID NO: 23154 - RNA, 21 nt, Artificial Sequence
  Synthetic
uccgccuccgaggcggacagc

SEQ ID NO: 23155 - RNA, 22 nt, Artificial Sequence
  Synthetic
cuccgccuccgaggcggacagc

SEQ ID NO: 23156 - RNA, 23 nt, Artificial Sequence
  Synthetic
acuccgccuccgaggcggacagc

SEQ ID NO: 23157 - RNA, 24 nt, Artificial Sequence
  Synthetic
gacuccgccuccgaggcggacagc

SEQ ID NO: 23158 - RNA, 18 nt, Artificial Sequence
  Synthetic
cugagggccgcccccagc

SEQ ID NO: 23159 - RNA, 19 nt, Artificial Sequence
  Synthetic
ccugagggccgcccccagc

SEQ ID NO: 23160 - RNA, 20 nt, Artificial Sequence
  Synthetic
gccugagggccgcccccagc

SEQ ID NO: 23161 - RNA, 21 nt, Artificial Sequence
  Synthetic
ggccugagggccgcccccagc

SEQ ID NO: 23162 - RNA, 22 nt, Artificial Sequence
  Synthetic
cggccugagggccgcccccagc

SEQ ID NO: 23163 - RNA, 23 nt, Artificial Sequence
  Synthetic
ccggccugagggccgcccccagc

SEQ ID NO: 23164 - RNA, 24 nt, Artificial Sequence
  Synthetic
gccggccugagggccgcccccagc

SEQ ID NO: 23165 - RNA, 18 nt, Artificial Sequence
  Synthetic
ggggggagccccccccgc

SEQ ID NO: 23166 - RNA, 19 nt, Artificial Sequence
  Synthetic
gggggggagccccccccgc

SEQ ID NO: 23167 - RNA, 20 nt, Artificial Sequence
  Synthetic
cgggggggagccccccccgc

SEQ ID NO: 23168 - RNA, 21 nt, Artificial Sequence
  Synthetic
ucgggggggagccccccccgc

SEQ ID NO: 23169 - RNA, 22 nt, Artificial Sequence
  Synthetic
cucgggggggagccccccccgc

SEQ ID NO: 23170 - RNA, 23 nt, Artificial Sequence
  Synthetic
ucucgggggggagccccccccgc

SEQ ID NO: 23171 - RNA, 24 nt, Artificial Sequence
  Synthetic
gucucgggggggagccccccccgc

SEQ ID NO: 23172 - RNA, 18 nt, Artificial Sequence
  Synthetic
gagcgaguacccgccggc

SEQ ID NO: 23173 - RNA, 19 nt, Artificial Sequence
  Synthetic
ggagcgaguacccgccggc

SEQ ID NO: 23174 - RNA, 20 nt, Artificial Sequence
  Synthetic
cggagcgaguacccgccggc

SEQ ID NO: 23175 - RNA, 21 nt, Artificial Sequence
  Synthetic
ccggagcgaguacccgccggc

SEQ ID NO: 23176 - RNA, 22 nt, Artificial Sequence
  Synthetic
cccggagcgaguacccgccggc

SEQ ID NO: 23177 - RNA, 23 nt, Artificial Sequence
  Synthetic
ccccggagcgaguacccgccggc

SEQ ID NO: 23178 - RNA, 24 nt, Artificial Sequence
  Synthetic
gccccggagcgaguacccgccggc

SEQ ID NO: 23179 - RNA, 18 nt, Artificial Sequence
  Synthetic
agaccgaagugggggggc

SEQ ID NO: 23180 - RNA, 19 nt, Artificial Sequence
  Synthetic
gagaccgaagugggggggc

SEQ ID NO: 23181 - RNA, 20 nt, Artificial Sequence
  Synthetic
ggagaccgaagugggggggc

SEQ ID NO: 23182 - RNA, 21 nt, Artificial Sequence
  Synthetic
cggagaccgaagugggggggc

SEQ ID NO: 23183 - RNA, 22 nt, Artificial Sequence
  Synthetic
gcggagaccgaagugggggggc

SEQ ID NO: 23184 - RNA, 23 nt, Artificial Sequence
  Synthetic
ggcggagaccgaagugggggggc

SEQ ID NO: 23185 - RNA, 24 nt, Artificial Sequence
  Synthetic
aggcggagaccgaagugggggggc

SEQ ID NO: 23186 - RNA, 18 nt, Artificial Sequence
  Synthetic
uguucgagacggggcugc

SEQ ID NO: 23187 - RNA, 19 nt, Artificial Sequence
  Synthetic
cuguucgagacggggcugc

SEQ ID NO: 23188 - RNA, 20 nt, Artificial Sequence
  Synthetic
acuguucgagacggggcugc

SEQ ID NO: 23189 - RNA, 21 nt, Artificial Sequence
  Synthetic
aacuguucgagacggggcugc

SEQ ID NO: 23190 - RNA, 22 nt, Artificial Sequence
  Synthetic
gaacuguucgagacggggcugc

SEQ ID NO: 23191 - RNA, 23 nt, Artificial Sequence
  Synthetic
ggaacuguucgagacggggcugc

SEQ ID NO: 23192 - RNA, 24 nt, Artificial Sequence
  Synthetic
cggaacuguucgagacggggcugc

SEQ ID NO: 23193 - RNA, 18 nt, Artificial Sequence
  Synthetic
cgcuucugcaucccgugc

SEQ ID NO: 23194 - RNA, 19 nt, Artificial Sequence
  Synthetic
ccgcuucugcaucccgugc

SEQ ID NO: 23195 - RNA, 20 nt, Artificial Sequence
  Synthetic
accgcuucugcaucccgugc

SEQ ID NO: 23196 - RNA, 21 nt, Artificial Sequence
  Synthetic
caccgcuucugcaucccgugc

SEQ ID NO: 23197 - RNA, 22 nt, Artificial Sequence
  Synthetic
gcaccgcuucugcaucccgugc

SEQ ID NO: 23198 - RNA, 23 nt, Artificial Sequence
  Synthetic
ugcaccgcuucugcaucccgugc

SEQ ID NO: 23199 - RNA, 24 nt, Artificial Sequence
  Synthetic
augcaccgcuucugcaucccgugc

SEQ ID NO: 23200 - RNA, 18 nt, Artificial Sequence
  Synthetic
gaagaccccggcaguugc

SEQ ID NO: 23201 - RNA, 19 nt, Artificial Sequence
  Synthetic
ggaagaccccggcaguugc

SEQ ID NO: 23202 - RNA, 20 nt, Artificial Sequence
  Synthetic
aggaagaccccggcaguugc

SEQ ID NO: 23203 - RNA, 21 nt, Artificial Sequence
  Synthetic
gaggaagaccccggcaguugc

SEQ ID NO: 23204 - RNA, 22 nt, Artificial Sequence
  Synthetic
cgaggaagaccccggcaguugc

SEQ ID NO: 23205 - RNA, 23 nt, Artificial Sequence
  Synthetic
gcgaggaagaccccggcaguugc

SEQ ID NO: 23206 - RNA, 24 nt, Artificial Sequence
  Synthetic
cgcgaggaagaccccggcaguugc

SEQ ID NO: 23207 - RNA, 18 nt, Artificial Sequence
  Synthetic
gcgggggcgcccccccuc

SEQ ID NO: 23208 - RNA, 19 nt, Artificial Sequence
  Synthetic
ugcgggggcgcccccccuc

SEQ ID NO: 23209 - RNA, 20 nt, Artificial Sequence
  Synthetic
uugcgggggcgcccccccuc

SEQ ID NO: 23210 - RNA, 21 nt, Artificial Sequence
  Synthetic
guugcgggggcgcccccccuc

SEQ ID NO: 23211 - RNA, 22 nt, Artificial Sequence
  Synthetic
aguugcgggggcgcccccccuc

SEQ ID NO: 23212 - RNA, 23 nt, Artificial Sequence
  Synthetic
caguugcgggggcgcccccccuc

SEQ ID NO: 23213 - RNA, 24 nt, Artificial Sequence
  Synthetic
gcaguugcgggggcgcccccccuc

SEQ ID NO: 23214 - RNA, 18 nt, Artificial Sequence
  Synthetic
ggaugggggggcggucuc

SEQ ID NO: 23215 - RNA, 19 nt, Artificial Sequence
  Synthetic
uggaugggggggcggucuc

SEQ ID NO: 23216 - RNA, 20 nt, Artificial Sequence
  Synthetic
guggaugggggggcggucuc

SEQ ID NO: 23217 - RNA, 21 nt, Artificial Sequence
  Synthetic
cguggaugggggggcggucuc

SEQ ID NO: 23218 - RNA, 22 nt, Artificial Sequence
  Synthetic
gcguggaugggggggcggucuc

SEQ ID NO: 23219 - RNA, 23 nt, Artificial Sequence
  Synthetic
ggcguggaugggggggcggucuc

SEQ ID NO: 23220 - RNA, 24 nt, Artificial Sequence
  Synthetic
gggcguggaugggggggcggucuc

SEQ ID NO: 23221 - RNA, 18 nt, Artificial Sequence
  Synthetic
guggaugggggggcgguc

SEQ ID NO: 23222 - RNA, 19 nt, Artificial Sequence
  Synthetic
cguggaugggggggcgguc

SEQ ID NO: 23223 - RNA, 20 nt, Artificial Sequence
  Synthetic
gcguggaugggggggcgguc

SEQ ID NO: 23224 - RNA, 21 nt, Artificial Sequence
  Synthetic
ggcguggaugggggggcgguc

SEQ ID NO: 23225 - RNA, 22 nt, Artificial Sequence
  Synthetic
gggcguggaugggggggcgguc

SEQ ID NO: 23226 - RNA, 23 nt, Artificial Sequence
  Synthetic
agggcguggaugggggggcgguc

SEQ ID NO: 23227 - RNA, 24 nt, Artificial Sequence
  Synthetic
cagggcguggaugggggggcgguc

SEQ ID NO: 23228 - RNA, 18 nt, Artificial Sequence
  Synthetic
cugaggcggagaccgaag

SEQ ID NO: 23229 - RNA, 19 nt, Artificial Sequence
  Synthetic
ucugaggcggagaccgaag

SEQ ID NO: 23230 - RNA, 20 nt, Artificial Sequence
  Synthetic
cucugaggcggagaccgaag

SEQ ID NO: 23231 - RNA, 21 nt, Artificial Sequence
  Synthetic
acucugaggcggagaccgaag

SEQ ID NO: 23232 - RNA, 22 nt, Artificial Sequence
  Synthetic
gacucugaggcggagaccgaag

SEQ ID NO: 23233 - RNA, 23 nt, Artificial Sequence
  Synthetic
cgacucugaggcggagaccgaag

SEQ ID NO: 23234 - RNA, 24 nt, Artificial Sequence
  Synthetic
gcgacucugaggcggagaccgaag

SEQ ID NO: 23235 - RNA, 18 nt, Artificial Sequence
  Synthetic
gacgacuccgccuccgag

SEQ ID NO: 23236 - RNA, 19 nt, Artificial Sequence
  Synthetic
cgacgacuccgccuccgag

SEQ ID NO: 23237 - RNA, 20 nt, Artificial Sequence
  Synthetic
acgacgacuccgccuccgag

SEQ ID NO: 23238 - RNA, 21 nt, Artificial Sequence
  Synthetic
gacgacgacuccgccuccgag

SEQ ID NO: 23239 - RNA, 22 nt, Artificial Sequence
  Synthetic
ugacgacgacuccgccuccgag

SEQ ID NO: 23240 - RNA, 23 nt, Artificial Sequence
  Synthetic
augacgacgacuccgccuccgag

SEQ ID NO: 23241 - RNA, 24 nt, Artificial Sequence
  Synthetic
caugacgacgacuccgccuccgag

SEQ ID NO: 23242 - RNA, 18 nt, Artificial Sequence
  Synthetic
gacacggaacuguucgag

SEQ ID NO: 23243 - RNA, 19 nt, Artificial Sequence
  Synthetic
ggacacggaacuguucgag

SEQ ID NO: 23244 - RNA, 20 nt, Artificial Sequence
  Synthetic
cggacacggaacuguucgag

SEQ ID NO: 23245 - RNA, 21 nt, Artificial Sequence
  Synthetic
acggacacggaacuguucgag

SEQ ID NO: 23246 - RNA, 22 nt, Artificial Sequence
  Synthetic
cacggacacggaacuguucgag

SEQ ID NO: 23247 - RNA, 23 nt, Artificial Sequence
  Synthetic
gcacggacacggaacuguucgag

SEQ ID NO: 23248 - RNA, 24 nt, Artificial Sequence
  Synthetic
agcacggacacggaacuguucgag

SEQ ID NO: 23249 - RNA, 18 nt, Artificial Sequence
  Synthetic
gacagcagcgacucugag

SEQ ID NO: 23250 - RNA, 19 nt, Artificial Sequence
  Synthetic
ggacagcagcgacucugag

SEQ ID NO: 23251 - RNA, 20 nt, Artificial Sequence
  Synthetic
cggacagcagcgacucugag

SEQ ID NO: 23252 - RNA, 21 nt, Artificial Sequence
  Synthetic
ccggacagcagcgacucugag

SEQ ID NO: 23253 - RNA, 22 nt, Artificial Sequence
  Synthetic
gccggacagcagcgacucugag

SEQ ID NO: 23254 - RNA, 23 nt, Artificial Sequence
  Synthetic
ugccggacagcagcgacucugag

SEQ ID NO: 23255 - RNA, 24 nt, Artificial Sequence
  Synthetic
cugccggacagcagcgacucugag

SEQ ID NO: 23256 - RNA, 18 nt, Artificial Sequence
  Synthetic
cccccccucgagaggacg

SEQ ID NO: 23257 - RNA, 19 nt, Artificial Sequence
  Synthetic
gcccccccucgagaggacg

SEQ ID NO: 23258 - RNA, 20 nt, Artificial Sequence
  Synthetic
cgcccccccucgagaggacg

SEQ ID NO: 23259 - RNA, 21 nt, Artificial Sequence
  Synthetic
gcgcccccccucgagaggacg

SEQ ID NO: 23260 - RNA, 22 nt, Artificial Sequence
  Synthetic
ggcgcccccccucgagaggacg

SEQ ID NO: 23261 - RNA, 23 nt, Artificial Sequence
  Synthetic
gggcgcccccccucgagaggacg

SEQ ID NO: 23262 - RNA, 24 nt, Artificial Sequence
  Synthetic
ggggcgcccccccucgagaggacg

SEQ ID NO: 23263 - RNA, 18 nt, Artificial Sequence
  Synthetic
acggggcugcuggggccg

SEQ ID NO: 23264 - RNA, 19 nt, Artificial Sequence
  Synthetic
gacggggcugcuggggccg

SEQ ID NO: 23265 - RNA, 20 nt, Artificial Sequence
  Synthetic
agacggggcugcuggggccg

SEQ ID NO: 23266 - RNA, 21 nt, Artificial Sequence
  Synthetic
gagacggggcugcuggggccg

SEQ ID NO: 23267 - RNA, 22 nt, Artificial Sequence
  Synthetic
cgagacggggcugcuggggccg

SEQ ID NO: 23268 - RNA, 23 nt, Artificial Sequence
  Synthetic
ucgagacggggcugcuggggccg

SEQ ID NO: 23269 - RNA, 24 nt, Artificial Sequence
  Synthetic
uucgagacggggcugcuggggccg

SEQ ID NO: 23270 - RNA, 18 nt, Artificial Sequence
  Synthetic
gagaggacggggggagcg

SEQ ID NO: 23271 - RNA, 19 nt, Artificial Sequence
  Synthetic
cgagaggacggggggagcg

SEQ ID NO: 23272 - RNA, 20 nt, Artificial Sequence
  Synthetic
ucgagaggacggggggagcg

SEQ ID NO: 23273 - RNA, 21 nt, Artificial Sequence
  Synthetic
cucgagaggacggggggagcg

SEQ ID NO: 23274 - RNA, 22 nt, Artificial Sequence
  Synthetic
ccucgagaggacggggggagcg

SEQ ID NO: 23275 - RNA, 23 nt, Artificial Sequence
  Synthetic
cccucgagaggacggggggagcg

SEQ ID NO: 23276 - RNA, 24 nt, Artificial Sequence
  Synthetic
ccccucgagaggacggggggagcg

SEQ ID NO: 23277 - RNA, 18 nt, Artificial Sequence
  Synthetic
gggggagccccccccgcg

SEQ ID NO: 23278 - RNA, 19 nt, Artificial Sequence
  Synthetic
ggggggagccccccccgcg

SEQ ID NO: 23279 - RNA, 20 nt, Artificial Sequence
  Synthetic
gggggggagccccccccgcg

SEQ ID NO: 23280 - RNA, 21 nt, Artificial Sequence
  Synthetic
cgggggggagccccccccgcg

SEQ ID NO: 23281 - RNA, 22 nt, Artificial Sequence
  Synthetic
ucgggggggagccccccccgcg

SEQ ID NO: 23282 - RNA, 23 nt, Artificial Sequence
  Synthetic
cucgggggggagccccccccgcg

SEQ ID NO: 23283 - RNA, 24 nt, Artificial Sequence
  Synthetic
ucucgggggggagccccccccgcg

SEQ ID NO: 23284 - RNA, 18 nt, Artificial Sequence
  Synthetic
gaccgaagugggggggcg

SEQ ID NO: 23285 - RNA, 19 nt, Artificial Sequence
  Synthetic
agaccgaagugggggggcg

SEQ ID NO: 23286 - RNA, 20 nt, Artificial Sequence
  Synthetic
gagaccgaagugggggggcg

SEQ ID NO: 23287 - RNA, 21 nt, Artificial Sequence
  Synthetic
ggagaccgaagugggggggcg

SEQ ID NO: 23288 - RNA, 22 nt, Artificial Sequence
  Synthetic
cggagaccgaagugggggggcg

SEQ ID NO: 23289 - RNA, 23 nt, Artificial Sequence
  Synthetic
gcggagaccgaagugggggggcg

SEQ ID NO: 23290 - RNA, 24 nt, Artificial Sequence
  Synthetic
ggcggagaccgaagugggggggcg

SEQ ID NO: 23291 - RNA, 18 nt, Artificial Sequence
  Synthetic
gaugggggggcggucucg

SEQ ID NO: 23292 - RNA, 19 nt, Artificial Sequence
  Synthetic
ggaugggggggcggucucg

SEQ ID NO: 23293 - RNA, 20 nt, Artificial Sequence
  Synthetic
uggaugggggggcggucucg

SEQ ID NO: 23294 - RNA, 21 nt, Artificial Sequence
  Synthetic
guggaugggggggcggucucg

SEQ ID NO: 23295 - RNA, 22 nt, Artificial Sequence
  Synthetic
cguggaugggggggcggucucg

SEQ ID NO: 23296 - RNA, 23 nt, Artificial Sequence
  Synthetic
gcguggaugggggggcggucucg

SEQ ID NO: 23297 - RNA, 24 nt, Artificial Sequence
  Synthetic
ggcguggaugggggggcggucucg

SEQ ID NO: 23298 - RNA, 18 nt, Artificial Sequence
  Synthetic
gcgcccccccucgagagg

SEQ ID NO: 23299 - RNA, 19 nt, Artificial Sequence
  Synthetic
ggcgcccccccucgagagg

SEQ ID NO: 23300 - RNA, 20 nt, Artificial Sequence
  Synthetic
gggcgcccccccucgagagg

SEQ ID NO: 23301 - RNA, 21 nt, Artificial Sequence
  Synthetic
ggggcgcccccccucgagagg

SEQ ID NO: 23302 - RNA, 22 nt, Artificial Sequence
  Synthetic
gggggcgcccccccucgagagg

SEQ ID NO: 23303 - RNA, 23 nt, Artificial Sequence
  Synthetic
cgggggcgcccccccucgagagg

SEQ ID NO: 23304 - RNA, 24 nt, Artificial Sequence
  Synthetic
gcgggggcgcccccccucgagagg

SEQ ID NO: 23305 - RNA, 18 nt, Artificial Sequence
  Synthetic
acagcagcgacucugagg

SEQ ID NO: 23306 - RNA, 19 nt, Artificial Sequence
  Synthetic
gacagcagcgacucugagg

SEQ ID NO: 23307 - RNA, 20 nt, Artificial Sequence
  Synthetic
ggacagcagcgacucugagg

SEQ ID NO: 23308 - RNA, 21 nt, Artificial Sequence
  Synthetic
cggacagcagcgacucugagg

SEQ ID NO: 23309 - RNA, 22 nt, Artificial Sequence
  Synthetic
ccggacagcagcgacucugagg

SEQ ID NO: 23310 - RNA, 23 nt, Artificial Sequence
  Synthetic
gccggacagcagcgacucugagg

SEQ ID NO: 23311 - RNA, 24 nt, Artificial Sequence
  Synthetic
ugccggacagcagcgacucugagg

SEQ ID NO: 23312 - RNA, 18 nt, Artificial Sequence
  Synthetic
ugugcgccgugugcacgg

SEQ ID NO: 23313 - RNA, 19 nt, Artificial Sequence
  Synthetic
gugugcgccgugugcacgg

SEQ ID NO: 23314 - RNA, 20 nt, Artificial Sequence
  Synthetic
cgugugcgccgugugcacgg

SEQ ID NO: 23315 - RNA, 21 nt, Artificial Sequence
  Synthetic
acgugugcgccgugugcacgg

SEQ ID NO: 23316 - RNA, 22 nt, Artificial Sequence
  Synthetic
gacgugugcgccgugugcacgg

SEQ ID NO: 23317 - RNA, 23 nt, Artificial Sequence
  Synthetic
cgacgugugcgccgugugcacgg

SEQ ID NO: 23318 - RNA, 24 nt, Artificial Sequence
  Synthetic
gcgacgugugcgccgugugcacgg

SEQ ID NO: 23319 - RNA, 18 nt, Artificial Sequence
  Synthetic
ccccccucgagaggacgg

SEQ ID NO: 23320 - RNA, 19 nt, Artificial Sequence
  Synthetic
cccccccucgagaggacgg

SEQ ID NO: 23321 - RNA, 20 nt, Artificial Sequence
  Synthetic
gcccccccucgagaggacgg

SEQ ID NO: 23322 - RNA, 21 nt, Artificial Sequence
  Synthetic
cgcccccccucgagaggacgg

SEQ ID NO: 23323 - RNA, 22 nt, Artificial Sequence
  Synthetic
gcgcccccccucgagaggacgg

SEQ ID NO: 23324 - RNA, 23 nt, Artificial Sequence
  Synthetic
ggcgcccccccucgagaggacgg

SEQ ID NO: 23325 - RNA, 24 nt, Artificial Sequence
  Synthetic
gggcgcccccccucgagaggacgg

SEQ ID NO: 23326 - RNA, 18 nt, Artificial Sequence
  Synthetic
accgaagugggggggcgg

SEQ ID NO: 23327 - RNA, 19 nt, Artificial Sequence
  Synthetic
gaccgaagugggggggcgg

SEQ ID NO: 23328 - RNA, 20 nt, Artificial Sequence
  Synthetic
agaccgaagugggggggcgg

SEQ ID NO: 23329 - RNA, 21 nt, Artificial Sequence
  Synthetic
gagaccgaagugggggggcgg

SEQ ID NO: 23330 - RNA, 22 nt, Artificial Sequence
  Synthetic
ggagaccgaagugggggggcgg

SEQ ID NO: 23331 - RNA, 23 nt, Artificial Sequence
  Synthetic
cggagaccgaagugggggggcgg

SEQ ID NO: 23332 - RNA, 24 nt, Artificial Sequence
  Synthetic
gcggagaccgaagugggggggcgg

SEQ ID NO: 23333 - RNA, 18 nt, Artificial Sequence
  Synthetic
augggggggcggucucgg

SEQ ID NO: 23334 - RNA, 19 nt, Artificial Sequence
  Synthetic
gaugggggggcggucucgg

SEQ ID NO: 23335 - RNA, 20 nt, Artificial Sequence
  Synthetic
ggaugggggggcggucucgg

SEQ ID NO: 23336 - RNA, 21 nt, Artificial Sequence
  Synthetic
uggaugggggggcggucucgg

SEQ ID NO: 23337 - RNA, 22 nt, Artificial Sequence
  Synthetic
guggaugggggggcggucucgg

SEQ ID NO: 23338 - RNA, 23 nt, Artificial Sequence
  Synthetic
cguggaugggggggcggucucgg

SEQ ID NO: 23339 - RNA, 24 nt, Artificial Sequence
  Synthetic
gcguggaugggggggcggucucgg

SEQ ID NO: 23340 - RNA, 18 nt, Artificial Sequence
  Synthetic
cccccucgagaggacggg

SEQ ID NO: 23341 - RNA, 19 nt, Artificial Sequence
  Synthetic
ccccccucgagaggacggg

SEQ ID NO: 23342 - RNA, 20 nt, Artificial Sequence
  Synthetic
cccccccucgagaggacggg

SEQ ID NO: 23343 - RNA, 21 nt, Artificial Sequence
  Synthetic
gcccccccucgagaggacggg

SEQ ID NO: 23344 - RNA, 22 nt, Artificial Sequence
  Synthetic
cgcccccccucgagaggacggg

SEQ ID NO: 23345 - RNA, 23 nt, Artificial Sequence
  Synthetic
gcgcccccccucgagaggacggg

SEQ ID NO: 23346 - RNA, 24 nt, Artificial Sequence
  Synthetic
ggcgcccccccucgagaggacggg

SEQ ID NO: 23347 - RNA, 18 nt, Artificial Sequence
  Synthetic
ugggggggcggucucggg

SEQ ID NO: 23348 - RNA, 19 nt, Artificial Sequence
  Synthetic
augggggggcggucucggg

SEQ ID NO: 23349 - RNA, 20 nt, Artificial Sequence
  Synthetic
gaugggggggcggucucggg

SEQ ID NO: 23350 - RNA, 21 nt, Artificial Sequence
  Synthetic
ggaugggggggcggucucggg

SEQ ID NO: 23351 - RNA, 22 nt, Artificial Sequence
  Synthetic
uggaugggggggcggucucggg

SEQ ID NO: 23352 - RNA, 23 nt, Artificial Sequence
  Synthetic
guggaugggggggcggucucggg

SEQ ID NO: 23353 - RNA, 24 nt, Artificial Sequence
  Synthetic
cguggaugggggggcggucucggg

SEQ ID NO: 23354 - RNA, 18 nt, Artificial Sequence
  Synthetic
gggggggcggucucgggg

SEQ ID NO: 23355 - RNA, 19 nt, Artificial Sequence
  Synthetic
ugggggggcggucucgggg

SEQ ID NO: 23356 - RNA, 20 nt, Artificial Sequence
  Synthetic
augggggggcggucucgggg

SEQ ID NO: 23357 - RNA, 21 nt, Artificial Sequence
  Synthetic
gaugggggggcggucucgggg

SEQ ID NO: 23358 - RNA, 22 nt, Artificial Sequence
  Synthetic
ggaugggggggcggucucgggg

SEQ ID NO: 23359 - RNA, 23 nt, Artificial Sequence
  Synthetic
uggaugggggggcggucucgggg

SEQ ID NO: 23360 - RNA, 24 nt, Artificial Sequence
  Synthetic
guggaugggggggcggucucgggg

SEQ ID NO: 23361 - RNA, 18 nt, Artificial Sequence
  Synthetic
gagaccgaaguggggggg

SEQ ID NO: 23362 - RNA, 19 nt, Artificial Sequence
  Synthetic
ggagaccgaaguggggggg

SEQ ID NO: 23363 - RNA, 20 nt, Artificial Sequence
  Synthetic
cggagaccgaaguggggggg

SEQ ID NO: 23364 - RNA, 21 nt, Artificial Sequence
  Synthetic
gcggagaccgaaguggggggg

SEQ ID NO: 23365 - RNA, 22 nt, Artificial Sequence
  Synthetic
ggcggagaccgaaguggggggg

SEQ ID NO: 23366 - RNA, 23 nt, Artificial Sequence
  Synthetic
aggcggagaccgaaguggggggg

SEQ ID NO: 23367 - RNA, 24 nt, Artificial Sequence
  Synthetic
gaggcggagaccgaaguggggggg

SEQ ID NO: 23368 - RNA, 18 nt, Artificial Sequence
  Synthetic
ggagaccgaagugggggg

SEQ ID NO: 23369 - RNA, 19 nt, Artificial Sequence
  Synthetic
cggagaccgaagugggggg

SEQ ID NO: 23370 - RNA, 20 nt, Artificial Sequence
  Synthetic
gcggagaccgaagugggggg

SEQ ID NO: 23371 - RNA, 21 nt, Artificial Sequence
  Synthetic
ggcggagaccgaagugggggg

SEQ ID NO: 23372 - RNA, 22 nt, Artificial Sequence
  Synthetic
aggcggagaccgaagugggggg

SEQ ID NO: 23373 - RNA, 23 nt, Artificial Sequence
  Synthetic
gaggcggagaccgaagugggggg

SEQ ID NO: 23374 - RNA, 24 nt, Artificial Sequence
  Synthetic
ugaggcggagaccgaagugggggg

SEQ ID NO: 23375 - RNA, 18 nt, Artificial Sequence
  Synthetic
gccgcagggcguggaugg

SEQ ID NO: 23376 - RNA, 19 nt, Artificial Sequence
  Synthetic
ggccgcagggcguggaugg

SEQ ID NO: 23377 - RNA, 20 nt, Artificial Sequence
  Synthetic
gggccgcagggcguggaugg

SEQ ID NO: 23378 - RNA, 21 nt, Artificial Sequence
  Synthetic
ggggccgcagggcguggaugg

SEQ ID NO: 23379 - RNA, 22 nt, Artificial Sequence
  Synthetic
uggggccgcagggcguggaugg

SEQ ID NO: 23380 - RNA, 23 nt, Artificial Sequence
  Synthetic
cuggggccgcagggcguggaugg

SEQ ID NO: 23381 - RNA, 24 nt, Artificial Sequence
  Synthetic
gcuggggccgcagggcguggaugg

SEQ ID NO: 23382 - RNA, 18 nt, Artificial Sequence
  Synthetic
aggcggagaccgaagugg

SEQ ID NO: 23383 - RNA, 19 nt, Artificial Sequence
  Synthetic
gaggcggagaccgaagugg

SEQ ID NO: 23384 - RNA, 20 nt, Artificial Sequence
  Synthetic
ugaggcggagaccgaagugg

SEQ ID NO: 23385 - RNA, 21 nt, Artificial Sequence
  Synthetic
cugaggcggagaccgaagugg

SEQ ID NO: 23386 - RNA, 22 nt, Artificial Sequence
  Synthetic
ucugaggcggagaccgaagugg

SEQ ID NO: 23387 - RNA, 23 nt, Artificial Sequence
  Synthetic
cucugaggcggagaccgaagugg

SEQ ID NO: 23388 - RNA, 24 nt, Artificial Sequence
  Synthetic
acucugaggcggagaccgaagugg

SEQ ID NO: 23389 - RNA, 18 nt, Artificial Sequence
  Synthetic
uggggccgcagggcgugg

SEQ ID NO: 23390 - RNA, 19 nt, Artificial Sequence
  Synthetic
cuggggccgcagggcgugg

SEQ ID NO: 23391 - RNA, 20 nt, Artificial Sequence
  Synthetic
gcuggggccgcagggcgugg

SEQ ID NO: 23392 - RNA, 21 nt, Artificial Sequence
  Synthetic
ugcuggggccgcagggcgugg

SEQ ID NO: 23393 - RNA, 22 nt, Artificial Sequence
  Synthetic
cugcuggggccgcagggcgugg

SEQ ID NO: 23394 - RNA, 23 nt, Artificial Sequence
  Synthetic
gcugcuggggccgcagggcgugg

SEQ ID NO: 23395 - RNA, 24 nt, Artificial Sequence
  Synthetic
ggcugcuggggccgcagggcgugg

SEQ ID NO: 23396 - RNA, 18 nt, Artificial Sequence
  Synthetic
ggccgcagggcguggaug

SEQ ID NO: 23397 - RNA, 19 nt, Artificial Sequence
  Synthetic
gggccgcagggcguggaug

SEQ ID NO: 23398 - RNA, 20 nt, Artificial Sequence
  Synthetic
ggggccgcagggcguggaug

SEQ ID NO: 23399 - RNA, 21 nt, Artificial Sequence
  Synthetic
uggggccgcagggcguggaug

SEQ ID NO: 23400 - RNA, 22 nt, Artificial Sequence
  Synthetic
cuggggccgcagggcguggaug

SEQ ID NO: 23401 - RNA, 23 nt, Artificial Sequence
  Synthetic
gcuggggccgcagggcguggaug

SEQ ID NO: 23402 - RNA, 24 nt, Artificial Sequence
  Synthetic
ugcuggggccgcagggcguggaug

SEQ ID NO: 23403 - RNA, 18 nt, Artificial Sequence
  Synthetic
cccugcgaccgagaccug

SEQ ID NO: 23404 - RNA, 19 nt, Artificial Sequence
  Synthetic
ucccugcgaccgagaccug

SEQ ID NO: 23405 - RNA, 20 nt, Artificial Sequence
  Synthetic
uucccugcgaccgagaccug

SEQ ID NO: 23406 - RNA, 21 nt, Artificial Sequence
  Synthetic
uuucccugcgaccgagaccug

SEQ ID NO: 23407 - RNA, 22 nt, Artificial Sequence
  Synthetic
guuucccugcgaccgagaccug

SEQ ID NO: 23408 - RNA, 23 nt, Artificial Sequence
  Synthetic
uguuucccugcgaccgagaccug

SEQ ID NO: 23409 - RNA, 24 nt, Artificial Sequence
  Synthetic
guguuucccugcgaccgagaccug

SEQ ID NO: 23410 - RNA, 18 nt, Artificial Sequence
  Synthetic
cuguucgagacggggcug

SEQ ID NO: 23411 - RNA, 19 nt, Artificial Sequence
  Synthetic
acuguucgagacggggcug

SEQ ID NO: 23412 - RNA, 20 nt, Artificial Sequence
  Synthetic
aacuguucgagacggggcug

SEQ ID NO: 23413 - RNA, 21 nt, Artificial Sequence
  Synthetic
gaacuguucgagacggggcug

SEQ ID NO: 23414 - RNA, 22 nt, Artificial Sequence
  Synthetic
ggaacuguucgagacggggcug

SEQ ID NO: 23415 - RNA, 23 nt, Artificial Sequence
  Synthetic
cggaacuguucgagacggggcug

SEQ ID NO: 23416 - RNA, 24 nt, Artificial Sequence
  Synthetic
acggaacuguucgagacggggcug

SEQ ID NO: 23417 - RNA, 18 nt, Artificial Sequence
  Synthetic
gaggcggagaccgaagug

SEQ ID NO: 23418 - RNA, 19 nt, Artificial Sequence
  Synthetic
ugaggcggagaccgaagug

SEQ ID NO: 23419 - RNA, 20 nt, Artificial Sequence
  Synthetic
cugaggcggagaccgaagug

SEQ ID NO: 23420 - RNA, 21 nt, Artificial Sequence
  Synthetic
ucugaggcggagaccgaagug

SEQ ID NO: 23421 - RNA, 22 nt, Artificial Sequence
  Synthetic
cucugaggcggagaccgaagug

SEQ ID NO: 23422 - RNA, 23 nt, Artificial Sequence
  Synthetic
acucugaggcggagaccgaagug

SEQ ID NO: 23423 - RNA, 24 nt, Artificial Sequence
  Synthetic
gacucugaggcggagaccgaagug

SEQ ID NO: 23424 - RNA, 18 nt, Artificial Sequence
  Synthetic
ggaagaccccggcaguug

SEQ ID NO: 23425 - RNA, 19 nt, Artificial Sequence
  Synthetic
aggaagaccccggcaguug

SEQ ID NO: 23426 - RNA, 20 nt, Artificial Sequence
  Synthetic
gaggaagaccccggcaguug

SEQ ID NO: 23427 - RNA, 21 nt, Artificial Sequence
  Synthetic
cgaggaagaccccggcaguug

SEQ ID NO: 23428 - RNA, 22 nt, Artificial Sequence
  Synthetic
gcgaggaagaccccggcaguug

SEQ ID NO: 23429 - RNA, 23 nt, Artificial Sequence
  Synthetic
cgcgaggaagaccccggcaguug

SEQ ID NO: 23430 - RNA, 24 nt, Artificial Sequence
  Synthetic
ccgcgaggaagaccccggcaguug

SEQ ID NO: 23431 - RNA, 18 nt, Artificial Sequence
  Synthetic
gggccgcagggcguggau

SEQ ID NO: 23432 - RNA, 19 nt, Artificial Sequence
  Synthetic
ggggccgcagggcguggau

SEQ ID NO: 23433 - RNA, 20 nt, Artificial Sequence
  Synthetic
uggggccgcagggcguggau

SEQ ID NO: 23434 - RNA, 21 nt, Artificial Sequence
  Synthetic
cuggggccgcagggcguggau

SEQ ID NO: 23435 - RNA, 22 nt, Artificial Sequence
  Synthetic
gcuggggccgcagggcguggau

SEQ ID NO: 23436 - RNA, 23 nt, Artificial Sequence
  Synthetic
ugcuggggccgcagggcguggau

SEQ ID NO: 23437 - RNA, 24 nt, Artificial Sequence
  Synthetic
cugcuggggccgcagggcguggau

SEQ ID NO: 23438 - RNA, 18 nt, Artificial Sequence
  Synthetic
ugccggacagcagcgacu

SEQ ID NO: 23439 - RNA, 19 nt, Artificial Sequence
  Synthetic
cugccggacagcagcgacu

SEQ ID NO: 23440 - RNA, 20 nt, Artificial Sequence
  Synthetic
ccugccggacagcagcgacu

SEQ ID NO: 23441 - RNA, 21 nt, Artificial Sequence
  Synthetic
accugccggacagcagcgacu

SEQ ID NO: 23442 - RNA, 22 nt, Artificial Sequence
  Synthetic
gaccugccggacagcagcgacu

SEQ ID NO: 23443 - RNA, 23 nt, Artificial Sequence
  Synthetic
agaccugccggacagcagcgacu

SEQ ID NO: 23444 - RNA, 24 nt, Artificial Sequence
  Synthetic
gagaccugccggacagcagcgacu

SEQ ID NO: 23445 - RNA, 18 nt, Artificial Sequence
  Synthetic
augacgacgacuccgccu

SEQ ID NO: 23446 - RNA, 19 nt, Artificial Sequence
  Synthetic
caugacgacgacuccgccu

SEQ ID NO: 23447 - RNA, 20 nt, Artificial Sequence
  Synthetic
ccaugacgacgacuccgccu

SEQ ID NO: 23448 - RNA, 21 nt, Artificial Sequence
  Synthetic
accaugacgacgacuccgccu

SEQ ID NO: 23449 - RNA, 22 nt, Artificial Sequence
  Synthetic
caccaugacgacgacuccgccu

SEQ ID NO: 23450 - RNA, 23 nt, Artificial Sequence
  Synthetic
ccaccaugacgacgacuccgccu

SEQ ID NO: 23451 - RNA, 24 nt, Artificial Sequence
  Synthetic
accaccaugacgacgacuccgccu

SEQ ID NO: 23452 - RNA, 18 nt, Artificial Sequence
  Synthetic
gcgaguacccgccggccu

SEQ ID NO: 23453 - RNA, 19 nt, Artificial Sequence
  Synthetic
agcgaguacccgccggccu

SEQ ID NO: 23454 - RNA, 20 nt, Artificial Sequence
  Synthetic
gagcgaguacccgccggccu

SEQ ID NO: 23455 - RNA, 21 nt, Artificial Sequence
  Synthetic
ggagcgaguacccgccggccu

SEQ ID NO: 23456 - RNA, 22 nt, Artificial Sequence
  Synthetic
cggagcgaguacccgccggccu

SEQ ID NO: 23457 - RNA, 23 nt, Artificial Sequence
  Synthetic
ccggagcgaguacccgccggccu

SEQ ID NO: 23458 - RNA, 24 nt, Artificial Sequence
  Synthetic
cccggagcgaguacccgccggccu

SEQ ID NO: 23459 - RNA, 18 nt, Artificial Sequence
  Synthetic
uggaugggggggcggucu

SEQ ID NO: 23460 - RNA, 19 nt, Artificial Sequence
  Synthetic
guggaugggggggcggucu

SEQ ID NO: 23461 - RNA, 20 nt, Artificial Sequence
  Synthetic
cguggaugggggggcggucu

SEQ ID NO: 23462 - RNA, 21 nt, Artificial Sequence
  Synthetic
gcguggaugggggggcggucu

SEQ ID NO: 23463 - RNA, 22 nt, Artificial Sequence
  Synthetic
ggcguggaugggggggcggucu

SEQ ID NO: 23464 - RNA, 23 nt, Artificial Sequence
  Synthetic
gggcguggaugggggggcggucu

SEQ ID NO: 23465 - RNA, 24 nt, Artificial Sequence
  Synthetic
agggcguggaugggggggcggucu

SEQ ID NO: 23466 - RNA, 18 nt, Artificial Sequence
  Synthetic
ugaggcggagaccgaagu

SEQ ID NO: 23467 - RNA, 19 nt, Artificial Sequence
  Synthetic
cugaggcggagaccgaagu

SEQ ID NO: 23468 - RNA, 20 nt, Artificial Sequence
  Synthetic
ucugaggcggagaccgaagu

SEQ ID NO: 23469 - RNA, 21 nt, Artificial Sequence
  Synthetic
cucugaggcggagaccgaagu

SEQ ID NO: 23470 - RNA, 22 nt, Artificial Sequence
  Synthetic
acucugaggcggagaccgaagu

SEQ ID NO: 23471 - RNA, 23 nt, Artificial Sequence
  Synthetic
gacucugaggcggagaccgaagu

SEQ ID NO: 23472 - RNA, 24 nt, Artificial Sequence
  Synthetic
cgacucugaggcggagaccgaagu

SEQ ID NO: 23473 - RNA, 18 nt, Artificial Sequence
  Synthetic
gcacggacacggaacugu

SEQ ID NO: 23474 - RNA, 19 nt, Artificial Sequence
  Synthetic
agcacggacacggaacugu

SEQ ID NO: 23475 - RNA, 20 nt, Artificial Sequence
  Synthetic
cagcacggacacggaacugu

SEQ ID NO: 23476 - RNA, 21 nt, Artificial Sequence
  Synthetic
acagcacggacacggaacugu

SEQ ID NO: 23477 - RNA, 22 nt, Artificial Sequence
  Synthetic
gacagcacggacacggaacugu

SEQ ID NO: 23478 - RNA, 23 nt, Artificial Sequence
  Synthetic
ggacagcacggacacggaacugu

SEQ ID NO: 23479 - RNA, 24 nt, Artificial Sequence
  Synthetic
cggacagcacggacacggaacugu

SEQ ID NO: 23480 - RNA, 18 nt, Artificial Sequence
  Synthetic
aggaagaccccggcaguu

SEQ ID NO: 23481 - RNA, 19 nt, Artificial Sequence
  Synthetic
gaggaagaccccggcaguu

SEQ ID NO: 23482 - RNA, 20 nt, Artificial Sequence
  Synthetic
cgaggaagaccccggcaguu

SEQ ID NO: 23483 - RNA, 21 nt, Artificial Sequence
  Synthetic
gcgaggaagaccccggcaguu

SEQ ID NO: 23484 - RNA, 22 nt, Artificial Sequence
  Synthetic
cgcgaggaagaccccggcaguu

SEQ ID NO: 23485 - RNA, 23 nt, Artificial Sequence
  Synthetic
ccgcgaggaagaccccggcaguu

SEQ ID NO: 23486 - RNA, 24 nt, Artificial Sequence
  Synthetic
cccgcgaggaagaccccggcaguu

SEQ ID NO: 23487 - RNA, 18 nt, Artificial Sequence
  Synthetic
gggagucgcugaucacua

SEQ ID NO: 23488 - RNA, 19 nt, Artificial Sequence
  Synthetic
ggggagucgcugaucacua

SEQ ID NO: 23489 - RNA, 20 nt, Artificial Sequence
  Synthetic
gggggagucgcugaucacua

SEQ ID NO: 23490 - RNA, 21 nt, Artificial Sequence
  Synthetic
ggggggagucgcugaucacua

SEQ ID NO: 23491 - RNA, 22 nt, Artificial Sequence
  Synthetic
gggggggagucgcugaucacua

SEQ ID NO: 23492 - RNA, 18 nt, Artificial Sequence
  Synthetic
gaacagcauguuccccac

SEQ ID NO: 23493 - RNA, 21 nt, Artificial Sequence
  Synthetic
gucgaacagcauguuccccac

SEQ ID NO: 23494 - RNA, 22 nt, Artificial Sequence
  Synthetic
ggucgaacagcauguuccccac

SEQ ID NO: 23495 - RNA, 18 nt, Artificial Sequence
  Synthetic
gaaguccagggcgcccac

SEQ ID NO: 23496 - RNA, 19 nt, Artificial Sequence
  Synthetic
ggaaguccagggcgcccac

SEQ ID NO: 23497 - RNA, 21 nt, Artificial Sequence
  Synthetic
gcggaaguccagggcgcccac

SEQ ID NO: 23498 - RNA, 24 nt, Artificial Sequence
  Synthetic
gcugcggaaguccagggcgcccac

SEQ ID NO: 23499 - RNA, 19 nt, Artificial Sequence
  Synthetic
gcccccugcuccccggacc

SEQ ID NO: 23500 - RNA, 22 nt, Artificial Sequence
  Synthetic
gacgcccccugcuccccggacc

SEQ ID NO: 23501 - RNA, 20 nt, Artificial Sequence
  Synthetic
gcccucaccgugugcccccc

SEQ ID NO: 23502 - RNA, 21 nt, Artificial Sequence
  Synthetic
ggcccucaccgugugcccccc

SEQ ID NO: 23503 - RNA, 22 nt, Artificial Sequence
  Synthetic
gggcccucaccgugugcccccc

SEQ ID NO: 23504 - RNA, 18 nt, Artificial Sequence
  Synthetic
ggccgcgcccccccggcc

SEQ ID NO: 23505 - RNA, 18 nt, Artificial Sequence
  Synthetic
ggaagaggcggcccccgc

SEQ ID NO: 23506 - RNA, 20 nt, Artificial Sequence
  Synthetic
gcggaagaggcggcccccgc

SEQ ID NO: 23507 - RNA, 21 nt, Artificial Sequence
  Synthetic
ggcggaagaggcggcccccgc

SEQ ID NO: 23508 - RNA, 23 nt, Artificial Sequence
  Synthetic
gcggcggaagaggcggcccccgc

SEQ ID NO: 23509 - RNA, 24 nt, Artificial Sequence
  Synthetic
ggcggcggaagaggcggcccccgc

SEQ ID NO: 23510 - RNA, 21 nt, Artificial Sequence
  Synthetic
gccacggccgcgcgggggcgc

SEQ ID NO: 23511 - RNA, 22 nt, Artificial Sequence
  Synthetic
ggccacggccgcgcgggggcgc

SEQ ID NO: 23512 - RNA, 23 nt, Artificial Sequence
  Synthetic
gggccacggccgcgcgggggcgc

SEQ ID NO: 23513 - RNA, 24 nt, Artificial Sequence
  Synthetic
ggggccacggccgcgcgggggcgc

SEQ ID NO: 23514 - RNA, 18 nt, Artificial Sequence
  Synthetic
guuccccgucuccauguc

SEQ ID NO: 23515 - RNA, 21 nt, Artificial Sequence
  Synthetic
gauguuccccgucuccauguc

SEQ ID NO: 23516 - RNA, 18 nt, Artificial Sequence
  Synthetic
ggggaccgcggcccgcag

SEQ ID NO: 23517 - RNA, 21 nt, Artificial Sequence
  Synthetic
gccggggaccgcggcccgcag

SEQ ID NO: 23518 - RNA, 18 nt, Artificial Sequence
  Synthetic
ggccgccgaggacgucag

SEQ ID NO: 23519 - RNA, 20 nt, Artificial Sequence
  Synthetic
gaggccgccgaggacgucag

SEQ ID NO: 23520 - RNA, 21 nt, Artificial Sequence
  Synthetic
ggaggccgccgaggacgucag

SEQ ID NO: 23521 - RNA, 23 nt, Artificial Sequence
  Synthetic
gcggaggccgccgaggacgucag

SEQ ID NO: 23522 - RNA, 24 nt, Artificial Sequence
  Synthetic
ggcggaggccgccgaggacgucag

SEQ ID NO: 23523 - RNA, 21 nt, Artificial Sequence
  Synthetic
guuacccgcggucucggggag

SEQ ID NO: 23524 - RNA, 22 nt, Artificial Sequence
  Synthetic
gguuacccgcggucucggggag

SEQ ID NO: 23525 - RNA, 24 nt, Artificial Sequence
  Synthetic
gugguuacccgcggucucggggag

SEQ ID NO: 23526 - RNA, 23 nt, Artificial Sequence
  Synthetic
guuccacuccgacgcgggggccg

SEQ ID NO: 23527 - RNA, 24 nt, Artificial Sequence
  Synthetic
gcccccccggcccugagucggagg

SEQ ID NO: 23528 - RNA, 18 nt, Artificial Sequence
  Synthetic
guccguggugggcuccgg

SEQ ID NO: 23529 - RNA, 20 nt, Artificial Sequence
  Synthetic
guucgcggccugagccaggg

SEQ ID NO: 23530 - RNA, 21 nt, Artificial Sequence
  Synthetic
gguucgcggccugagccaggg

SEQ ID NO: 23531 - RNA, 21 nt, Artificial Sequence
  Synthetic
gccuguggggagaggccgggg

SEQ ID NO: 23532 - RNA, 22 nt, Artificial Sequence
  Synthetic
ggccuguggggagaggccgggg

SEQ ID NO: 23533 - RNA, 23 nt, Artificial Sequence
  Synthetic
gggccuguggggagaggccgggg

SEQ ID NO: 23534 - RNA, 24 nt, Artificial Sequence
  Synthetic
ggggccuguggggagaggccgggg

SEQ ID NO: 23535 - RNA, 22 nt, Artificial Sequence
  Synthetic
gucucuguuguuugcaaggggg

SEQ ID NO: 23536 - RNA, 23 nt, Artificial Sequence
  Synthetic
ggucucuguuguuugcaaggggg

SEQ ID NO: 23537 - RNA, 24 nt, Artificial Sequence
  Synthetic
gggucucuguuguuugcaaggggg

SEQ ID NO: 23538 - RNA, 18 nt, Artificial Sequence
  Synthetic
gacgcguggacugggggg

SEQ ID NO: 23539 - RNA, 19 nt, Artificial Sequence
  Synthetic
ggacgcguggacugggggg

SEQ ID NO: 23540 - RNA, 20 nt, Artificial Sequence
  Synthetic
gggacgcguggacugggggg

SEQ ID NO: 23541 - RNA, 21 nt, Artificial Sequence
  Synthetic
ggggacgcguggacugggggg

SEQ ID NO: 23542 - RNA, 22 nt, Artificial Sequence
  Synthetic
gggggacgcguggacugggggg

SEQ ID NO: 23543 - RNA, 23 nt, Artificial Sequence
  Synthetic
ggggggacgcguggacugggggg

SEQ ID NO: 23544 - RNA, 24 nt, Artificial Sequence
  Synthetic
gggggggacgcguggacugggggg

SEQ ID NO: 23545 - RNA, 18 nt, Artificial Sequence
  Synthetic
ggccuccucggccuccau

SEQ ID NO: 23546 - RNA, 21 nt, Artificial Sequence
  Synthetic
gacggccuccucggccuccau

SEQ ID NO: 23547 - RNA, 20 nt, Artificial Sequence
  Synthetic
gucugggggucguucacgau

SEQ ID NO: 23548 - RNA, 21 nt, Artificial Sequence
  Synthetic
ggucugggggucguucacgau

SEQ ID NO: 23549 - RNA, 22 nt, Artificial Sequence
  Synthetic
gggucugggggucguucacgau

SEQ ID NO: 23550 - RNA, 24 nt, Artificial Sequence
  Synthetic
gcgggucugggggucguucacgau

SEQ ID NO: 23551 - RNA, 23 nt, Artificial Sequence
  Synthetic
gucauccucguccguggugggcu

SEQ ID NO: 23552 - RNA, 21 nt, Artificial Sequence
  Synthetic
gcucaggccgcgaaccaagaa

SEQ ID NO: 23553 - RNA, 22 nt, Artificial Sequence
  Synthetic
ggcucaggccgcgaaccaagaa

SEQ ID NO: 23554 - RNA, 20 nt, Artificial Sequence
  Synthetic
gcacccugcuccccgagacc

SEQ ID NO: 23555 - RNA, 23 nt, Artificial Sequence
  Synthetic
gccgcacccugcuccccgagacc

SEQ ID NO: 23556 - RNA, 18 nt, Artificial Sequence
  Synthetic
guaaccacgugaugcccc

SEQ ID NO: 23557 - RNA, 19 nt, Artificial Sequence
  Synthetic
gguaaccacgugaugcccc

SEQ ID NO: 23558 - RNA, 20 nt, Artificial Sequence
  Synthetic
ggguaaccacgugaugcccc

SEQ ID NO: 23559 - RNA, 22 nt, Artificial Sequence
  Synthetic
gcggguaaccacgugaugcccc

SEQ ID NO: 23560 - RNA, 19 nt, Artificial Sequence
  Synthetic
gugcguccgaggaagaggc

SEQ ID NO: 23561 - RNA, 20 nt, Artificial Sequence
  Synthetic
ggugcguccgaggaagaggc

SEQ ID NO: 23562 - RNA, 22 nt, Artificial Sequence
  Synthetic
gcggugcguccgaggaagaggc

SEQ ID NO: 23563 - RNA, 23 nt, Artificial Sequence
  Synthetic
ggcggugcguccgaggaagaggc

SEQ ID NO: 23564 - RNA, 18 nt, Artificial Sequence
  Synthetic
gggccgggggggcgcggc

SEQ ID NO: 23565 - RNA, 24 nt, Artificial Sequence
  Synthetic
gacucagggccgggggggcgcggc

SEQ ID NO: 23566 - RNA, 18 nt, Artificial Sequence
  Synthetic
gcgcuaccugcccaucuc

SEQ ID NO: 23567 - RNA, 18 nt, Artificial Sequence
  Synthetic
ggcgucuggccccuccgg

SEQ ID NO: 23568 - RNA, 19 nt, Artificial Sequence
  Synthetic
gggcgucuggccccuccgg

SEQ ID NO: 23569 - RNA, 20 nt, Artificial Sequence
  Synthetic
ggggcgucuggccccuccgg

SEQ ID NO: 23570 - RNA, 21 nt, Artificial Sequence
  Synthetic
gggggcgucuggccccuccgg

SEQ ID NO: 23571 - RNA, 22 nt, Artificial Sequence
  Synthetic
ggggggcgucuggccccuccgg

SEQ ID NO: 23572 - RNA, 24 nt, Artificial Sequence
  Synthetic
gcggggggcgucuggccccuccgg

SEQ ID NO: 23573 - RNA, 20 nt, Artificial Sequence
  Synthetic
gcucgggggggccgggcgug

SEQ ID NO: 23574 - RNA, 21 nt, Artificial Sequence
  Synthetic
ggcucgggggggccgggcgug

SEQ ID NO: 23575 - RNA, 23 nt, Artificial Sequence
  Synthetic
gcggcucgggggggccgggcgug

SEQ ID NO: 23576 - RNA, 18 nt, Artificial Sequence
  Synthetic
gucggaguggaacagccu

SEQ ID NO: 23577 - RNA, 20 nt, Artificial Sequence
  Synthetic
gcgucggaguggaacagccu

SEQ ID NO: 23578 - RNA, 20 nt, Artificial Sequence
  Synthetic
guacccgacggcccccgcgu

SEQ ID NO: 23579 - RNA, 22 nt, Artificial Sequence
  Synthetic
gaguacccgacggcccccgcgu

SEQ ID NO: 23580 - RNA, 21 nt, Artificial Sequence
  Synthetic
gucuggccccuccgggggggu

SEQ ID NO: 23581 - RNA, 23 nt, Artificial Sequence
  Synthetic
gcgucuggccccuccgggggggu

SEQ ID NO: 23582 - RNA, 24 nt, Artificial Sequence
  Synthetic
ggcgucuggccccuccgggggggu

SEQ ID NO: 23583 - RNA, 22 nt, Artificial Sequence
  Synthetic
gccccuccggggggguuggggu

SEQ ID NO: 23584 - RNA, 23 nt, Artificial Sequence
  Synthetic
ggccccuccggggggguuggggu

SEQ ID NO: 23585 - RNA, 18 nt, Artificial Sequence
  Synthetic
ggggguugggguuggggu

SEQ ID NO: 23586 - RNA, 19 nt, Artificial Sequence
  Synthetic
gggggguugggguuggggu

SEQ ID NO: 23587 - RNA, 20 nt, Artificial Sequence
  Synthetic
ggggggguugggguuggggu

SEQ ID NO: 23588 - RNA, 23 nt, Artificial Sequence
  Synthetic
cgggggggagucgcugaucacua

SEQ ID NO: 23589 - RNA, 24 nt, Artificial Sequence
  Synthetic
ccgggggggagucgcugaucacua

SEQ ID NO: 23590 - RNA, 19 nt, Artificial Sequence
  Synthetic
cgaacagcauguuccccac

SEQ ID NO: 23591 - RNA, 20 nt, Artificial Sequence
  Synthetic
ucgaacagcauguuccccac

SEQ ID NO: 23592 - RNA, 23 nt, Artificial Sequence
  Synthetic
uggucgaacagcauguuccccac

SEQ ID NO: 23593 - RNA, 24 nt, Artificial Sequence
  Synthetic
cuggucgaacagcauguuccccac

SEQ ID NO: 23594 - RNA, 20 nt, Artificial Sequence
  Synthetic
cggaaguccagggcgcccac

SEQ ID NO: 23595 - RNA, 22 nt, Artificial Sequence
  Synthetic
ugcggaaguccagggcgcccac

SEQ ID NO: 23596 - RNA, 23 nt, Artificial Sequence
  Synthetic
cugcggaaguccagggcgcccac

SEQ ID NO: 23597 - RNA, 18 nt, Artificial Sequence
  Synthetic
cccccugcuccccggacc

SEQ ID NO: 23598 - RNA, 20 nt, Artificial Sequence
  Synthetic
cgcccccugcuccccggacc

SEQ ID NO: 23599 - RNA, 21 nt, Artificial Sequence
  Synthetic
acgcccccugcuccccggacc

SEQ ID NO: 23600 - RNA, 23 nt, Artificial Sequence
  Synthetic
cgacgcccccugcuccccggacc

SEQ ID NO: 23601 - RNA, 24 nt, Artificial Sequence
  Synthetic
ucgacgcccccugcuccccggacc

SEQ ID NO: 23602 - RNA, 18 nt, Artificial Sequence
  Synthetic
ccucaccgugugcccccc

SEQ ID NO: 23603 - RNA, 19 nt, Artificial Sequence
  Synthetic
cccucaccgugugcccccc

SEQ ID NO: 23604 - RNA, 23 nt, Artificial Sequence
  Synthetic
agggcccucaccgugugcccccc

SEQ ID NO: 23605 - RNA, 24 nt, Artificial Sequence
  Synthetic
cagggcccucaccgugugcccccc

SEQ ID NO: 23606 - RNA, 19 nt, Artificial Sequence
  Synthetic
uggccgcgcccccccggcc

SEQ ID NO: 23607 - RNA, 20 nt, Artificial Sequence
  Synthetic
cuggccgcgcccccccggcc

SEQ ID NO: 23608 - RNA, 21 nt, Artificial Sequence
  Synthetic
ccuggccgcgcccccccggcc

SEQ ID NO: 23609 - RNA, 22 nt, Artificial Sequence
  Synthetic
cccuggccgcgcccccccggcc

SEQ ID NO: 23610 - RNA, 23 nt, Artificial Sequence
  Synthetic
acccuggccgcgcccccccggcc

SEQ ID NO: 23611 - RNA, 24 nt, Artificial Sequence
  Synthetic
cacccuggccgcgcccccccggcc

SEQ ID NO: 23612 - RNA, 19 nt, Artificial Sequence
  Synthetic
cggaagaggcggcccccgc

SEQ ID NO: 23613 - RNA, 22 nt, Artificial Sequence
  Synthetic
cggcggaagaggcggcccccgc

SEQ ID NO: 23614 - RNA, 18 nt, Artificial Sequence
  Synthetic
acggccgcgcgggggcgc

SEQ ID NO: 23615 - RNA, 19 nt, Artificial Sequence
  Synthetic
cacggccgcgcgggggcgc

SEQ ID NO: 23616 - RNA, 20 nt, Artificial Sequence
  Synthetic
ccacggccgcgcgggggcgc

SEQ ID NO: 23617 - RNA, 19 nt, Artificial Sequence
  Synthetic
uguuccccgucuccauguc

SEQ ID NO: 23618 - RNA, 20 nt, Artificial Sequence
  Synthetic
auguuccccgucuccauguc

SEQ ID NO: 23619 - RNA, 22 nt, Artificial Sequence
  Synthetic
cgauguuccccgucuccauguc

SEQ ID NO: 23620 - RNA, 23 nt, Artificial Sequence
  Synthetic
ccgauguuccccgucuccauguc

SEQ ID NO: 23621 - RNA, 24 nt, Artificial Sequence
  Synthetic
cccgauguuccccgucuccauguc

SEQ ID NO: 23622 - RNA, 19 nt, Artificial Sequence
  Synthetic
cggggaccgcggcccgcag

SEQ ID NO: 23623 - RNA, 20 nt, Artificial Sequence
  Synthetic
ccggggaccgcggcccgcag

SEQ ID NO: 23624 - RNA, 22 nt, Artificial Sequence
  Synthetic
agccggggaccgcggcccgcag

SEQ ID NO: 23625 - RNA, 23 nt, Artificial Sequence
  Synthetic
cagccggggaccgcggcccgcag

SEQ ID NO: 23626 - RNA, 24 nt, Artificial Sequence
  Synthetic
ccagccggggaccgcggcccgcag

SEQ ID NO: 23627 - RNA, 19 nt, Artificial Sequence
  Synthetic
aggccgccgaggacgucag

SEQ ID NO: 23628 - RNA, 22 nt, Artificial Sequence
  Synthetic
cggaggccgccgaggacgucag

SEQ ID NO: 23629 - RNA, 18 nt, Artificial Sequence
  Synthetic
acccgcggucucggggag

SEQ ID NO: 23630 - RNA, 19 nt, Artificial Sequence
  Synthetic
uacccgcggucucggggag

SEQ ID NO: 23631 - RNA, 20 nt, Artificial Sequence
  Synthetic
uuacccgcggucucggggag

SEQ ID NO: 23632 - RNA, 23 nt, Artificial Sequence
  Synthetic
ugguuacccgcggucucggggag

SEQ ID NO: 23633 - RNA, 18 nt, Artificial Sequence
  Synthetic
acuccgacgcgggggccg

SEQ ID NO: 23634 - RNA, 19 nt, Artificial Sequence
  Synthetic
cacuccgacgcgggggccg

SEQ ID NO: 23635 - RNA, 20 nt, Artificial Sequence
  Synthetic
ccacuccgacgcgggggccg

SEQ ID NO: 23636 - RNA, 21 nt, Artificial Sequence
  Synthetic
uccacuccgacgcgggggccg

SEQ ID NO: 23637 - RNA, 22 nt, Artificial Sequence
  Synthetic
uuccacuccgacgcgggggccg

SEQ ID NO: 23638 - RNA, 24 nt, Artificial Sequence
  Synthetic
uguuccacuccgacgcgggggccg

SEQ ID NO: 23639 - RNA, 18 nt, Artificial Sequence
  Synthetic
ccggcccugagucggagg

SEQ ID NO: 23640 - RNA, 19 nt, Artificial Sequence
  Synthetic
cccggcccugagucggagg

SEQ ID NO: 23641 - RNA, 20 nt, Artificial Sequence
  Synthetic
ccccggcccugagucggagg

SEQ ID NO: 23642 - RNA, 21 nt, Artificial Sequence
  Synthetic
cccccggcccugagucggagg

SEQ ID NO: 23643 - RNA, 22 nt, Artificial Sequence
  Synthetic
ccccccggcccugagucggagg

SEQ ID NO: 23644 - RNA, 23 nt, Artificial Sequence
  Synthetic
cccccccggcccugagucggagg

SEQ ID NO: 23645 - RNA, 19 nt, Artificial Sequence
  Synthetic
cguccguggugggcuccgg

SEQ ID NO: 23646 - RNA, 20 nt, Artificial Sequence
  Synthetic
ucguccguggugggcuccgg

SEQ ID NO: 23647 - RNA, 21 nt, Artificial Sequence
  Synthetic
cucguccguggugggcuccgg

SEQ ID NO: 23648 - RNA, 22 nt, Artificial Sequence
  Synthetic
ccucguccguggugggcuccgg

SEQ ID NO: 23649 - RNA, 23 nt, Artificial Sequence
  Synthetic
uccucguccguggugggcuccgg

SEQ ID NO: 23650 - RNA, 24 nt, Artificial Sequence
  Synthetic
auccucguccguggugggcuccgg

SEQ ID NO: 23651 - RNA, 18 nt, Artificial Sequence
  Synthetic
ucgcggccugagccaggg

SEQ ID NO: 23652 - RNA, 19 nt, Artificial Sequence
  Synthetic
uucgcggccugagccaggg

SEQ ID NO: 23653 - RNA, 22 nt, Artificial Sequence
  Synthetic
ugguucgcggccugagccaggg

SEQ ID NO: 23654 - RNA, 23 nt, Artificial Sequence
  Synthetic
uugguucgcggccugagccaggg

SEQ ID NO: 23655 - RNA, 24 nt, Artificial Sequence
  Synthetic
cuugguucgcggccugagccaggg

SEQ ID NO: 23656 - RNA, 18 nt, Artificial Sequence
  Synthetic
uguggggagaggccgggg

SEQ ID NO: 23657 - RNA, 19 nt, Artificial Sequence
  Synthetic
cuguggggagaggccgggg

SEQ ID NO: 23658 - RNA, 20 nt, Artificial Sequence
  Synthetic
ccuguggggagaggccgggg

SEQ ID NO: 23659 - RNA, 18 nt, Artificial Sequence
  Synthetic
cuguuguuugcaaggggg

SEQ ID NO: 23660 - RNA, 19 nt, Artificial Sequence
  Synthetic
ucuguuguuugcaaggggg

SEQ ID NO: 23661 - RNA, 20 nt, Artificial Sequence
  Synthetic
cucuguuguuugcaaggggg

SEQ ID NO: 23662 - RNA, 21 nt, Artificial Sequence
  Synthetic
ucucuguuguuugcaaggggg

SEQ ID NO: 23663 - RNA, 19 nt, Artificial Sequence
  Synthetic
cggccuccucggccuccau

SEQ ID NO: 23664 - RNA, 20 nt, Artificial Sequence
  Synthetic
acggccuccucggccuccau

SEQ ID NO: 23665 - RNA, 22 nt, Artificial Sequence
  Synthetic
ugacggccuccucggccuccau

SEQ ID NO: 23666 - RNA, 23 nt, Artificial Sequence
  Synthetic
cugacggccuccucggccuccau

SEQ ID NO: 23667 - RNA, 24 nt, Artificial Sequence
  Synthetic
ccugacggccuccucggccuccau

SEQ ID NO: 23668 - RNA, 18 nt, Artificial Sequence
  Synthetic
cugggggucguucacgau

SEQ ID NO: 23669 - RNA, 19 nt, Artificial Sequence
  Synthetic
ucugggggucguucacgau

SEQ ID NO: 23670 - RNA, 23 nt, Artificial Sequence
  Synthetic
cgggucugggggucguucacgau

SEQ ID NO: 23671 - RNA, 18 nt, Artificial Sequence
  Synthetic
ccucguccguggugggcu

SEQ ID NO: 23672 - RNA, 19 nt, Artificial Sequence
  Synthetic
uccucguccguggugggcu

SEQ ID NO: 23673 - RNA, 20 nt, Artificial Sequence
  Synthetic
auccucguccguggugggcu

SEQ ID NO: 23674 - RNA, 21 nt, Artificial Sequence
  Synthetic
cauccucguccguggugggcu

SEQ ID NO: 23675 - RNA, 22 nt, Artificial Sequence
  Synthetic
ucauccucguccguggugggcu

SEQ ID NO: 23676 - RNA, 24 nt, Artificial Sequence
  Synthetic
cgucauccucguccguggugggcu

SEQ ID NO: 23677 - RNA, 18 nt, Artificial Sequence
  Synthetic
cggccuccaugcgggucu

SEQ ID NO: 23678 - RNA, 19 nt, Artificial Sequence
  Synthetic
ucggccuccaugcgggucu

SEQ ID NO: 23679 - RNA, 20 nt, Artificial Sequence
  Synthetic
cucggccuccaugcgggucu

SEQ ID NO: 23680 - RNA, 21 nt, Artificial Sequence
  Synthetic
ccucggccuccaugcgggucu

SEQ ID NO: 23681 - RNA, 22 nt, Artificial Sequence
  Synthetic
uccucggccuccaugcgggucu

SEQ ID NO: 23682 - RNA, 23 nt, Artificial Sequence
  Synthetic
cuccucggccuccaugcgggucu

SEQ ID NO: 23683 - RNA, 24 nt, Artificial Sequence
  Synthetic
ccuccucggccuccaugcgggucu

SEQ ID NO: 23684 - RNA, 18 nt, Artificial Sequence
  Synthetic
caggccgcgaaccaagaa

SEQ ID NO: 23685 - RNA, 19 nt, Artificial Sequence
  Synthetic
ucaggccgcgaaccaagaa

SEQ ID NO: 23686 - RNA, 20 nt, Artificial Sequence
  Synthetic
cucaggccgcgaaccaagaa

SEQ ID NO: 23687 - RNA, 23 nt, Artificial Sequence
  Synthetic
uggcucaggccgcgaaccaagaa

SEQ ID NO: 23688 - RNA, 24 nt, Artificial Sequence
  Synthetic
cuggcucaggccgcgaaccaagaa

SEQ ID NO: 23689 - RNA, 18 nt, Artificial Sequence
  Synthetic
ccggagcccaccacggac

SEQ ID NO: 23690 - RNA, 19 nt, Artificial Sequence
  Synthetic
cccggagcccaccacggac

SEQ ID NO: 23691 - RNA, 20 nt, Artificial Sequence
  Synthetic
acccggagcccaccacggac

SEQ ID NO: 23692 - RNA, 21 nt, Artificial Sequence
  Synthetic
cacccggagcccaccacggac

SEQ ID NO: 23693 - RNA, 22 nt, Artificial Sequence
  Synthetic
ccacccggagcccaccacggac

SEQ ID NO: 23694 - RNA, 23 nt, Artificial Sequence
  Synthetic
cccacccggagcccaccacggac

SEQ ID NO: 23695 - RNA, 24 nt, Artificial Sequence
  Synthetic
acccacccggagcccaccacggac

SEQ ID NO: 23696 - RNA, 18 nt, Artificial Sequence
  Synthetic
acccugcuccccgagacc

SEQ ID NO: 23697 - RNA, 19 nt, Artificial Sequence
  Synthetic
cacccugcuccccgagacc

SEQ ID NO: 23698 - RNA, 21 nt, Artificial Sequence
  Synthetic
cgcacccugcuccccgagacc

SEQ ID NO: 23699 - RNA, 22 nt, Artificial Sequence
  Synthetic
ccgcacccugcuccccgagacc

SEQ ID NO: 23700 - RNA, 24 nt, Artificial Sequence
  Synthetic
cgccgcacccugcuccccgagacc

SEQ ID NO: 23701 - RNA, 21 nt, Artificial Sequence
  Synthetic
cggguaaccacgugaugcccc

SEQ ID NO: 23702 - RNA, 23 nt, Artificial Sequence
  Synthetic
cgcggguaaccacgugaugcccc

SEQ ID NO: 23703 - RNA, 24 nt, Artificial Sequence
  Synthetic
ccgcggguaaccacgugaugcccc

SEQ ID NO: 23704 - RNA, 18 nt, Artificial Sequence
  Synthetic
ugcguccgaggaagaggc

SEQ ID NO: 23705 - RNA, 21 nt, Artificial Sequence
  Synthetic
cggugcguccgaggaagaggc

SEQ ID NO: 23706 - RNA, 24 nt, Artificial Sequence
  Synthetic
cggcggugcguccgaggaagaggc

SEQ ID NO: 23707 - RNA, 19 nt, Artificial Sequence
  Synthetic
agggccgggggggcgcggc

SEQ ID NO: 23708 - RNA, 20 nt, Artificial Sequence
  Synthetic
cagggccgggggggcgcggc

SEQ ID NO: 23709 - RNA, 21 nt, Artificial Sequence
  Synthetic
ucagggccgggggggcgcggc

SEQ ID NO: 23710 - RNA, 22 nt, Artificial Sequence
  Synthetic
cucagggccgggggggcgcggc

SEQ ID NO: 23711 - RNA, 23 nt, Artificial Sequence
  Synthetic
acucagggccgggggggcgcggc

SEQ ID NO: 23712 - RNA, 19 nt, Artificial Sequence
  Synthetic
cgcgcuaccugcccaucuc

SEQ ID NO: 23713 - RNA, 20 nt, Artificial Sequence
  Synthetic
acgcgcuaccugcccaucuc

SEQ ID NO: 23714 - RNA, 21 nt, Artificial Sequence
  Synthetic
cacgcgcuaccugcccaucuc

SEQ ID NO: 23715 - RNA, 22 nt, Artificial Sequence
  Synthetic
ucacgcgcuaccugcccaucuc

SEQ ID NO: 23716 - RNA, 23 nt, Artificial Sequence
  Synthetic
cucacgcgcuaccugcccaucuc

SEQ ID NO: 23717 - RNA, 24 nt, Artificial Sequence
  Synthetic
ccucacgcgcuaccugcccaucuc

SEQ ID NO: 23718 - RNA, 23 nt, Artificial Sequence
  Synthetic
cggggggcgucuggccccuccgg

SEQ ID NO: 23719 - RNA, 18 nt, Artificial Sequence
  Synthetic
ucgggggggccgggcgug

SEQ ID NO: 23720 - RNA, 19 nt, Artificial Sequence
  Synthetic
cucgggggggccgggcgug

SEQ ID NO: 23721 - RNA, 22 nt, Artificial Sequence
  Synthetic
cggcucgggggggccgggcgug

SEQ ID NO: 23722 - RNA, 24 nt, Artificial Sequence
  Synthetic
cgcggcucgggggggccgggcgug

SEQ ID NO: 23723 - RNA, 19 nt, Artificial Sequence
  Synthetic
cgucggaguggaacagccu

SEQ ID NO: 23724 - RNA, 21 nt, Artificial Sequence
  Synthetic
cgcgucggaguggaacagccu

SEQ ID NO: 23725 - RNA, 22 nt, Artificial Sequence
  Synthetic
ccgcgucggaguggaacagccu

SEQ ID NO: 23726 - RNA, 23 nt, Artificial Sequence
  Synthetic
cccgcgucggaguggaacagccu

SEQ ID NO: 23727 - RNA, 24 nt, Artificial Sequence
  Synthetic
ccccgcgucggaguggaacagccu

SEQ ID NO: 23728 - RNA, 18 nt, Artificial Sequence
  Synthetic
acccgacggcccccgcgu

SEQ ID NO: 23729 - RNA, 19 nt, Artificial Sequence
  Synthetic
uacccgacggcccccgcgu

SEQ ID NO: 23730 - RNA, 21 nt, Artificial Sequence
  Synthetic
aguacccgacggcccccgcgu

SEQ ID NO: 23731 - RNA, 23 nt, Artificial Sequence
  Synthetic
cgaguacccgacggcccccgcgu

SEQ ID NO: 23732 - RNA, 24 nt, Artificial Sequence
  Synthetic
ccgaguacccgacggcccccgcgu

SEQ ID NO: 23733 - RNA, 18 nt, Artificial Sequence
  Synthetic
uggccccuccgggggggu

SEQ ID NO: 23734 - RNA, 19 nt, Artificial Sequence
  Synthetic
cuggccccuccgggggggu

SEQ ID NO: 23735 - RNA, 20 nt, Artificial Sequence
  Synthetic
ucuggccccuccgggggggu

SEQ ID NO: 23736 - RNA, 22 nt, Artificial Sequence
  Synthetic
cgucuggccccuccgggggggu

SEQ ID NO: 23737 - RNA, 18 nt, Artificial Sequence
  Synthetic
cuccggggggguuggggu

SEQ ID NO: 23738 - RNA, 19 nt, Artificial Sequence
  Synthetic
ccuccggggggguuggggu

SEQ ID NO: 23739 - RNA, 20 nt, Artificial Sequence
  Synthetic
cccuccggggggguuggggu

SEQ ID NO: 23740 - RNA, 21 nt, Artificial Sequence
  Synthetic
ccccuccggggggguuggggu

SEQ ID NO: 23741 - RNA, 24 nt, Artificial Sequence
  Synthetic
uggccccuccggggggguuggggu

SEQ ID NO: 23742 - RNA, 21 nt, Artificial Sequence
  Synthetic
cggggggguugggguuggggu

SEQ ID NO: 23743 - RNA, 22 nt, Artificial Sequence
  Synthetic
ccggggggguugggguuggggu

SEQ ID NO: 23744 - RNA, 23 nt, Artificial Sequence
  Synthetic
uccggggggguugggguuggggu

SEQ ID NO: 23745 - RNA, 24 nt, Artificial Sequence
  Synthetic
cuccggggggguugggguuggggu

SEQ ID NO: 23746 - RNA, 18 nt, Artificial Sequence
  Synthetic
gggcgggucuguugacaa

SEQ ID NO: 23747 - RNA, 19 nt, Artificial Sequence
  Synthetic
ggggcgggucuguugacaa

SEQ ID NO: 23748 - RNA, 20 nt, Artificial Sequence
  Synthetic
gggggcgggucuguugacaa

SEQ ID NO: 23749 - RNA, 21 nt, Artificial Sequence
  Synthetic
ggggggcgggucuguugacaa

SEQ ID NO: 23750 - RNA, 22 nt, Artificial Sequence
  Synthetic
aggggggcgggucuguugacaa

SEQ ID NO: 23751 - RNA, 23 nt, Artificial Sequence
  Synthetic
aaggggggcgggucuguugacaa

SEQ ID NO: 23752 - RNA, 24 nt, Artificial Sequence
  Synthetic
caaggggggcgggucuguugacaa

SEQ ID NO: 23753 - RNA, 18 nt, Artificial Sequence
  Synthetic
ggucucuguuguuugcaa

SEQ ID NO: 23754 - RNA, 19 nt, Artificial Sequence
  Synthetic
gggucucuguuguuugcaa

SEQ ID NO: 23755 - RNA, 20 nt, Artificial Sequence
  Synthetic
ggggucucuguuguuugcaa

SEQ ID NO: 23756 - RNA, 21 nt, Artificial Sequence
  Synthetic
uggggucucuguuguuugcaa

SEQ ID NO: 23757 - RNA, 22 nt, Artificial Sequence
  Synthetic
auggggucucuguuguuugcaa

SEQ ID NO: 23758 - RNA, 23 nt, Artificial Sequence
  Synthetic
uauggggucucuguuguuugcaa

SEQ ID NO: 23759 - RNA, 24 nt, Artificial Sequence
  Synthetic
cuauggggucucuguuguuugcaa

SEQ ID NO: 23760 - RNA, 18 nt, Artificial Sequence
  Synthetic
ccgcccgaggaggcggaa

SEQ ID NO: 23761 - RNA, 19 nt, Artificial Sequence
  Synthetic
cccgcccgaggaggcggaa

SEQ ID NO: 23762 - RNA, 20 nt, Artificial Sequence
  Synthetic
ccccgcccgaggaggcggaa

SEQ ID NO: 23763 - RNA, 21 nt, Artificial Sequence
  Synthetic
gccccgcccgaggaggcggaa

SEQ ID NO: 23764 - RNA, 22 nt, Artificial Sequence
  Synthetic
ggccccgcccgaggaggcggaa

SEQ ID NO: 23765 - RNA, 23 nt, Artificial Sequence
  Synthetic
cggccccgcccgaggaggcggaa

SEQ ID NO: 23766 - RNA, 24 nt, Artificial Sequence
  Synthetic
acggccccgcccgaggaggcggaa

SEQ ID NO: 23767 - RNA, 18 nt, Artificial Sequence
  Synthetic
ggggcgggucuguugaca

SEQ ID NO: 23768 - RNA, 19 nt, Artificial Sequence
  Synthetic
gggggcgggucuguugaca

SEQ ID NO: 23769 - RNA, 20 nt, Artificial Sequence
  Synthetic
ggggggcgggucuguugaca

SEQ ID NO: 23770 - RNA, 21 nt, Artificial Sequence
  Synthetic
aggggggcgggucuguugaca

SEQ ID NO: 23771 - RNA, 22 nt, Artificial Sequence
  Synthetic
aaggggggcgggucuguugaca

SEQ ID NO: 23772 - RNA, 23 nt, Artificial Sequence
  Synthetic
caaggggggcgggucuguugaca

SEQ ID NO: 23773 - RNA, 24 nt, Artificial Sequence
  Synthetic
gcaaggggggcgggucuguugaca

SEQ ID NO: 23774 - RNA, 18 nt, Artificial Sequence
  Synthetic
cgaacagcauguucccca

SEQ ID NO: 23775 - RNA, 19 nt, Artificial Sequence
  Synthetic
ucgaacagcauguucccca

SEQ ID NO: 23776 - RNA, 20 nt, Artificial Sequence
  Synthetic
gucgaacagcauguucccca

SEQ ID NO: 23777 - RNA, 21 nt, Artificial Sequence
  Synthetic
ggucgaacagcauguucccca

SEQ ID NO: 23778 - RNA, 22 nt, Artificial Sequence
  Synthetic
uggucgaacagcauguucccca

SEQ ID NO: 23779 - RNA, 23 nt, Artificial Sequence
  Synthetic
cuggucgaacagcauguucccca

SEQ ID NO: 23780 - RNA, 24 nt, Artificial Sequence
  Synthetic
ccuggucgaacagcauguucccca

SEQ ID NO: 23781 - RNA, 18 nt, Artificial Sequence
  Synthetic
aggcggcgcucgcacgca

SEQ ID NO: 23782 - RNA, 19 nt, Artificial Sequence
  Synthetic
gaggcggcgcucgcacgca

SEQ ID NO: 23783 - RNA, 20 nt, Artificial Sequence
  Synthetic
ggaggcggcgcucgcacgca

SEQ ID NO: 23784 - RNA, 21 nt, Artificial Sequence
  Synthetic
cggaggcggcgcucgcacgca

SEQ ID NO: 23785 - RNA, 22 nt, Artificial Sequence
  Synthetic
ccggaggcggcgcucgcacgca

SEQ ID NO: 23786 - RNA, 23 nt, Artificial Sequence
  Synthetic
cccggaggcggcgcucgcacgca

SEQ ID NO: 23787 - RNA, 24 nt, Artificial Sequence
  Synthetic
ccccggaggcggcgcucgcacgca

SEQ ID NO: 23788 - RNA, 18 nt, Artificial Sequence
  Synthetic
gccgaggaggaagaggca

SEQ ID NO: 23789 - RNA, 19 nt, Artificial Sequence
  Synthetic
ggccgaggaggaagaggca

SEQ ID NO: 23790 - RNA, 20 nt, Artificial Sequence
  Synthetic
gggccgaggaggaagaggca

SEQ ID NO: 23791 - RNA, 21 nt, Artificial Sequence
  Synthetic
ggggccgaggaggaagaggca

SEQ ID NO: 23792 - RNA, 22 nt, Artificial Sequence
  Synthetic
cggggccgaggaggaagaggca

SEQ ID NO: 23793 - RNA, 23 nt, Artificial Sequence
  Synthetic
ucggggccgaggaggaagaggca

SEQ ID NO: 23794 - RNA, 24 nt, Artificial Sequence
  Synthetic
gucggggccgaggaggaagaggca

SEQ ID NO: 23795 - RNA, 18 nt, Artificial Sequence
  Synthetic
gggucucuguuguuugca

SEQ ID NO: 23796 - RNA, 19 nt, Artificial Sequence
  Synthetic
ggggucucuguuguuugca

SEQ ID NO: 23797 - RNA, 20 nt, Artificial Sequence
  Synthetic
uggggucucuguuguuugca

SEQ ID NO: 23798 - RNA, 21 nt, Artificial Sequence
  Synthetic
auggggucucuguuguuugca

SEQ ID NO: 23799 - RNA, 22 nt, Artificial Sequence
  Synthetic
uauggggucucuguuguuugca

SEQ ID NO: 23800 - RNA, 23 nt, Artificial Sequence
  Synthetic
cuauggggucucuguuguuugca

SEQ ID NO: 23801 - RNA, 24 nt, Artificial Sequence
  Synthetic
acuauggggucucuguuguuugca

SEQ ID NO: 23802 - RNA, 18 nt, Artificial Sequence
  Synthetic
aggccgccgaggacguca

SEQ ID NO: 23803 - RNA, 19 nt, Artificial Sequence
  Synthetic
gaggccgccgaggacguca

SEQ ID NO: 23804 - RNA, 20 nt, Artificial Sequence
  Synthetic
ggaggccgccgaggacguca

SEQ ID NO: 23805 - RNA, 21 nt, Artificial Sequence
  Synthetic
cggaggccgccgaggacguca

SEQ ID NO: 23806 - RNA, 22 nt, Artificial Sequence
  Synthetic
gcggaggccgccgaggacguca

SEQ ID NO: 23807 - RNA, 23 nt, Artificial Sequence
  Synthetic
ggcggaggccgccgaggacguca

SEQ ID NO: 23808 - RNA, 24 nt, Artificial Sequence
  Synthetic
aggcggaggccgccgaggacguca

SEQ ID NO: 23809 - RNA, 18 nt, Artificial Sequence
  Synthetic
gagacgccccgcccguca

SEQ ID NO: 23810 - RNA, 19 nt, Artificial Sequence
  Synthetic
ugagacgccccgcccguca

SEQ ID NO: 23811 - RNA, 20 nt, Artificial Sequence
  Synthetic
gugagacgccccgcccguca

SEQ ID NO: 23812 - RNA, 21 nt, Artificial Sequence
  Synthetic
cgugagacgccccgcccguca

SEQ ID NO: 23813 - RNA, 22 nt, Artificial Sequence
  Synthetic
gcgugagacgccccgcccguca

SEQ ID NO: 23814 - RNA, 23 nt, Artificial Sequence
  Synthetic
ugcgugagacgccccgcccguca

SEQ ID NO: 23815 - RNA, 24 nt, Artificial Sequence
  Synthetic
cugcgugagacgccccgcccguca

SEQ ID NO: 23816 - RNA, 18 nt, Artificial Sequence
  Synthetic
ucugggggucguucacga

SEQ ID NO: 23817 - RNA, 19 nt, Artificial Sequence
  Synthetic
gucugggggucguucacga

SEQ ID NO: 23818 - RNA, 20 nt, Artificial Sequence
  Synthetic
ggucugggggucguucacga

SEQ ID NO: 23819 - RNA, 21 nt, Artificial Sequence
  Synthetic
gggucugggggucguucacga

SEQ ID NO: 23820 - RNA, 22 nt, Artificial Sequence
  Synthetic
cgggucugggggucguucacga

SEQ ID NO: 23821 - RNA, 23 nt, Artificial Sequence
  Synthetic
gcgggucugggggucguucacga

SEQ ID NO: 23822 - RNA, 24 nt, Artificial Sequence
  Synthetic
ugcgggucugggggucguucacga

SEQ ID NO: 23823 - RNA, 18 nt, Artificial Sequence
  Synthetic
uggcccgaugggcgccga

SEQ ID NO: 23824 - RNA, 19 nt, Artificial Sequence
  Synthetic
guggcccgaugggcgccga

SEQ ID NO: 23825 - RNA, 20 nt, Artificial Sequence
  Synthetic
uguggcccgaugggcgccga

SEQ ID NO: 23826 - RNA, 21 nt, Artificial Sequence
  Synthetic
guguggcccgaugggcgccga

SEQ ID NO: 23827 - RNA, 22 nt, Artificial Sequence
  Synthetic
cguguggcccgaugggcgccga

SEQ ID NO: 23828 - RNA, 23 nt, Artificial Sequence
  Synthetic
ccguguggcccgaugggcgccga

SEQ ID NO: 23829 - RNA, 24 nt, Artificial Sequence
  Synthetic
gccguguggcccgaugggcgccga

SEQ ID NO: 23830 - RNA, 18 nt, Artificial Sequence
  Synthetic
aagcagcgcgggggccga

SEQ ID NO: 23831 - RNA, 19 nt, Artificial Sequence
  Synthetic
gaagcagcgcgggggccga

SEQ ID NO: 23832 - RNA, 20 nt, Artificial Sequence
  Synthetic
agaagcagcgcgggggccga

SEQ ID NO: 23833 - RNA, 21 nt, Artificial Sequence
  Synthetic
cagaagcagcgcgggggccga

SEQ ID NO: 23834 - RNA, 22 nt, Artificial Sequence
  Synthetic
ccagaagcagcgcgggggccga

SEQ ID NO: 23835 - RNA, 23 nt, Artificial Sequence
  Synthetic
cccagaagcagcgcgggggccga

SEQ ID NO: 23836 - RNA, 24 nt, Artificial Sequence
  Synthetic
gcccagaagcagcgcgggggccga

SEQ ID NO: 23837 - RNA, 18 nt, Artificial Sequence
  Synthetic
uggccccugccggcgcga

SEQ ID NO: 23838 - RNA, 19 nt, Artificial Sequence
  Synthetic
uuggccccugccggcgcga

SEQ ID NO: 23839 - RNA, 20 nt, Artificial Sequence
  Synthetic
cuuggccccugccggcgcga

SEQ ID NO: 23840 - RNA, 21 nt, Artificial Sequence
  Synthetic
ucuuggccccugccggcgcga

SEQ ID NO: 23841 - RNA, 22 nt, Artificial Sequence
  Synthetic
cucuuggccccugccggcgcga

SEQ ID NO: 23842 - RNA, 23 nt, Artificial Sequence
  Synthetic
ccucuuggccccugccggcgcga

SEQ ID NO: 23843 - RNA, 24 nt, Artificial Sequence
  Synthetic
cccucuuggccccugccggcgcga

SEQ ID NO: 23844 - RNA, 18 nt, Artificial Sequence
  Synthetic
cuuguucacguaaggcga

SEQ ID NO: 23845 - RNA, 19 nt, Artificial Sequence
  Synthetic
ucuuguucacguaaggcga

SEQ ID NO: 23846 - RNA, 20 nt, Artificial Sequence
  Synthetic
gucuuguucacguaaggcga

SEQ ID NO: 23847 - RNA, 21 nt, Artificial Sequence
  Synthetic
agucuuguucacguaaggcga

SEQ ID NO: 23848 - RNA, 22 nt, Artificial Sequence
  Synthetic
uagucuuguucacguaaggcga

SEQ ID NO: 23849 - RNA, 23 nt, Artificial Sequence
  Synthetic
auagucuuguucacguaaggcga

SEQ ID NO: 23850 - RNA, 24 nt, Artificial Sequence
  Synthetic
gauagucuuguucacguaaggcga

SEQ ID NO: 23851 - RNA, 18 nt, Artificial Sequence
  Synthetic
cuccgggugggugggcga

SEQ ID NO: 23852 - RNA, 19 nt, Artificial Sequence
  Synthetic
gcuccgggugggugggcga

SEQ ID NO: 23853 - RNA, 20 nt, Artificial Sequence
  Synthetic
ggcuccgggugggugggcga

SEQ ID NO: 23854 - RNA, 21 nt, Artificial Sequence
  Synthetic
gggcuccgggugggugggcga

SEQ ID NO: 23855 - RNA, 22 nt, Artificial Sequence
  Synthetic
ugggcuccgggugggugggcga

SEQ ID NO: 23856 - RNA, 23 nt, Artificial Sequence
  Synthetic
gugggcuccgggugggugggcga

SEQ ID NO: 23857 - RNA, 24 nt, Artificial Sequence
  Synthetic
ggugggcuccgggugggugggcga

SEQ ID NO: 23858 - RNA, 18 nt, Artificial Sequence
  Synthetic
agccagggacgagugcga

SEQ ID NO: 23859 - RNA, 19 nt, Artificial Sequence
  Synthetic
gagccagggacgagugcga

SEQ ID NO: 23860 - RNA, 20 nt, Artificial Sequence
  Synthetic
ugagccagggacgagugcga

SEQ ID NO: 23861 - RNA, 21 nt, Artificial Sequence
  Synthetic
cugagccagggacgagugcga

SEQ ID NO: 23862 - RNA, 22 nt, Artificial Sequence
  Synthetic
ccugagccagggacgagugcga

SEQ ID NO: 23863 - RNA, 23 nt, Artificial Sequence
  Synthetic
gccugagccagggacgagugcga

SEQ ID NO: 23864 - RNA, 24 nt, Artificial Sequence
  Synthetic
ggccugagccagggacgagugcga

SEQ ID NO: 23865 - RNA, 18 nt, Artificial Sequence
  Synthetic
ccgccgccuccugcucga

SEQ ID NO: 23866 - RNA, 19 nt, Artificial Sequence
  Synthetic
accgccgccuccugcucga

SEQ ID NO: 23867 - RNA, 20 nt, Artificial Sequence
  Synthetic
caccgccgccuccugcucga

SEQ ID NO: 23868 - RNA, 21 nt, Artificial Sequence
  Synthetic
gcaccgccgccuccugcucga

SEQ ID NO: 23869 - RNA, 22 nt, Artificial Sequence
  Synthetic
cgcaccgccgccuccugcucga

SEQ ID NO: 23870 - RNA, 23 nt, Artificial Sequence
  Synthetic
acgcaccgccgccuccugcucga

SEQ ID NO: 23871 - RNA, 24 nt, Artificial Sequence
  Synthetic
gacgcaccgccgccuccugcucga

SEQ ID NO: 23872 - RNA, 18 nt, Artificial Sequence
  Synthetic
gagcggggcggcgccgga

SEQ ID NO: 23873 - RNA, 19 nt, Artificial Sequence
  Synthetic
ggagcggggcggcgccgga

SEQ ID NO: 23874 - RNA, 20 nt, Artificial Sequence
  Synthetic
gggagcggggcggcgccgga

SEQ ID NO: 23875 - RNA, 21 nt, Artificial Sequence
  Synthetic
ggggagcggggcggcgccgga

SEQ ID NO: 23876 - RNA, 22 nt, Artificial Sequence
  Synthetic
aggggagcggggcggcgccgga

SEQ ID NO: 23877 - RNA, 23 nt, Artificial Sequence
  Synthetic
gaggggagcggggcggcgccgga

SEQ ID NO: 23878 - RNA, 24 nt, Artificial Sequence
  Synthetic
ggaggggagcggggcggcgccgga

SEQ ID NO: 23879 - RNA, 18 nt, Artificial Sequence
  Synthetic
cucgacagaggcggcgga

SEQ ID NO: 23880 - RNA, 19 nt, Artificial Sequence
  Synthetic
gcucgacagaggcggcgga

SEQ ID NO: 23881 - RNA, 20 nt, Artificial Sequence
  Synthetic
ugcucgacagaggcggcgga

SEQ ID NO: 23882 - RNA, 21 nt, Artificial Sequence
  Synthetic
cugcucgacagaggcggcgga

SEQ ID NO: 23883 - RNA, 22 nt, Artificial Sequence
  Synthetic
ccugcucgacagaggcggcgga

SEQ ID NO: 23884 - RNA, 23 nt, Artificial Sequence
  Synthetic
uccugcucgacagaggcggcgga

SEQ ID NO: 23885 - RNA, 24 nt, Artificial Sequence
  Synthetic
cuccugcucgacagaggcggcgga

SEQ ID NO: 23886 - RNA, 18 nt, Artificial Sequence
  Synthetic
ccccggcccugagucgga

SEQ ID NO: 23887 - RNA, 19 nt, Artificial Sequence
  Synthetic
cccccggcccugagucgga

SEQ ID NO: 23888 - RNA, 20 nt, Artificial Sequence
  Synthetic
ccccccggcccugagucgga

SEQ ID NO: 23889 - RNA, 21 nt, Artificial Sequence
  Synthetic
cccccccggcccugagucgga

SEQ ID NO: 23890 - RNA, 22 nt, Artificial Sequence
  Synthetic
gcccccccggcccugagucgga

SEQ ID NO: 23891 - RNA, 23 nt, Artificial Sequence
  Synthetic
cgcccccccggcccugagucgga

SEQ ID NO: 23892 - RNA, 24 nt, Artificial Sequence
  Synthetic
gcgcccccccggcccugagucgga

SEQ ID NO: 23893 - RNA, 18 nt, Artificial Sequence
  Synthetic
cagaggcggcggagggga

SEQ ID NO: 23894 - RNA, 19 nt, Artificial Sequence
  Synthetic
acagaggcggcggagggga

SEQ ID NO: 23895 - RNA, 20 nt, Artificial Sequence
  Synthetic
gacagaggcggcggagggga

SEQ ID NO: 23896 - RNA, 21 nt, Artificial Sequence
  Synthetic
cgacagaggcggcggagggga

SEQ ID NO: 23897 - RNA, 22 nt, Artificial Sequence
  Synthetic
ucgacagaggcggcggagggga

SEQ ID NO: 23898 - RNA, 23 nt, Artificial Sequence
  Synthetic
cucgacagaggcggcggagggga

SEQ ID NO: 23899 - RNA, 24 nt, Artificial Sequence
  Synthetic
gcucgacagaggcggcggagggga

SEQ ID NO: 23900 - RNA, 18 nt, Artificial Sequence
  Synthetic
gagggggggacgcgugga

SEQ ID NO: 23901 - RNA, 19 nt, Artificial Sequence
  Synthetic
cgagggggggacgcgugga

SEQ ID NO: 23902 - RNA, 20 nt, Artificial Sequence
  Synthetic
gcgagggggggacgcgugga

SEQ ID NO: 23903 - RNA, 21 nt, Artificial Sequence
  Synthetic
cgcgagggggggacgcgugga

SEQ ID NO: 23904 - RNA, 22 nt, Artificial Sequence
  Synthetic
gcgcgagggggggacgcgugga

SEQ ID NO: 23905 - RNA, 23 nt, Artificial Sequence
  Synthetic
ggcgcgagggggggacgcgugga

SEQ ID NO: 23906 - RNA, 24 nt, Artificial Sequence
  Synthetic
cggcgcgagggggggacgcgugga

SEQ ID NO: 23907 - RNA, 18 nt, Artificial Sequence
  Synthetic
guuucccgucugguccac

SEQ ID NO: 23908 - RNA, 19 nt, Artificial Sequence
  Synthetic
uguuucccgucugguccac

SEQ ID NO: 23909 - RNA, 20 nt, Artificial Sequence
  Synthetic
auguuucccgucugguccac

SEQ ID NO: 23910 - RNA, 21 nt, Artificial Sequence
  Synthetic
cauguuucccgucugguccac

SEQ ID NO: 23911 - RNA, 22 nt, Artificial Sequence
  Synthetic
ccauguuucccgucugguccac

SEQ ID NO: 23912 - RNA, 23 nt, Artificial Sequence
  Synthetic
gccauguuucccgucugguccac

SEQ ID NO: 23913 - RNA, 24 nt, Artificial Sequence
  Synthetic
cgccauguuucccgucugguccac

SEQ ID NO: 23914 - RNA, 18 nt, Artificial Sequence
  Synthetic
agacgccccgcccgucac

SEQ ID NO: 23915 - RNA, 19 nt, Artificial Sequence
  Synthetic
gagacgccccgcccgucac

SEQ ID NO: 23916 - RNA, 20 nt, Artificial Sequence
  Synthetic
ugagacgccccgcccgucac

SEQ ID NO: 23917 - RNA, 21 nt, Artificial Sequence
  Synthetic
gugagacgccccgcccgucac

SEQ ID NO: 23918 - RNA, 22 nt, Artificial Sequence
  Synthetic
cgugagacgccccgcccgucac

SEQ ID NO: 23919 - RNA, 23 nt, Artificial Sequence
  Synthetic
gcgugagacgccccgcccgucac

SEQ ID NO: 23920 - RNA, 24 nt, Artificial Sequence
  Synthetic
ugcgugagacgccccgcccgucac

SEQ ID NO: 23921 - RNA, 18 nt, Artificial Sequence
  Synthetic
aggcuguuccacuccgac

SEQ ID NO: 23922 - RNA, 19 nt, Artificial Sequence
  Synthetic
gaggcuguuccacuccgac

SEQ ID NO: 23923 - RNA, 20 nt, Artificial Sequence
  Synthetic
agaggcuguuccacuccgac

SEQ ID NO: 23924 - RNA, 21 nt, Artificial Sequence
  Synthetic
cagaggcuguuccacuccgac

SEQ ID NO: 23925 - RNA, 22 nt, Artificial Sequence
  Synthetic
ccagaggcuguuccacuccgac

SEQ ID NO: 23926 - RNA, 23 nt, Artificial Sequence
  Synthetic
uccagaggcuguuccacuccgac

SEQ ID NO: 23927 - RNA, 24 nt, Artificial Sequence
  Synthetic
auccagaggcuguuccacuccgac

SEQ ID NO: 23928 - RNA, 18 nt, Artificial Sequence
  Synthetic
gccagggacgagugcgac

SEQ ID NO: 23929 - RNA, 19 nt, Artificial Sequence
  Synthetic
agccagggacgagugcgac

SEQ ID NO: 23930 - RNA, 20 nt, Artificial Sequence
  Synthetic
gagccagggacgagugcgac

SEQ ID NO: 23931 - RNA, 21 nt, Artificial Sequence
  Synthetic
ugagccagggacgagugcgac

SEQ ID NO: 23932 - RNA, 22 nt, Artificial Sequence
  Synthetic
cugagccagggacgagugcgac

SEQ ID NO: 23933 - RNA, 23 nt, Artificial Sequence
  Synthetic
ccugagccagggacgagugcgac

SEQ ID NO: 23934 - RNA, 24 nt, Artificial Sequence
  Synthetic
gccugagccagggacgagugcgac

SEQ ID NO: 23935 - RNA, 18 nt, Artificial Sequence
  Synthetic
cccgacgcggccgcggac

SEQ ID NO: 23936 - RNA, 19 nt, Artificial Sequence
  Synthetic
ucccgacgcggccgcggac

SEQ ID NO: 23937 - RNA, 20 nt, Artificial Sequence
  Synthetic
gucccgacgcggccgcggac

SEQ ID NO: 23938 - RNA, 21 nt, Artificial Sequence
  Synthetic
ggucccgacgcggccgcggac

SEQ ID NO: 23939 - RNA, 22 nt, Artificial Sequence
  Synthetic
gggucccgacgcggccgcggac

SEQ ID NO: 23940 - RNA, 23 nt, Artificial Sequence
  Synthetic
cgggucccgacgcggccgcggac

SEQ ID NO: 23941 - RNA, 24 nt, Artificial Sequence
  Synthetic
gcgggucccgacgcggccgcggac

SEQ ID NO: 23942 - RNA, 18 nt, Artificial Sequence
  Synthetic
agggggggacgcguggac

SEQ ID NO: 23943 - RNA, 19 nt, Artificial Sequence
  Synthetic
gagggggggacgcguggac

SEQ ID NO: 23944 - RNA, 20 nt, Artificial Sequence
  Synthetic
cgagggggggacgcguggac

SEQ ID NO: 23945 - RNA, 21 nt, Artificial Sequence
  Synthetic
gcgagggggggacgcguggac

SEQ ID NO: 23946 - RNA, 22 nt, Artificial Sequence
  Synthetic
cgcgagggggggacgcguggac

SEQ ID NO: 23947 - RNA, 23 nt, Artificial Sequence
  Synthetic
gcgcgagggggggacgcguggac

SEQ ID NO: 23948 - RNA, 24 nt, Artificial Sequence
  Synthetic
ggcgcgagggggggacgcguggac

SEQ ID NO: 23949 - RNA, 18 nt, Artificial Sequence
  Synthetic
gggggcgggucuguugac

SEQ ID NO: 23950 - RNA, 19 nt, Artificial Sequence
  Synthetic
ggggggcgggucuguugac

SEQ ID NO: 23951 - RNA, 20 nt, Artificial Sequence
  Synthetic
aggggggcgggucuguugac

SEQ ID NO: 23952 - RNA, 21 nt, Artificial Sequence
  Synthetic
aaggggggcgggucuguugac

SEQ ID NO: 23953 - RNA, 22 nt, Artificial Sequence
  Synthetic
caaggggggcgggucuguugac

SEQ ID NO: 23954 - RNA, 23 nt, Artificial Sequence
  Synthetic
gcaaggggggcgggucuguugac

SEQ ID NO: 23955 - RNA, 24 nt, Artificial Sequence
  Synthetic
ugcaaggggggcgggucuguugac

SEQ ID NO: 23956 - RNA, 18 nt, Artificial Sequence
  Synthetic
gcgggggccgucggguac

SEQ ID NO: 23957 - RNA, 19 nt, Artificial Sequence
  Synthetic
cgcgggggccgucggguac

SEQ ID NO: 23958 - RNA, 20 nt, Artificial Sequence
  Synthetic
acgcgggggccgucggguac

SEQ ID NO: 23959 - RNA, 21 nt, Artificial Sequence
  Synthetic
gacgcgggggccgucggguac

SEQ ID NO: 23960 - RNA, 22 nt, Artificial Sequence
  Synthetic
cgacgcgggggccgucggguac

SEQ ID NO: 23961 - RNA, 23 nt, Artificial Sequence
  Synthetic
ccgacgcgggggccgucggguac

SEQ ID NO: 23962 - RNA, 24 nt, Artificial Sequence
  Synthetic
uccgacgcgggggccgucggguac

SEQ ID NO: 23963 - RNA, 18 nt, Artificial Sequence
  Synthetic
cccccagggucagguacc

SEQ ID NO: 23964 - RNA, 19 nt, Artificial Sequence
  Synthetic
ccccccagggucagguacc

SEQ ID NO: 23965 - RNA, 20 nt, Artificial Sequence
  Synthetic
cccccccagggucagguacc

SEQ ID NO: 23966 - RNA, 21 nt, Artificial Sequence
  Synthetic
gcccccccagggucagguacc

SEQ ID NO: 23967 - RNA, 22 nt, Artificial Sequence
  Synthetic
ugcccccccagggucagguacc

SEQ ID NO: 23968 - RNA, 23 nt, Artificial Sequence
  Synthetic
gugcccccccagggucagguacc

SEQ ID NO: 23969 - RNA, 24 nt, Artificial Sequence
  Synthetic
ugugcccccccagggucagguacc

SEQ ID NO: 23970 - RNA, 18 nt, Artificial Sequence
  Synthetic
cgaccacgcuagagaccc

SEQ ID NO: 23971 - RNA, 19 nt, Artificial Sequence
  Synthetic
gcgaccacgcuagagaccc

SEQ ID NO: 23972 - RNA, 20 nt, Artificial Sequence
  Synthetic
ggcgaccacgcuagagaccc

SEQ ID NO: 23973 - RNA, 21 nt, Artificial Sequence
  Synthetic
gggcgaccacgcuagagaccc

SEQ ID NO: 23974 - RNA, 22 nt, Artificial Sequence
  Synthetic
agggcgaccacgcuagagaccc

SEQ ID NO: 23975 - RNA, 23 nt, Artificial Sequence
  Synthetic
cagggcgaccacgcuagagaccc

SEQ ID NO: 23976 - RNA, 24 nt, Artificial Sequence
  Synthetic
acagggcgaccacgcuagagaccc

SEQ ID NO: 23977 - RNA, 18 nt, Artificial Sequence
  Synthetic
accccaaccccaaccccc

SEQ ID NO: 23978 - RNA, 19 nt, Artificial Sequence
  Synthetic
aaccccaaccccaaccccc

SEQ ID NO: 23979 - RNA, 20 nt, Artificial Sequence
  Synthetic
caaccccaaccccaaccccc

SEQ ID NO: 23980 - RNA, 21 nt, Artificial Sequence
  Synthetic
ccaaccccaaccccaaccccc

SEQ ID NO: 23981 - RNA, 22 nt, Artificial Sequence
  Synthetic
cccaaccccaaccccaaccccc

SEQ ID NO: 23982 - RNA, 23 nt, Artificial Sequence
  Synthetic
ccccaaccccaaccccaaccccc

SEQ ID NO: 23983 - RNA, 24 nt, Artificial Sequence
  Synthetic
accccaaccccaaccccaaccccc

SEQ ID NO: 23984 - RNA, 18 nt, Artificial Sequence
  Synthetic
ccccaaccccaacccccc

SEQ ID NO: 23985 - RNA, 19 nt, Artificial Sequence
  Synthetic
accccaaccccaacccccc

SEQ ID NO: 23986 - RNA, 20 nt, Artificial Sequence
  Synthetic
aaccccaaccccaacccccc

SEQ ID NO: 23987 - RNA, 21 nt, Artificial Sequence
  Synthetic
caaccccaaccccaacccccc

SEQ ID NO: 23988 - RNA, 22 nt, Artificial Sequence
  Synthetic
ccaaccccaaccccaacccccc

SEQ ID NO: 23989 - RNA, 23 nt, Artificial Sequence
  Synthetic
cccaaccccaaccccaacccccc

SEQ ID NO: 23990 - RNA, 24 nt, Artificial Sequence
  Synthetic
ccccaaccccaaccccaacccccc

SEQ ID NO: 23991 - RNA, 18 nt, Artificial Sequence
  Synthetic
ccuccacgcccggccccc

SEQ ID NO: 23992 - RNA, 19 nt, Artificial Sequence
  Synthetic
cccuccacgcccggccccc

SEQ ID NO: 23993 - RNA, 20 nt, Artificial Sequence
  Synthetic
acccuccacgcccggccccc

SEQ ID NO: 23994 - RNA, 21 nt, Artificial Sequence
  Synthetic
cacccuccacgcccggccccc

SEQ ID NO: 23995 - RNA, 22 nt, Artificial Sequence
  Synthetic
ccacccuccacgcccggccccc

SEQ ID NO: 23996 - RNA, 23 nt, Artificial Sequence
  Synthetic
cccacccuccacgcccggccccc

SEQ ID NO: 23997 - RNA, 24 nt, Artificial Sequence
  Synthetic
gcccacccuccacgcccggccccc

SEQ ID NO: 23998 - RNA, 18 nt, Artificial Sequence
  Synthetic
gcggaagaggcggccccc

SEQ ID NO: 23999 - RNA, 19 nt, Artificial Sequence
  Synthetic
ggcggaagaggcggccccc

SEQ ID NO: 24000 - RNA, 20 nt, Artificial Sequence
  Synthetic
cggcggaagaggcggccccc

SEQ ID NO: 24001 - RNA, 21 nt, Artificial Sequence
  Synthetic
gcggcggaagaggcggccccc

SEQ ID NO: 24002 - RNA, 22 nt, Artificial Sequence
  Synthetic
ggcggcggaagaggcggccccc

SEQ ID NO: 24003 - RNA, 23 nt, Artificial Sequence
  Synthetic
cggcggcggaagaggcggccccc

SEQ ID NO: 24004 - RNA, 24 nt, Artificial Sequence
  Synthetic
ccggcggcggaagaggcggccccc

SEQ ID NO: 24005 - RNA, 18 nt, Artificial Sequence
  Synthetic
ggcggccggcuccgcccc

SEQ ID NO: 24006 - RNA, 19 nt, Artificial Sequence
  Synthetic
gggcggccggcuccgcccc

SEQ ID NO: 24007 - RNA, 20 nt, Artificial Sequence
  Synthetic
cgggcggccggcuccgcccc

SEQ ID NO: 24008 - RNA, 21 nt, Artificial Sequence
  Synthetic
gcgggcggccggcuccgcccc

SEQ ID NO: 24009 - RNA, 22 nt, Artificial Sequence
  Synthetic
ggcgggcggccggcuccgcccc

SEQ ID NO: 24010 - RNA, 23 nt, Artificial Sequence
  Synthetic
gggcgggcggccggcuccgcccc

SEQ ID NO: 24011 - RNA, 24 nt, Artificial Sequence
  Synthetic
ggggcgggcggccggcuccgcccc

SEQ ID NO: 24012 - RNA, 18 nt, Artificial Sequence
  Synthetic
ucgaacagcauguucccc

SEQ ID NO: 24013 - RNA, 19 nt, Artificial Sequence
  Synthetic
gucgaacagcauguucccc

SEQ ID NO: 24014 - RNA, 20 nt, Artificial Sequence
  Synthetic
ggucgaacagcauguucccc

SEQ ID NO: 24015 - RNA, 21 nt, Artificial Sequence
  Synthetic
uggucgaacagcauguucccc

SEQ ID NO: 24016 - RNA, 22 nt, Artificial Sequence
  Synthetic
cuggucgaacagcauguucccc

SEQ ID NO: 24017 - RNA, 23 nt, Artificial Sequence
  Synthetic
ccuggucgaacagcauguucccc

SEQ ID NO: 24018 - RNA, 24 nt, Artificial Sequence
  Synthetic
cccuggucgaacagcauguucccc

SEQ ID NO: 24019 - RNA, 18 nt, Artificial Sequence
  Synthetic
gcaccgacggccccgccc

SEQ ID NO: 24020 - RNA, 19 nt, Artificial Sequence
  Synthetic
ggcaccgacggccccgccc

SEQ ID NO: 24021 - RNA, 20 nt, Artificial Sequence
  Synthetic
gggcaccgacggccccgccc

SEQ ID NO: 24022 - RNA, 21 nt, Artificial Sequence
  Synthetic
agggcaccgacggccccgccc

SEQ ID NO: 24023 - RNA, 22 nt, Artificial Sequence
  Synthetic
cagggcaccgacggccccgccc

SEQ ID NO: 24024 - RNA, 23 nt, Artificial Sequence
  Synthetic
ccagggcaccgacggccccgccc

SEQ ID NO: 24025 - RNA, 24 nt, Artificial Sequence
  Synthetic
cccagggcaccgacggccccgccc

SEQ ID NO: 24026 - RNA, 18 nt, Artificial Sequence
  Synthetic
uagcgcgugaggccgccc

SEQ ID NO: 24027 - RNA, 19 nt, Artificial Sequence
  Synthetic
guagcgcgugaggccgccc

SEQ ID NO: 24028 - RNA, 20 nt, Artificial Sequence
  Synthetic
gguagcgcgugaggccgccc

SEQ ID NO: 24029 - RNA, 21 nt, Artificial Sequence
  Synthetic
agguagcgcgugaggccgccc

SEQ ID NO: 24030 - RNA, 22 nt, Artificial Sequence
  Synthetic
cagguagcgcgugaggccgccc

SEQ ID NO: 24031 - RNA, 23 nt, Artificial Sequence
  Synthetic
gcagguagcgcgugaggccgccc

SEQ ID NO: 24032 - RNA, 24 nt, Artificial Sequence
  Synthetic
ggcagguagcgcgugaggccgccc

SEQ ID NO: 24033 - RNA, 18 nt, Artificial Sequence
  Synthetic
gggcggccggcuccgccc

SEQ ID NO: 24034 - RNA, 19 nt, Artificial Sequence
  Synthetic
cgggcggccggcuccgccc

SEQ ID NO: 24035 - RNA, 20 nt, Artificial Sequence
  Synthetic
gcgggcggccggcuccgccc

SEQ ID NO: 24036 - RNA, 21 nt, Artificial Sequence
  Synthetic
ggcgggcggccggcuccgccc

SEQ ID NO: 24037 - RNA, 22 nt, Artificial Sequence
  Synthetic
gggcgggcggccggcuccgccc

SEQ ID NO: 24038 - RNA, 23 nt, Artificial Sequence
  Synthetic
ggggcgggcggccggcuccgccc

SEQ ID NO: 24039 - RNA, 24 nt, Artificial Sequence
  Synthetic
cggggcgggcggccggcuccgccc

SEQ ID NO: 24040 - RNA, 18 nt, Artificial Sequence
  Synthetic
cgcccgcggggacggccc

SEQ ID NO: 24041 - RNA, 19 nt, Artificial Sequence
  Synthetic
ccgcccgcggggacggccc

SEQ ID NO: 24042 - RNA, 20 nt, Artificial Sequence
  Synthetic
gccgcccgcggggacggccc

SEQ ID NO: 24043 - RNA, 21 nt, Artificial Sequence
  Synthetic
ggccgcccgcggggacggccc

SEQ ID NO: 24044 - RNA, 22 nt, Artificial Sequence
  Synthetic
aggccgcccgcggggacggccc

SEQ ID NO: 24045 - RNA, 23 nt, Artificial Sequence
  Synthetic
gaggccgcccgcggggacggccc

SEQ ID NO: 24046 - RNA, 24 nt, Artificial Sequence
  Synthetic
ugaggccgcccgcggggacggccc

SEQ ID NO: 24047 - RNA, 18 nt, Artificial Sequence
  Synthetic
ggcgcgggggccgggccc

SEQ ID NO: 24048 - RNA, 19 nt, Artificial Sequence
  Synthetic
gggcgcgggggccgggccc

SEQ ID NO: 24049 - RNA, 20 nt, Artificial Sequence
  Synthetic
ggggcgcgggggccgggccc

SEQ ID NO: 24050 - RNA, 21 nt, Artificial Sequence
  Synthetic
cggggcgcgggggccgggccc

SEQ ID NO: 24051 - RNA, 22 nt, Artificial Sequence
  Synthetic
ccggggcgcgggggccgggccc

SEQ ID NO: 24052 - RNA, 23 nt, Artificial Sequence
  Synthetic
gccggggcgcgggggccgggccc

SEQ ID NO: 24053 - RNA, 24 nt, Artificial Sequence
  Synthetic
ggccggggcgcgggggccgggccc

SEQ ID NO: 24054 - RNA, 18 nt, Artificial Sequence
  Synthetic
ggugcggcggcuccagcc

SEQ ID NO: 24055 - RNA, 19 nt, Artificial Sequence
  Synthetic
gggugcggcggcuccagcc

SEQ ID NO: 24056 - RNA, 20 nt, Artificial Sequence
  Synthetic
agggugcggcggcuccagcc

SEQ ID NO: 24057 - RNA, 21 nt, Artificial Sequence
  Synthetic
cagggugcggcggcuccagcc

SEQ ID NO: 24058 - RNA, 22 nt, Artificial Sequence
  Synthetic
gcagggugcggcggcuccagcc

SEQ ID NO: 24059 - RNA, 23 nt, Artificial Sequence
  Synthetic
agcagggugcggcggcuccagcc

SEQ ID NO: 24060 - RNA, 24 nt, Artificial Sequence
  Synthetic
gagcagggugcggcggcuccagcc

SEQ ID NO: 24061 - RNA, 18 nt, Artificial Sequence
  Synthetic
ugguucgcggccugagcc

SEQ ID NO: 24062 - RNA, 19 nt, Artificial Sequence
  Synthetic
uugguucgcggccugagcc

SEQ ID NO: 24063 - RNA, 20 nt, Artificial Sequence
  Synthetic
cuugguucgcggccugagcc

SEQ ID NO: 24064 - RNA, 21 nt, Artificial Sequence
  Synthetic
ucuugguucgcggccugagcc

SEQ ID NO: 24065 - RNA, 22 nt, Artificial Sequence
  Synthetic
uucuugguucgcggccugagcc

SEQ ID NO: 24066 - RNA, 23 nt, Artificial Sequence
  Synthetic
guucuugguucgcggccugagcc

SEQ ID NO: 24067 - RNA, 24 nt, Artificial Sequence
  Synthetic
uguucuugguucgcggccugagcc

SEQ ID NO: 24068 - RNA, 18 nt, Artificial Sequence
  Synthetic
gaagaggcggaggccgcc

SEQ ID NO: 24069 - RNA, 19 nt, Artificial Sequence
  Synthetic
ggaagaggcggaggccgcc

SEQ ID NO: 24070 - RNA, 20 nt, Artificial Sequence
  Synthetic
aggaagaggcggaggccgcc

SEQ ID NO: 24071 - RNA, 21 nt, Artificial Sequence
  Synthetic
gaggaagaggcggaggccgcc

SEQ ID NO: 24072 - RNA, 22 nt, Artificial Sequence
  Synthetic
ggaggaagaggcggaggccgcc

SEQ ID NO: 24073 - RNA, 23 nt, Artificial Sequence
  Synthetic
aggaggaagaggcggaggccgcc

SEQ ID NO: 24074 - RNA, 24 nt, Artificial Sequence
  Synthetic
gaggaggaagaggcggaggccgcc

SEQ ID NO: 24075 - RNA, 18 nt, Artificial Sequence
  Synthetic
cgggcggccggcuccgcc

SEQ ID NO: 24076 - RNA, 19 nt, Artificial Sequence
  Synthetic
gcgggcggccggcuccgcc

SEQ ID NO: 24077 - RNA, 20 nt, Artificial Sequence
  Synthetic
ggcgggcggccggcuccgcc

SEQ ID NO: 24078 - RNA, 21 nt, Artificial Sequence
  Synthetic
gggcgggcggccggcuccgcc

SEQ ID NO: 24079 - RNA, 22 nt, Artificial Sequence
  Synthetic
ggggcgggcggccggcuccgcc

SEQ ID NO: 24080 - RNA, 23 nt, Artificial Sequence
  Synthetic
cggggcgggcggccggcuccgcc

SEQ ID NO: 24081 - RNA, 24 nt, Artificial Sequence
  Synthetic
gcggggcgggcggccggcuccgcc

SEQ ID NO: 24082 - RNA, 18 nt, Artificial Sequence
  Synthetic
gccggagggggcggcgcc

SEQ ID NO: 24083 - RNA, 19 nt, Artificial Sequence
  Synthetic
cgccggagggggcggcgcc

SEQ ID NO: 24084 - RNA, 20 nt, Artificial Sequence
  Synthetic
gcgccggagggggcggcgcc

SEQ ID NO: 24085 - RNA, 21 nt, Artificial Sequence
  Synthetic
ggcgccggagggggcggcgcc

SEQ ID NO: 24086 - RNA, 22 nt, Artificial Sequence
  Synthetic
cggcgccggagggggcggcgcc

SEQ ID NO: 24087 - RNA, 23 nt, Artificial Sequence
  Synthetic
gcggcgccggagggggcggcgcc

SEQ ID NO: 24088 - RNA, 24 nt, Artificial Sequence
  Synthetic
ggcggcgccggagggggcggcgcc

SEQ ID NO: 24089 - RNA, 18 nt, Artificial Sequence
  Synthetic
gagccuggcaugggcgcc

SEQ ID NO: 24090 - RNA, 19 nt, Artificial Sequence
  Synthetic
ggagccuggcaugggcgcc

SEQ ID NO: 24091 - RNA, 20 nt, Artificial Sequence
  Synthetic
cggagccuggcaugggcgcc

SEQ ID NO: 24092 - RNA, 21 nt, Artificial Sequence
  Synthetic
gcggagccuggcaugggcgcc

SEQ ID NO: 24093 - RNA, 22 nt, Artificial Sequence
  Synthetic
ggcggagccuggcaugggcgcc

SEQ ID NO: 24094 - RNA, 23 nt, Artificial Sequence
  Synthetic
gggcggagccuggcaugggcgcc

SEQ ID NO: 24095 - RNA, 24 nt, Artificial Sequence
  Synthetic
ggggcggagccuggcaugggcgcc

SEQ ID NO: 24096 - RNA, 18 nt, Artificial Sequence
  Synthetic
uguggcccgaugggcgcc

SEQ ID NO: 24097 - RNA, 19 nt, Artificial Sequence
  Synthetic
guguggcccgaugggcgcc

SEQ ID NO: 24098 - RNA, 20 nt, Artificial Sequence
  Synthetic
cguguggcccgaugggcgcc

SEQ ID NO: 24099 - RNA, 21 nt, Artificial Sequence
  Synthetic
ccguguggcccgaugggcgcc

SEQ ID NO: 24100 - RNA, 22 nt, Artificial Sequence
  Synthetic
gccguguggcccgaugggcgcc

SEQ ID NO: 24101 - RNA, 23 nt, Artificial Sequence
  Synthetic
ugccguguggcccgaugggcgcc

SEQ ID NO: 24102 - RNA, 24 nt, Artificial Sequence
  Synthetic
cugccguguggcccgaugggcgcc

SEQ ID NO: 24103 - RNA, 18 nt, Artificial Sequence
  Synthetic
ggccuguggggagaggcc

SEQ ID NO: 24104 - RNA, 19 nt, Artificial Sequence
  Synthetic
gggccuguggggagaggcc

SEQ ID NO: 24105 - RNA, 20 nt, Artificial Sequence
  Synthetic
ggggccuguggggagaggcc

SEQ ID NO: 24106 - RNA, 21 nt, Artificial Sequence
  Synthetic
gggggccuguggggagaggcc

SEQ ID NO: 24107 - RNA, 22 nt, Artificial Sequence
  Synthetic
ggggggccuguggggagaggcc

SEQ ID NO: 24108 - RNA, 23 nt, Artificial Sequence
  Synthetic
cggggggccuguggggagaggcc

SEQ ID NO: 24109 - RNA, 24 nt, Artificial Sequence
  Synthetic
gcggggggccuguggggagaggcc

SEQ ID NO: 24110 - RNA, 18 nt, Artificial Sequence
  Synthetic
ccgcccgcggggacggcc

SEQ ID NO: 24111 - RNA, 19 nt, Artificial Sequence
  Synthetic
gccgcccgcggggacggcc

SEQ ID NO: 24112 - RNA, 20 nt, Artificial Sequence
  Synthetic
ggccgcccgcggggacggcc

SEQ ID NO: 24113 - RNA, 21 nt, Artificial Sequence
  Synthetic
aggccgcccgcggggacggcc

SEQ ID NO: 24114 - RNA, 22 nt, Artificial Sequence
  Synthetic
gaggccgcccgcggggacggcc

SEQ ID NO: 24115 - RNA, 23 nt, Artificial Sequence
  Synthetic
ugaggccgcccgcggggacggcc

SEQ ID NO: 24116 - RNA, 24 nt, Artificial Sequence
  Synthetic
gugaggccgcccgcggggacggcc

SEQ ID NO: 24117 - RNA, 18 nt, Artificial Sequence
  Synthetic
gcgggucccgacgcggcc

SEQ ID NO: 24118 - RNA, 19 nt, Artificial Sequence
  Synthetic
cgcgggucccgacgcggcc

SEQ ID NO: 24119 - RNA, 20 nt, Artificial Sequence
  Synthetic
gcgcgggucccgacgcggcc

SEQ ID NO: 24120 - RNA, 21 nt, Artificial Sequence
  Synthetic
cgcgcgggucccgacgcggcc

SEQ ID NO: 24121 - RNA, 22 nt, Artificial Sequence
  Synthetic
gcgcgcgggucccgacgcggcc

SEQ ID NO: 24122 - RNA, 23 nt, Artificial Sequence
  Synthetic
ggcgcgcgggucccgacgcggcc

SEQ ID NO: 24123 - RNA, 24 nt, Artificial Sequence
  Synthetic
gggcgcgcgggucccgacgcggcc

SEQ ID NO: 24124 - RNA, 18 nt, Artificial Sequence
  Synthetic
uccucggcccccgcggcc

SEQ ID NO: 24125 - RNA, 19 nt, Artificial Sequence
  Synthetic
uuccucggcccccgcggcc

SEQ ID NO: 24126 - RNA, 20 nt, Artificial Sequence
  Synthetic
cuuccucggcccccgcggcc

SEQ ID NO: 24127 - RNA, 21 nt, Artificial Sequence
  Synthetic
acuuccucggcccccgcggcc

SEQ ID NO: 24128 - RNA, 22 nt, Artificial Sequence
  Synthetic
cacuuccucggcccccgcggcc

SEQ ID NO: 24129 - RNA, 23 nt, Artificial Sequence
  Synthetic
acacuuccucggcccccgcggcc

SEQ ID NO: 24130 - RNA, 24 nt, Artificial Sequence
  Synthetic
cacacuuccucggcccccgcggcc

SEQ ID NO: 24131 - RNA, 18 nt, Artificial Sequence
  Synthetic
gggcgcgggggccgggcc

SEQ ID NO: 24132 - RNA, 19 nt, Artificial Sequence
  Synthetic
ggggcgcgggggccgggcc

SEQ ID NO: 24133 - RNA, 20 nt, Artificial Sequence
  Synthetic
cggggcgcgggggccgggcc

SEQ ID NO: 24134 - RNA, 21 nt, Artificial Sequence
  Synthetic
ccggggcgcgggggccgggcc

SEQ ID NO: 24135 - RNA, 22 nt, Artificial Sequence
  Synthetic
gccggggcgcgggggccgggcc

SEQ ID NO: 24136 - RNA, 23 nt, Artificial Sequence
  Synthetic
ggccggggcgcgggggccgggcc

SEQ ID NO: 24137 - RNA, 24 nt, Artificial Sequence
  Synthetic
gggccggggcgcgggggccgggcc

SEQ ID NO: 24138 - RNA, 18 nt, Artificial Sequence
  Synthetic
cccgcgggggucggggcc

SEQ ID NO: 24139 - RNA, 19 nt, Artificial Sequence
  Synthetic
ccccgcgggggucggggcc

SEQ ID NO: 24140 - RNA, 20 nt, Artificial Sequence
  Synthetic
cccccgcgggggucggggcc

SEQ ID NO: 24141 - RNA, 21 nt, Artificial Sequence
  Synthetic
gcccccgcgggggucggggcc

SEQ ID NO: 24142 - RNA, 22 nt, Artificial Sequence
  Synthetic
ggcccccgcgggggucggggcc

SEQ ID NO: 24143 - RNA, 23 nt, Artificial Sequence
  Synthetic
cggcccccgcgggggucggggcc

SEQ ID NO: 24144 - RNA, 24 nt, Artificial Sequence
  Synthetic
gcggcccccgcgggggucggggcc

SEQ ID NO: 24145 - RNA, 18 nt, Artificial Sequence
  Synthetic
agaagcagcgcgggggcc

SEQ ID NO: 24146 - RNA, 19 nt, Artificial Sequence
  Synthetic
cagaagcagcgcgggggcc

SEQ ID NO: 24147 - RNA, 20 nt, Artificial Sequence
  Synthetic
ccagaagcagcgcgggggcc

SEQ ID NO: 24148 - RNA, 21 nt, Artificial Sequence
  Synthetic
cccagaagcagcgcgggggcc

SEQ ID NO: 24149 - RNA, 22 nt, Artificial Sequence
  Synthetic
gcccagaagcagcgcgggggcc

SEQ ID NO: 24150 - RNA, 23 nt, Artificial Sequence
  Synthetic
ggcccagaagcagcgcgggggcc

SEQ ID NO: 24151 - RNA, 24 nt, Artificial Sequence
  Synthetic
cggcccagaagcagcgcgggggcc

SEQ ID NO: 24152 - RNA, 18 nt, Artificial Sequence
  Synthetic
ccgcggacgcggggggcc

SEQ ID NO: 24153 - RNA, 19 nt, Artificial Sequence
  Synthetic
gccgcggacgcggggggcc

SEQ ID NO: 24154 - RNA, 20 nt, Artificial Sequence
  Synthetic
ggccgcggacgcggggggcc

SEQ ID NO: 24155 - RNA, 21 nt, Artificial Sequence
  Synthetic
cggccgcggacgcggggggcc

SEQ ID NO: 24156 - RNA, 22 nt, Artificial Sequence
  Synthetic
gcggccgcggacgcggggggcc

SEQ ID NO: 24157 - RNA, 23 nt, Artificial Sequence
  Synthetic
cgcggccgcggacgcggggggcc

SEQ ID NO: 24158 - RNA, 24 nt, Artificial Sequence
  Synthetic
acgcggccgcggacgcggggggcc

SEQ ID NO: 24159 - RNA, 18 nt, Artificial Sequence
  Synthetic
uuccucuugucucccucc

SEQ ID NO: 24160 - RNA, 19 nt, Artificial Sequence
  Synthetic
uuuccucuugucucccucc

SEQ ID NO: 24161 - RNA, 20 nt, Artificial Sequence
  Synthetic
guuuccucuugucucccucc

SEQ ID NO: 24162 - RNA, 21 nt, Artificial Sequence
  Synthetic
gguuuccucuugucucccucc

SEQ ID NO: 24163 - RNA, 22 nt, Artificial Sequence
  Synthetic
agguuuccucuugucucccucc

SEQ ID NO: 24164 - RNA, 23 nt, Artificial Sequence
  Synthetic
gagguuuccucuugucucccucc

SEQ ID NO: 24165 - RNA, 24 nt, Artificial Sequence
  Synthetic
ggagguuuccucuugucucccucc

SEQ ID NO: 24166 - RNA, 18 nt, Artificial Sequence
  Synthetic
gucgacgcccccugcucc

SEQ ID NO: 24167 - RNA, 19 nt, Artificial Sequence
  Synthetic
ggucgacgcccccugcucc

SEQ ID NO: 24168 - RNA, 20 nt, Artificial Sequence
  Synthetic
gggucgacgcccccugcucc

SEQ ID NO: 24169 - RNA, 21 nt, Artificial Sequence
  Synthetic
cgggucgacgcccccugcucc

SEQ ID NO: 24170 - RNA, 22 nt, Artificial Sequence
  Synthetic
ccgggucgacgcccccugcucc

SEQ ID NO: 24171 - RNA, 23 nt, Artificial Sequence
  Synthetic
cccgggucgacgcccccugcucc

SEQ ID NO: 24172 - RNA, 24 nt, Artificial Sequence
  Synthetic
ucccgggucgacgcccccugcucc

SEQ ID NO: 24173 - RNA, 18 nt, Artificial Sequence
  Synthetic
ggcacacggcgcgcgucc

SEQ ID NO: 24174 - RNA, 19 nt, Artificial Sequence
  Synthetic
gggcacacggcgcgcgucc

SEQ ID NO: 24175 - RNA, 20 nt, Artificial Sequence
  Synthetic
ggggcacacggcgcgcgucc

SEQ ID NO: 24176 - RNA, 21 nt, Artificial Sequence
  Synthetic
uggggcacacggcgcgcgucc

SEQ ID NO: 24177 - RNA, 22 nt, Artificial Sequence
  Synthetic
cuggggcacacggcgcgcgucc

SEQ ID NO: 24178 - RNA, 23 nt, Artificial Sequence
  Synthetic
acuggggcacacggcgcgcgucc

SEQ ID NO: 24179 - RNA, 24 nt, Artificial Sequence
  Synthetic
gacuggggcacacggcgcgcgucc

SEQ ID NO: 24180 - RNA, 18 nt, Artificial Sequence
  Synthetic
ccgacccgcgccucuucc

SEQ ID NO: 24181 - RNA, 19 nt, Artificial Sequence
  Synthetic
cccgacccgcgccucuucc

SEQ ID NO: 24182 - RNA, 20 nt, Artificial Sequence
  Synthetic
gcccgacccgcgccucuucc

SEQ ID NO: 24183 - RNA, 21 nt, Artificial Sequence
  Synthetic
ggcccgacccgcgccucuucc

SEQ ID NO: 24184 - RNA, 22 nt, Artificial Sequence
  Synthetic
uggcccgacccgcgccucuucc

SEQ ID NO: 24185 - RNA, 23 nt, Artificial Sequence
  Synthetic
cuggcccgacccgcgccucuucc

SEQ ID NO: 24186 - RNA, 24 nt, Artificial Sequence
  Synthetic
ccuggcccgacccgcgccucuucc

SEQ ID NO: 24187 - RNA, 18 nt, Artificial Sequence
  Synthetic
gggugcggcggcuccagc

SEQ ID NO: 24188 - RNA, 19 nt, Artificial Sequence
  Synthetic
agggugcggcggcuccagc

SEQ ID NO: 24189 - RNA, 20 nt, Artificial Sequence
  Synthetic
cagggugcggcggcuccagc

SEQ ID NO: 24190 - RNA, 21 nt, Artificial Sequence
  Synthetic
gcagggugcggcggcuccagc

SEQ ID NO: 24191 - RNA, 22 nt, Artificial Sequence
  Synthetic
agcagggugcggcggcuccagc

SEQ ID NO: 24192 - RNA, 23 nt, Artificial Sequence
  Synthetic
gagcagggugcggcggcuccagc

SEQ ID NO: 24193 - RNA, 24 nt, Artificial Sequence
  Synthetic
ggagcagggugcggcggcuccagc

SEQ ID NO: 24194 - RNA, 18 nt, Artificial Sequence
  Synthetic
ccgcggcccagaagcagc

SEQ ID NO: 24195 - RNA, 19 nt, Artificial Sequence
  Synthetic
cccgcggcccagaagcagc

SEQ ID NO: 24196 - RNA, 20 nt, Artificial Sequence
  Synthetic
ccccgcggcccagaagcagc

SEQ ID NO: 24197 - RNA, 21 nt, Artificial Sequence
  Synthetic
cccccgcggcccagaagcagc

SEQ ID NO: 24198 - RNA, 22 nt, Artificial Sequence
  Synthetic
gcccccgcggcccagaagcagc

SEQ ID NO: 24199 - RNA, 23 nt, Artificial Sequence
  Synthetic
ggcccccgcggcccagaagcagc

SEQ ID NO: 24200 - RNA, 24 nt, Artificial Sequence
  Synthetic
cggcccccgcggcccagaagcagc

SEQ ID NO: 24201 - RNA, 18 nt, Artificial Sequence
  Synthetic
uugguucgcggccugagc

SEQ ID NO: 24202 - RNA, 19 nt, Artificial Sequence
  Synthetic
cuugguucgcggccugagc

SEQ ID NO: 24203 - RNA, 20 nt, Artificial Sequence
  Synthetic
ucuugguucgcggccugagc

SEQ ID NO: 24204 - RNA, 21 nt, Artificial Sequence
  Synthetic
uucuugguucgcggccugagc

SEQ ID NO: 24205 - RNA, 22 nt, Artificial Sequence
  Synthetic
guucuugguucgcggccugagc

SEQ ID NO: 24206 - RNA, 23 nt, Artificial Sequence
  Synthetic
uguucuugguucgcggccugagc

SEQ ID NO: 24207 - RNA, 24 nt, Artificial Sequence
  Synthetic
cuguucuugguucgcggccugagc

SEQ ID NO: 24208 - RNA, 18 nt, Artificial Sequence
  Synthetic
gcgacagggcgaccacgc

SEQ ID NO: 24209 - RNA, 19 nt, Artificial Sequence
  Synthetic
ggcgacagggcgaccacgc

SEQ ID NO: 24210 - RNA, 20 nt, Artificial Sequence
  Synthetic
aggcgacagggcgaccacgc

SEQ ID NO: 24211 - RNA, 21 nt, Artificial Sequence
  Synthetic
aaggcgacagggcgaccacgc

SEQ ID NO: 24212 - RNA, 22 nt, Artificial Sequence
  Synthetic
uaaggcgacagggcgaccacgc

SEQ ID NO: 24213 - RNA, 23 nt, Artificial Sequence
  Synthetic
guaaggcgacagggcgaccacgc

SEQ ID NO: 24214 - RNA, 24 nt, Artificial Sequence
  Synthetic
cguaaggcgacagggcgaccacgc

SEQ ID NO: 24215 - RNA, 18 nt, Artificial Sequence
  Synthetic
gaggcggcgcucgcacgc

SEQ ID NO: 24216 - RNA, 19 nt, Artificial Sequence
  Synthetic
ggaggcggcgcucgcacgc

SEQ ID NO: 24217 - RNA, 20 nt, Artificial Sequence
  Synthetic
cggaggcggcgcucgcacgc

SEQ ID NO: 24218 - RNA, 21 nt, Artificial Sequence
  Synthetic
ccggaggcggcgcucgcacgc

SEQ ID NO: 24219 - RNA, 22 nt, Artificial Sequence
  Synthetic
cccggaggcggcgcucgcacgc

SEQ ID NO: 24220 - RNA, 23 nt, Artificial Sequence
  Synthetic
ccccggaggcggcgcucgcacgc

SEQ ID NO: 24221 - RNA, 24 nt, Artificial Sequence
  Synthetic
gccccggaggcggcgcucgcacgc

SEQ ID NO: 24222 - RNA, 18 nt, Artificial Sequence
  Synthetic
gcuguuccacuccgacgc

SEQ ID NO: 24223 - RNA, 19 nt, Artificial Sequence
  Synthetic
ggcuguuccacuccgacgc

SEQ ID NO: 24224 - RNA, 20 nt, Artificial Sequence
  Synthetic
aggcuguuccacuccgacgc

SEQ ID NO: 24225 - RNA, 21 nt, Artificial Sequence
  Synthetic
gaggcuguuccacuccgacgc

SEQ ID NO: 24226 - RNA, 22 nt, Artificial Sequence
  Synthetic
agaggcuguuccacuccgacgc

SEQ ID NO: 24227 - RNA, 23 nt, Artificial Sequence
  Synthetic
cagaggcuguuccacuccgacgc

SEQ ID NO: 24228 - RNA, 24 nt, Artificial Sequence
  Synthetic
ccagaggcuguuccacuccgacgc

SEQ ID NO: 24229 - RNA, 18 nt, Artificial Sequence
  Synthetic
cgacgcggccgcggacgc

SEQ ID NO: 24230 - RNA, 19 nt, Artificial Sequence
  Synthetic
ccgacgcggccgcggacgc

SEQ ID NO: 24231 - RNA, 20 nt, Artificial Sequence
  Synthetic
cccgacgcggccgcggacgc

SEQ ID NO: 24232 - RNA, 21 nt, Artificial Sequence
  Synthetic
ucccgacgcggccgcggacgc

SEQ ID NO: 24233 - RNA, 22 nt, Artificial Sequence
  Synthetic
gucccgacgcggccgcggacgc

SEQ ID NO: 24234 - RNA, 23 nt, Artificial Sequence
  Synthetic
ggucccgacgcggccgcggacgc

SEQ ID NO: 24235 - RNA, 24 nt, Artificial Sequence
  Synthetic
gggucccgacgcggccgcggacgc

SEQ ID NO: 24236 - RNA, 18 nt, Artificial Sequence
  Synthetic
ggcgcgagggggggacgc

SEQ ID NO: 24237 - RNA, 19 nt, Artificial Sequence
  Synthetic
cggcgcgagggggggacgc

SEQ ID NO: 24238 - RNA, 20 nt, Artificial Sequence
  Synthetic
ccggcgcgagggggggacgc

SEQ ID NO: 24239 - RNA, 21 nt, Artificial Sequence
  Synthetic
gccggcgcgagggggggacgc

SEQ ID NO: 24240 - RNA, 22 nt, Artificial Sequence
  Synthetic
ugccggcgcgagggggggacgc

SEQ ID NO: 24241 - RNA, 23 nt, Artificial Sequence
  Synthetic
cugccggcgcgagggggggacgc

SEQ ID NO: 24242 - RNA, 24 nt, Artificial Sequence
  Synthetic
ccugccggcgcgagggggggacgc

SEQ ID NO: 24243 - RNA, 18 nt, Artificial Sequence
  Synthetic
gggcaccgacggccccgc

SEQ ID NO: 24244 - RNA, 19 nt, Artificial Sequence
  Synthetic
agggcaccgacggccccgc

SEQ ID NO: 24245 - RNA, 20 nt, Artificial Sequence
  Synthetic
cagggcaccgacggccccgc

SEQ ID NO: 24246 - RNA, 21 nt, Artificial Sequence
  Synthetic
ccagggcaccgacggccccgc

SEQ ID NO: 24247 - RNA, 22 nt, Artificial Sequence
  Synthetic
cccagggcaccgacggccccgc

SEQ ID NO: 24248 - RNA, 23 nt, Artificial Sequence
  Synthetic
ucccagggcaccgacggccccgc

SEQ ID NO: 24249 - RNA, 24 nt, Artificial Sequence
  Synthetic
cucccagggcaccgacggccccgc

SEQ ID NO: 24250 - RNA, 18 nt, Artificial Sequence
  Synthetic
gcgcgugaggccgcccgc

SEQ ID NO: 24251 - RNA, 19 nt, Artificial Sequence
  Synthetic
agcgcgugaggccgcccgc

SEQ ID NO: 24252 - RNA, 20 nt, Artificial Sequence
  Synthetic
uagcgcgugaggccgcccgc

SEQ ID NO: 24253 - RNA, 21 nt, Artificial Sequence
  Synthetic
guagcgcgugaggccgcccgc

SEQ ID NO: 24254 - RNA, 22 nt, Artificial Sequence
  Synthetic
gguagcgcgugaggccgcccgc

SEQ ID NO: 24255 - RNA, 23 nt, Artificial Sequence
  Synthetic
agguagcgcgugaggccgcccgc

SEQ ID NO: 24256 - RNA, 24 nt, Artificial Sequence
  Synthetic
cagguagcgcgugaggccgcccgc

SEQ ID NO: 24257 - RNA, 18 nt, Artificial Sequence
  Synthetic
cggagggggcggcgccgc

SEQ ID NO: 24258 - RNA, 19 nt, Artificial Sequence
  Synthetic
ccggagggggcggcgccgc

SEQ ID NO: 24259 - RNA, 20 nt, Artificial Sequence
  Synthetic
gccggagggggcggcgccgc

SEQ ID NO: 24260 - RNA, 21 nt, Artificial Sequence
  Synthetic
cgccggagggggcggcgccgc

SEQ ID NO: 24261 - RNA, 22 nt, Artificial Sequence
  Synthetic
gcgccggagggggcggcgccgc

SEQ ID NO: 24262 - RNA, 23 nt, Artificial Sequence
  Synthetic
ggcgccggagggggcggcgccgc

SEQ ID NO: 24263 - RNA, 24 nt, Artificial Sequence
  Synthetic
cggcgccggagggggcggcgccgc

SEQ ID NO: 24264 - RNA, 18 nt, Artificial Sequence
  Synthetic
gccuggcaugggcgccgc

SEQ ID NO: 24265 - RNA, 19 nt, Artificial Sequence
  Synthetic
agccuggcaugggcgccgc

SEQ ID NO: 24266 - RNA, 20 nt, Artificial Sequence
  Synthetic
gagccuggcaugggcgccgc

SEQ ID NO: 24267 - RNA, 21 nt, Artificial Sequence
  Synthetic
ggagccuggcaugggcgccgc

SEQ ID NO: 24268 - RNA, 22 nt, Artificial Sequence
  Synthetic
cggagccuggcaugggcgccgc

SEQ ID NO: 24269 - RNA, 23 nt, Artificial Sequence
  Synthetic
gcggagccuggcaugggcgccgc

SEQ ID NO: 24270 - RNA, 24 nt, Artificial Sequence
  Synthetic
ggcggagccuggcaugggcgccgc

SEQ ID NO: 24271 - RNA, 18 nt, Artificial Sequence
  Synthetic
gcacggggccacggccgc

SEQ ID NO: 24272 - RNA, 19 nt, Artificial Sequence
  Synthetic
cgcacggggccacggccgc

SEQ ID NO: 24273 - RNA, 20 nt, Artificial Sequence
  Synthetic
acgcacggggccacggccgc

SEQ ID NO: 24274 - RNA, 21 nt, Artificial Sequence
  Synthetic
cacgcacggggccacggccgc

SEQ ID NO: 24275 - RNA, 22 nt, Artificial Sequence
  Synthetic
gcacgcacggggccacggccgc

SEQ ID NO: 24276 - RNA, 23 nt, Artificial Sequence
  Synthetic
cgcacgcacggggccacggccgc

SEQ ID NO: 24277 - RNA, 24 nt, Artificial Sequence
  Synthetic
ucgcacgcacggggccacggccgc

SEQ ID NO: 24278 - RNA, 18 nt, Artificial Sequence
  Synthetic
gcggcccagaagcagcgc

SEQ ID NO: 24279 - RNA, 19 nt, Artificial Sequence
  Synthetic
cgcggcccagaagcagcgc

SEQ ID NO: 24280 - RNA, 20 nt, Artificial Sequence
  Synthetic
ccgcggcccagaagcagcgc

SEQ ID NO: 24281 - RNA, 21 nt, Artificial Sequence
  Synthetic
cccgcggcccagaagcagcgc

SEQ ID NO: 24282 - RNA, 22 nt, Artificial Sequence
  Synthetic
ccccgcggcccagaagcagcgc

SEQ ID NO: 24283 - RNA, 23 nt, Artificial Sequence
  Synthetic
cccccgcggcccagaagcagcgc

SEQ ID NO: 24284 - RNA, 24 nt, Artificial Sequence
  Synthetic
gcccccgcggcccagaagcagcgc

SEQ ID NO: 24285 - RNA, 18 nt, Artificial Sequence
  Synthetic
gagaugggcagguagcgc

SEQ ID NO: 24286 - RNA, 19 nt, Artificial Sequence
  Synthetic
cgagaugggcagguagcgc

SEQ ID NO: 24287 - RNA, 20 nt, Artificial Sequence
  Synthetic
ccgagaugggcagguagcgc

SEQ ID NO: 24288 - RNA, 21 nt, Artificial Sequence
  Synthetic
cccgagaugggcagguagcgc

SEQ ID NO: 24289 - RNA, 22 nt, Artificial Sequence
  Synthetic
ccccgagaugggcagguagcgc

SEQ ID NO: 24290 - RNA, 23 nt, Artificial Sequence
  Synthetic
cccccgagaugggcagguagcgc

SEQ ID NO: 24291 - RNA, 24 nt, Artificial Sequence
  Synthetic
acccccgagaugggcagguagcgc

SEQ ID NO: 24292 - RNA, 18 nt, Artificial Sequence
  Synthetic
acggggccacggccgcgc

SEQ ID NO: 24293 - RNA, 19 nt, Artificial Sequence
  Synthetic
cacggggccacggccgcgc

SEQ ID NO: 24294 - RNA, 20 nt, Artificial Sequence
  Synthetic
gcacggggccacggccgcgc

SEQ ID NO: 24295 - RNA, 21 nt, Artificial Sequence
  Synthetic
cgcacggggccacggccgcgc

SEQ ID NO: 24296 - RNA, 22 nt, Artificial Sequence
  Synthetic
acgcacggggccacggccgcgc

SEQ ID NO: 24297 - RNA, 23 nt, Artificial Sequence
  Synthetic
cacgcacggggccacggccgcgc

SEQ ID NO: 24298 - RNA, 24 nt, Artificial Sequence
  Synthetic
gcacgcacggggccacggccgcgc

SEQ ID NO: 24299 - RNA, 18 nt, Artificial Sequence
  Synthetic
cuuggccccugccggcgc

SEQ ID NO: 24300 - RNA, 19 nt, Artificial Sequence
  Synthetic
ucuuggccccugccggcgc

SEQ ID NO: 24301 - RNA, 20 nt, Artificial Sequence
  Synthetic
cucuuggccccugccggcgc

SEQ ID NO: 24302 - RNA, 21 nt, Artificial Sequence
  Synthetic
ccucuuggccccugccggcgc

SEQ ID NO: 24303 - RNA, 22 nt, Artificial Sequence
  Synthetic
cccucuuggccccugccggcgc

SEQ ID NO: 24304 - RNA, 23 nt, Artificial Sequence
  Synthetic
gcccucuuggccccugccggcgc

SEQ ID NO: 24305 - RNA, 24 nt, Artificial Sequence
  Synthetic
cgcccucuuggccccugccggcgc

SEQ ID NO: 24306 - RNA, 18 nt, Artificial Sequence
  Synthetic
aggggagcggggcggcgc

SEQ ID NO: 24307 - RNA, 19 nt, Artificial Sequence
  Synthetic
gaggggagcggggcggcgc

SEQ ID NO: 24308 - RNA, 20 nt, Artificial Sequence
  Synthetic
ggaggggagcggggcggcgc

SEQ ID NO: 24309 - RNA, 21 nt, Artificial Sequence
  Synthetic
cggaggggagcggggcggcgc

SEQ ID NO: 24310 - RNA, 22 nt, Artificial Sequence
  Synthetic
gcggaggggagcggggcggcgc

SEQ ID NO: 24311 - RNA, 23 nt, Artificial Sequence
  Synthetic
ggcggaggggagcggggcggcgc

SEQ ID NO: 24312 - RNA, 24 nt, Artificial Sequence
  Synthetic
cggcggaggggagcggggcggcgc

SEQ ID NO: 24313 - RNA, 18 nt, Artificial Sequence
  Synthetic
ccccgggggccggggcgc

SEQ ID NO: 24314 - RNA, 19 nt, Artificial Sequence
  Synthetic
gccccgggggccggggcgc

SEQ ID NO: 24315 - RNA, 20 nt, Artificial Sequence
  Synthetic
cgccccgggggccggggcgc

SEQ ID NO: 24316 - RNA, 21 nt, Artificial Sequence
  Synthetic
ccgccccgggggccggggcgc

SEQ ID NO: 24317 - RNA, 22 nt, Artificial Sequence
  Synthetic
uccgccccgggggccggggcgc

SEQ ID NO: 24318 - RNA, 23 nt, Artificial Sequence
  Synthetic
cuccgccccgggggccggggcgc

SEQ ID NO: 24319 - RNA, 24 nt, Artificial Sequence
  Synthetic
gcuccgccccgggggccggggcgc

SEQ ID NO: 24320 - RNA, 18 nt, Artificial Sequence
  Synthetic
gggccuguggggagaggc

SEQ ID NO: 24321 - RNA, 19 nt, Artificial Sequence
  Synthetic
ggggccuguggggagaggc

SEQ ID NO: 24322 - RNA, 20 nt, Artificial Sequence
  Synthetic
gggggccuguggggagaggc

SEQ ID NO: 24323 - RNA, 21 nt, Artificial Sequence
  Synthetic
ggggggccuguggggagaggc

SEQ ID NO: 24324 - RNA, 22 nt, Artificial Sequence
  Synthetic
cggggggccuguggggagaggc

SEQ ID NO: 24325 - RNA, 23 nt, Artificial Sequence
  Synthetic
gcggggggccuguggggagaggc

SEQ ID NO: 24326 - RNA, 24 nt, Artificial Sequence
  Synthetic
cgcggggggccuguggggagaggc

SEQ ID NO: 24327 - RNA, 18 nt, Artificial Sequence
  Synthetic
guccgagccgcggccggc

SEQ ID NO: 24328 - RNA, 19 nt, Artificial Sequence
  Synthetic
uguccgagccgcggccggc

SEQ ID NO: 24329 - RNA, 20 nt, Artificial Sequence
  Synthetic
cuguccgagccgcggccggc

SEQ ID NO: 24330 - RNA, 21 nt, Artificial Sequence
  Synthetic
gcuguccgagccgcggccggc

SEQ ID NO: 24331 - RNA, 22 nt, Artificial Sequence
  Synthetic
cgcuguccgagccgcggccggc

SEQ ID NO: 24332 - RNA, 23 nt, Artificial Sequence
  Synthetic
gcgcuguccgagccgcggccggc

SEQ ID NO: 24333 - RNA, 24 nt, Artificial Sequence
  Synthetic
ggcgcuguccgagccgcggccggc

SEQ ID NO: 24334 - RNA, 18 nt, Artificial Sequence
  Synthetic
cucuuggccccugccggc

SEQ ID NO: 24335 - RNA, 19 nt, Artificial Sequence
  Synthetic
ccucuuggccccugccggc

SEQ ID NO: 24336 - RNA, 20 nt, Artificial Sequence
  Synthetic
cccucuuggccccugccggc

SEQ ID NO: 24337 - RNA, 21 nt, Artificial Sequence
  Synthetic
gcccucuuggccccugccggc

SEQ ID NO: 24338 - RNA, 22 nt, Artificial Sequence
  Synthetic
cgcccucuuggccccugccggc

SEQ ID NO: 24339 - RNA, 23 nt, Artificial Sequence
  Synthetic
ccgcccucuuggccccugccggc

SEQ ID NO: 24340 - RNA, 24 nt, Artificial Sequence
  Synthetic
gccgcccucuuggccccugccggc

SEQ ID NO: 24341 - RNA, 18 nt, Artificial Sequence
  Synthetic
gggcgcggggcguccggc

SEQ ID NO: 24342 - RNA, 19 nt, Artificial Sequence
  Synthetic
ggggcgcggggcguccggc

SEQ ID NO: 24343 - RNA, 20 nt, Artificial Sequence
  Synthetic
gggggcgcggggcguccggc

SEQ ID NO: 24344 - RNA, 21 nt, Artificial Sequence
  Synthetic
ggggggcgcggggcguccggc

SEQ ID NO: 24345 - RNA, 22 nt, Artificial Sequence
  Synthetic
gggggggcgcggggcguccggc

SEQ ID NO: 24346 - RNA, 23 nt, Artificial Sequence
  Synthetic
ugggggggcgcggggcguccggc

SEQ ID NO: 24347 - RNA, 24 nt, Artificial Sequence
  Synthetic
gugggggggcgcggggcguccggc

SEQ ID NO: 24348 - RNA, 18 nt, Artificial Sequence
  Synthetic
cuguucuugguucgcggc

SEQ ID NO: 24349 - RNA, 19 nt, Artificial Sequence
  Synthetic
ucuguucuugguucgcggc

SEQ ID NO: 24350 - RNA, 20 nt, Artificial Sequence
  Synthetic
cucuguucuugguucgcggc

SEQ ID NO: 24351 - RNA, 21 nt, Artificial Sequence
  Synthetic
acucuguucuugguucgcggc

SEQ ID NO: 24352 - RNA, 22 nt, Artificial Sequence
  Synthetic
gacucuguucuugguucgcggc

SEQ ID NO: 24353 - RNA, 23 nt, Artificial Sequence
  Synthetic
agacucuguucuugguucgcggc

SEQ ID NO: 24354 - RNA, 24 nt, Artificial Sequence
  Synthetic
cagacucuguucuugguucgcggc

SEQ ID NO: 24355 - RNA, 18 nt, Artificial Sequence
  Synthetic
acgcggggggcccggggc

SEQ ID NO: 24356 - RNA, 19 nt, Artificial Sequence
  Synthetic
gacgcggggggcccggggc

SEQ ID NO: 24357 - RNA, 20 nt, Artificial Sequence
  Synthetic
ggacgcggggggcccggggc

SEQ ID NO: 24358 - RNA, 21 nt, Artificial Sequence
  Synthetic
cggacgcggggggcccggggc

SEQ ID NO: 24359 - RNA, 22 nt, Artificial Sequence
  Synthetic
gcggacgcggggggcccggggc

SEQ ID NO: 24360 - RNA, 23 nt, Artificial Sequence
  Synthetic
cgcggacgcggggggcccggggc

SEQ ID NO: 24361 - RNA, 24 nt, Artificial Sequence
  Synthetic
ccgcggacgcggggggcccggggc

SEQ ID NO: 24362 - RNA, 18 nt, Artificial Sequence
  Synthetic
cgccccgggggccggggc

SEQ ID NO: 24363 - RNA, 19 nt, Artificial Sequence
  Synthetic
ccgccccgggggccggggc

SEQ ID NO: 24364 - RNA, 20 nt, Artificial Sequence
  Synthetic
uccgccccgggggccggggc

SEQ ID NO: 24365 - RNA, 21 nt, Artificial Sequence
  Synthetic
cuccgccccgggggccggggc

SEQ ID NO: 24366 - RNA, 22 nt, Artificial Sequence
  Synthetic
gcuccgccccgggggccggggc

SEQ ID NO: 24367 - RNA, 23 nt, Artificial Sequence
  Synthetic
ggcuccgccccgggggccggggc

SEQ ID NO: 24368 - RNA, 24 nt, Artificial Sequence
  Synthetic
cggcuccgccccgggggccggggc

SEQ ID NO: 24369 - RNA, 18 nt, Artificial Sequence
  Synthetic
cggcuccgccccgggggc

SEQ ID NO: 24370 - RNA, 19 nt, Artificial Sequence
  Synthetic
ccggcuccgccccgggggc

SEQ ID NO: 24371 - RNA, 20 nt, Artificial Sequence
  Synthetic
gccggcuccgccccgggggc

SEQ ID NO: 24372 - RNA, 21 nt, Artificial Sequence
  Synthetic
ggccggcuccgccccgggggc

SEQ ID NO: 24373 - RNA, 22 nt, Artificial Sequence
  Synthetic
cggccggcuccgccccgggggc

SEQ ID NO: 24374 - RNA, 23 nt, Artificial Sequence
  Synthetic
gcggccggcuccgccccgggggc

SEQ ID NO: 24375 - RNA, 24 nt, Artificial Sequence
  Synthetic
ggcggccggcuccgccccgggggc

SEQ ID NO: 24376 - RNA, 18 nt, Artificial Sequence
  Synthetic
gccgcggacgcggggggc

SEQ ID NO: 24377 - RNA, 19 nt, Artificial Sequence
  Synthetic
ggccgcggacgcggggggc

SEQ ID NO: 24378 - RNA, 20 nt, Artificial Sequence
  Synthetic
cggccgcggacgcggggggc

SEQ ID NO: 24379 - RNA, 21 nt, Artificial Sequence
  Synthetic
gcggccgcggacgcggggggc

SEQ ID NO: 24380 - RNA, 22 nt, Artificial Sequence
  Synthetic
cgcggccgcggacgcggggggc

SEQ ID NO: 24381 - RNA, 23 nt, Artificial Sequence
  Synthetic
acgcggccgcggacgcggggggc

SEQ ID NO: 24382 - RNA, 24 nt, Artificial Sequence
  Synthetic
gacgcggccgcggacgcggggggc

SEQ ID NO: 24383 - RNA, 18 nt, Artificial Sequence
  Synthetic
gccucugcgugggggggc

SEQ ID NO: 24384 - RNA, 19 nt, Artificial Sequence
  Synthetic
cgccucugcgugggggggc

SEQ ID NO: 24385 - RNA, 20 nt, Artificial Sequence
  Synthetic
gcgccucugcgugggggggc

SEQ ID NO: 24386 - RNA, 21 nt, Artificial Sequence
  Synthetic
ggcgccucugcgugggggggc

SEQ ID NO: 24387 - RNA, 22 nt, Artificial Sequence
  Synthetic
cggcgccucugcgugggggggc

SEQ ID NO: 24388 - RNA, 23 nt, Artificial Sequence
  Synthetic
gcggcgccucugcgugggggggc

SEQ ID NO: 24389 - RNA, 24 nt, Artificial Sequence
  Synthetic
ggcggcgccucugcgugggggggc

SEQ ID NO: 24390 - RNA, 18 nt, Artificial Sequence
  Synthetic
ccgcggcucgcgacuggc

SEQ ID NO: 24391 - RNA, 19 nt, Artificial Sequence
  Synthetic
gccgcggcucgcgacuggc

SEQ ID NO: 24392 - RNA, 20 nt, Artificial Sequence
  Synthetic
cgccgcggcucgcgacuggc

SEQ ID NO: 24393 - RNA, 21 nt, Artificial Sequence
  Synthetic
gcgccgcggcucgcgacuggc

SEQ ID NO: 24394 - RNA, 22 nt, Artificial Sequence
  Synthetic
ggcgccgcggcucgcgacuggc

SEQ ID NO: 24395 - RNA, 23 nt, Artificial Sequence
  Synthetic
cggcgccgcggcucgcgacuggc

SEQ ID NO: 24396 - RNA, 24 nt, Artificial Sequence
  Synthetic
gcggcgccgcggcucgcgacuggc

SEQ ID NO: 24397 - RNA, 18 nt, Artificial Sequence
  Synthetic
cggggggcggagccuggc

SEQ ID NO: 24398 - RNA, 19 nt, Artificial Sequence
  Synthetic
gcggggggcggagccuggc

SEQ ID NO: 24399 - RNA, 20 nt, Artificial Sequence
  Synthetic
ggcggggggcggagccuggc

SEQ ID NO: 24400 - RNA, 21 nt, Artificial Sequence
  Synthetic
gggcggggggcggagccuggc

SEQ ID NO: 24401 - RNA, 22 nt, Artificial Sequence
  Synthetic
ggggcggggggcggagccuggc

SEQ ID NO: 24402 - RNA, 23 nt, Artificial Sequence
  Synthetic
cggggcggggggcggagccuggc

SEQ ID NO: 24403 - RNA, 24 nt, Artificial Sequence
  Synthetic
ccggggcggggggcggagccuggc

SEQ ID NO: 24404 - RNA, 18 nt, Artificial Sequence
  Synthetic
ggccggcuggggggcugc

SEQ ID NO: 24405 - RNA, 19 nt, Artificial Sequence
  Synthetic
cggccggcuggggggcugc

SEQ ID NO: 24406 - RNA, 20 nt, Artificial Sequence
  Synthetic
gcggccggcuggggggcugc

SEQ ID NO: 24407 - RNA, 21 nt, Artificial Sequence
  Synthetic
cgcggccggcuggggggcugc

SEQ ID NO: 24408 - RNA, 22 nt, Artificial Sequence
  Synthetic
ccgcggccggcuggggggcugc

SEQ ID NO: 24409 - RNA, 23 nt, Artificial Sequence
  Synthetic
gccgcggccggcuggggggcugc

SEQ ID NO: 24410 - RNA, 24 nt, Artificial Sequence
  Synthetic
agccgcggccggcuggggggcugc

SEQ ID NO: 24411 - RNA, 18 nt, Artificial Sequence
  Synthetic
gcgcggcggcgccucugc

SEQ ID NO: 24412 - RNA, 19 nt, Artificial Sequence
  Synthetic
ggcgcggcggcgccucugc

SEQ ID NO: 24413 - RNA, 20 nt, Artificial Sequence
  Synthetic
gggcgcggcggcgccucugc

SEQ ID NO: 24414 - RNA, 21 nt, Artificial Sequence
  Synthetic
ggggcgcggcggcgccucugc

SEQ ID NO: 24415 - RNA, 22 nt, Artificial Sequence
  Synthetic
gggggcgcggcggcgccucugc

SEQ ID NO: 24416 - RNA, 23 nt, Artificial Sequence
  Synthetic
ggggggcgcggcggcgccucugc

SEQ ID NO: 24417 - RNA, 24 nt, Artificial Sequence
  Synthetic
cggggggcgcggcggcgccucugc

SEQ ID NO: 24418 - RNA, 18 nt, Artificial Sequence
  Synthetic
ggggucucuguuguuugc

SEQ ID NO: 24419 - RNA, 19 nt, Artificial Sequence
  Synthetic
uggggucucuguuguuugc

SEQ ID NO: 24420 - RNA, 20 nt, Artificial Sequence
  Synthetic
auggggucucuguuguuugc

SEQ ID NO: 24421 - RNA, 21 nt, Artificial Sequence
  Synthetic
uauggggucucuguuguuugc

SEQ ID NO: 24422 - RNA, 22 nt, Artificial Sequence
  Synthetic
cuauggggucucuguuguuugc

SEQ ID NO: 24423 - RNA, 23 nt, Artificial Sequence
  Synthetic
acuauggggucucuguuguuugc

SEQ ID NO: 24424 - RNA, 24 nt, Artificial Sequence
  Synthetic
cacuauggggucucuguuguuugc

SEQ ID NO: 24425 - RNA, 18 nt, Artificial Sequence
  Synthetic
uuccccacgggggucauc

SEQ ID NO: 24426 - RNA, 19 nt, Artificial Sequence
  Synthetic
guuccccacgggggucauc

SEQ ID NO: 24427 - RNA, 20 nt, Artificial Sequence
  Synthetic
uguuccccacgggggucauc

SEQ ID NO: 24428 - RNA, 21 nt, Artificial Sequence
  Synthetic
auguuccccacgggggucauc

SEQ ID NO: 24429 - RNA, 22 nt, Artificial Sequence
  Synthetic
cauguuccccacgggggucauc

SEQ ID NO: 24430 - RNA, 23 nt, Artificial Sequence
  Synthetic
gcauguuccccacgggggucauc

SEQ ID NO: 24431 - RNA, 24 nt, Artificial Sequence
  Synthetic
agcauguuccccacgggggucauc

SEQ ID NO: 24432 - RNA, 18 nt, Artificial Sequence
  Synthetic
gggggccgucggguacuc

SEQ ID NO: 24433 - RNA, 19 nt, Artificial Sequence
  Synthetic
cgggggccgucggguacuc

SEQ ID NO: 24434 - RNA, 20 nt, Artificial Sequence
  Synthetic
gcgggggccgucggguacuc

SEQ ID NO: 24435 - RNA, 21 nt, Artificial Sequence
  Synthetic
cgcgggggccgucggguacuc

SEQ ID NO: 24436 - RNA, 22 nt, Artificial Sequence
  Synthetic
acgcgggggccgucggguacuc

SEQ ID NO: 24437 - RNA, 23 nt, Artificial Sequence
  Synthetic
gacgcgggggccgucggguacuc

SEQ ID NO: 24438 - RNA, 24 nt, Artificial Sequence
  Synthetic
cgacgcgggggccgucggguacuc

SEQ ID NO: 24439 - RNA, 18 nt, Artificial Sequence
  Synthetic
gugguuacccgcggucuc

SEQ ID NO: 24440 - RNA, 19 nt, Artificial Sequence
  Synthetic
cgugguuacccgcggucuc

SEQ ID NO: 24441 - RNA, 20 nt, Artificial Sequence
  Synthetic
acgugguuacccgcggucuc

SEQ ID NO: 24442 - RNA, 21 nt, Artificial Sequence
  Synthetic
cacgugguuacccgcggucuc

SEQ ID NO: 24443 - RNA, 22 nt, Artificial Sequence
  Synthetic
ucacgugguuacccgcggucuc

SEQ ID NO: 24444 - RNA, 23 nt, Artificial Sequence
  Synthetic
aucacgugguuacccgcggucuc

SEQ ID NO: 24445 - RNA, 24 nt, Artificial Sequence
  Synthetic
caucacgugguuacccgcggucuc

SEQ ID NO: 24446 - RNA, 18 nt, Artificial Sequence
  Synthetic
ccgcaggcugcggaaguc

SEQ ID NO: 24447 - RNA, 19 nt, Artificial Sequence
  Synthetic
accgcaggcugcggaaguc

SEQ ID NO: 24448 - RNA, 20 nt, Artificial Sequence
  Synthetic
gaccgcaggcugcggaaguc

SEQ ID NO: 24449 - RNA, 21 nt, Artificial Sequence
  Synthetic
agaccgcaggcugcggaaguc

SEQ ID NO: 24450 - RNA, 22 nt, Artificial Sequence
  Synthetic
gagaccgcaggcugcggaaguc

SEQ ID NO: 24451 - RNA, 23 nt, Artificial Sequence
  Synthetic
cgagaccgcaggcugcggaaguc

SEQ ID NO: 24452 - RNA, 24 nt, Artificial Sequence
  Synthetic
ccgagaccgcaggcugcggaaguc

SEQ ID NO: 24453 - RNA, 18 nt, Artificial Sequence
  Synthetic
gaggccgccgaggacguc

SEQ ID NO: 24454 - RNA, 19 nt, Artificial Sequence
  Synthetic
ggaggccgccgaggacguc

SEQ ID NO: 24455 - RNA, 20 nt, Artificial Sequence
  Synthetic
cggaggccgccgaggacguc

SEQ ID NO: 24456 - RNA, 21 nt, Artificial Sequence
  Synthetic
gcggaggccgccgaggacguc

SEQ ID NO: 24457 - RNA, 22 nt, Artificial Sequence
  Synthetic
ggcggaggccgccgaggacguc

SEQ ID NO: 24458 - RNA, 23 nt, Artificial Sequence
  Synthetic
aggcggaggccgccgaggacguc

SEQ ID NO: 24459 - RNA, 24 nt, Artificial Sequence
  Synthetic
gaggcggaggccgccgaggacguc

SEQ ID NO: 24460 - RNA, 18 nt, Artificial Sequence
  Synthetic
ugagacgccccgcccguc

SEQ ID NO: 24461 - RNA, 19 nt, Artificial Sequence
  Synthetic
gugagacgccccgcccguc

SEQ ID NO: 24462 - RNA, 20 nt, Artificial Sequence
  Synthetic
cgugagacgccccgcccguc

SEQ ID NO: 24463 - RNA, 21 nt, Artificial Sequence
  Synthetic
gcgugagacgccccgcccguc

SEQ ID NO: 24464 - RNA, 22 nt, Artificial Sequence
  Synthetic
ugcgugagacgccccgcccguc

SEQ ID NO: 24465 - RNA, 23 nt, Artificial Sequence
  Synthetic
cugcgugagacgccccgcccguc

SEQ ID NO: 24466 - RNA, 24 nt, Artificial Sequence
  Synthetic
gcugcgugagacgccccgcccguc

SEQ ID NO: 24467 - RNA, 18 nt, Artificial Sequence
  Synthetic
acgugguuacccgcgguc

SEQ ID NO: 24468 - RNA, 19 nt, Artificial Sequence
  Synthetic
cacgugguuacccgcgguc

SEQ ID NO: 24469 - RNA, 20 nt, Artificial Sequence
  Synthetic
ucacgugguuacccgcgguc

SEQ ID NO: 24470 - RNA, 21 nt, Artificial Sequence
  Synthetic
aucacgugguuacccgcgguc

SEQ ID NO: 24471 - RNA, 22 nt, Artificial Sequence
  Synthetic
caucacgugguuacccgcgguc

SEQ ID NO: 24472 - RNA, 23 nt, Artificial Sequence
  Synthetic
gcaucacgugguuacccgcgguc

SEQ ID NO: 24473 - RNA, 24 nt, Artificial Sequence
  Synthetic
ggcaucacgugguuacccgcgguc

SEQ ID NO: 24474 - RNA, 18 nt, Artificial Sequence
  Synthetic
ucggccuccaugcggguc

SEQ ID NO: 24475 - RNA, 19 nt, Artificial Sequence
  Synthetic
cucggccuccaugcggguc

SEQ ID NO: 24476 - RNA, 20 nt, Artificial Sequence
  Synthetic
ccucggccuccaugcggguc

SEQ ID NO: 24477 - RNA, 21 nt, Artificial Sequence
  Synthetic
uccucggccuccaugcggguc

SEQ ID NO: 24478 - RNA, 22 nt, Artificial Sequence
  Synthetic
cuccucggccuccaugcggguc

SEQ ID NO: 24479 - RNA, 23 nt, Artificial Sequence
  Synthetic
ccuccucggccuccaugcggguc

SEQ ID NO: 24480 - RNA, 24 nt, Artificial Sequence
  Synthetic
gccuccucggccuccaugcggguc

SEQ ID NO: 24481 - RNA, 18 nt, Artificial Sequence
  Synthetic
gaggacgucagggggguc

SEQ ID NO: 24482 - RNA, 19 nt, Artificial Sequence
  Synthetic
cgaggacgucagggggguc

SEQ ID NO: 24483 - RNA, 20 nt, Artificial Sequence
  Synthetic
ccgaggacgucagggggguc

SEQ ID NO: 24484 - RNA, 21 nt, Artificial Sequence
  Synthetic
gccgaggacgucagggggguc

SEQ ID NO: 24485 - RNA, 22 nt, Artificial Sequence
  Synthetic
cgccgaggacgucagggggguc

SEQ ID NO: 24486 - RNA, 23 nt, Artificial Sequence
  Synthetic
ccgccgaggacgucagggggguc

SEQ ID NO: 24487 - RNA, 24 nt, Artificial Sequence
  Synthetic
gccgccgaggacgucagggggguc

SEQ ID NO: 24488 - RNA, 18 nt, Artificial Sequence
  Synthetic
gucucuguuguuugcaag

SEQ ID NO: 24489 - RNA, 19 nt, Artificial Sequence
  Synthetic
ggucucuguuguuugcaag

SEQ ID NO: 24490 - RNA, 20 nt, Artificial Sequence
  Synthetic
gggucucuguuguuugcaag

SEQ ID NO: 24491 - RNA, 21 nt, Artificial Sequence
  Synthetic
ggggucucuguuguuugcaag

SEQ ID NO: 24492 - RNA, 22 nt, Artificial Sequence
  Synthetic
uggggucucuguuguuugcaag

SEQ ID NO: 24493 - RNA, 23 nt, Artificial Sequence
  Synthetic
auggggucucuguuguuugcaag

SEQ ID NO: 24494 - RNA, 24 nt, Artificial Sequence
  Synthetic
uauggggucucuguuguuugcaag

SEQ ID NO: 24495 - RNA, 18 nt, Artificial Sequence
  Synthetic
cgcccgaggaggcggaag

SEQ ID NO: 24496 - RNA, 19 nt, Artificial Sequence
  Synthetic
ccgcccgaggaggcggaag

SEQ ID NO: 24497 - RNA, 20 nt, Artificial Sequence
  Synthetic
cccgcccgaggaggcggaag

SEQ ID NO: 24498 - RNA, 21 nt, Artificial Sequence
  Synthetic
ccccgcccgaggaggcggaag

SEQ ID NO: 24499 - RNA, 22 nt, Artificial Sequence
  Synthetic
gccccgcccgaggaggcggaag

SEQ ID NO: 24500 - RNA, 23 nt, Artificial Sequence
  Synthetic
ggccccgcccgaggaggcggaag

SEQ ID NO: 24501 - RNA, 24 nt, Artificial Sequence
  Synthetic
cggccccgcccgaggaggcggaag

SEQ ID NO: 24502 - RNA, 18 nt, Artificial Sequence
  Synthetic
agggugcggcggcuccag

SEQ ID NO: 24503 - RNA, 19 nt, Artificial Sequence
  Synthetic
cagggugcggcggcuccag

SEQ ID NO: 24504 - RNA, 20 nt, Artificial Sequence
  Synthetic
gcagggugcggcggcuccag

SEQ ID NO: 24505 - RNA, 21 nt, Artificial Sequence
  Synthetic
agcagggugcggcggcuccag

SEQ ID NO: 24506 - RNA, 22 nt, Artificial Sequence
  Synthetic
gagcagggugcggcggcuccag

SEQ ID NO: 24507 - RNA, 23 nt, Artificial Sequence
  Synthetic
ggagcagggugcggcggcuccag

SEQ ID NO: 24508 - RNA, 24 nt, Artificial Sequence
  Synthetic
gggagcagggugcggcggcuccag

SEQ ID NO: 24509 - RNA, 18 nt, Artificial Sequence
  Synthetic
ccgaggaggaagaggcag

SEQ ID NO: 24510 - RNA, 19 nt, Artificial Sequence
  Synthetic
gccgaggaggaagaggcag

SEQ ID NO: 24511 - RNA, 20 nt, Artificial Sequence
  Synthetic
ggccgaggaggaagaggcag

SEQ ID NO: 24512 - RNA, 21 nt, Artificial Sequence
  Synthetic
gggccgaggaggaagaggcag

SEQ ID NO: 24513 - RNA, 22 nt, Artificial Sequence
  Synthetic
ggggccgaggaggaagaggcag

SEQ ID NO: 24514 - RNA, 23 nt, Artificial Sequence
  Synthetic
cggggccgaggaggaagaggcag

SEQ ID NO: 24515 - RNA, 24 nt, Artificial Sequence
  Synthetic
ucggggccgaggaggaagaggcag

SEQ ID NO: 24516 - RNA, 18 nt, Artificial Sequence
  Synthetic
gaggcagaggaggaagag

SEQ ID NO: 24517 - RNA, 19 nt, Artificial Sequence
  Synthetic
agaggcagaggaggaagag

SEQ ID NO: 24518 - RNA, 20 nt, Artificial Sequence
  Synthetic
aagaggcagaggaggaagag

SEQ ID NO: 24519 - RNA, 21 nt, Artificial Sequence
  Synthetic
gaagaggcagaggaggaagag

SEQ ID NO: 24520 - RNA, 22 nt, Artificial Sequence
  Synthetic
ggaagaggcagaggaggaagag

SEQ ID NO: 24521 - RNA, 23 nt, Artificial Sequence
  Synthetic
aggaagaggcagaggaggaagag

SEQ ID NO: 24522 - RNA, 24 nt, Artificial Sequence
  Synthetic
gaggaagaggcagaggaggaagag

SEQ ID NO: 24523 - RNA, 18 nt, Artificial Sequence
  Synthetic
gaggaggaagaggcagag

SEQ ID NO: 24524 - RNA, 19 nt, Artificial Sequence
  Synthetic
cgaggaggaagaggcagag

SEQ ID NO: 24525 - RNA, 20 nt, Artificial Sequence
  Synthetic
ccgaggaggaagaggcagag

SEQ ID NO: 24526 - RNA, 21 nt, Artificial Sequence
  Synthetic
gccgaggaggaagaggcagag

SEQ ID NO: 24527 - RNA, 22 nt, Artificial Sequence
  Synthetic
ggccgaggaggaagaggcagag

SEQ ID NO: 24528 - RNA, 23 nt, Artificial Sequence
  Synthetic
gggccgaggaggaagaggcagag

SEQ ID NO: 24529 - RNA, 24 nt, Artificial Sequence
  Synthetic
ggggccgaggaggaagaggcagag

SEQ ID NO: 24530 - RNA, 18 nt, Artificial Sequence
  Synthetic
acgcuagagacccccgag

SEQ ID NO: 24531 - RNA, 19 nt, Artificial Sequence
  Synthetic
cacgcuagagacccccgag

SEQ ID NO: 24532 - RNA, 20 nt, Artificial Sequence
  Synthetic
ccacgcuagagacccccgag

SEQ ID NO: 24533 - RNA, 21 nt, Artificial Sequence
  Synthetic
accacgcuagagacccccgag

SEQ ID NO: 24534 - RNA, 22 nt, Artificial Sequence
  Synthetic
gaccacgcuagagacccccgag

SEQ ID NO: 24535 - RNA, 23 nt, Artificial Sequence
  Synthetic
cgaccacgcuagagacccccgag

SEQ ID NO: 24536 - RNA, 24 nt, Artificial Sequence
  Synthetic
gcgaccacgcuagagacccccgag

SEQ ID NO: 24537 - RNA, 18 nt, Artificial Sequence
  Synthetic
ggcccgaugggcgccgag

SEQ ID NO: 24538 - RNA, 19 nt, Artificial Sequence
  Synthetic
uggcccgaugggcgccgag

SEQ ID NO: 24539 - RNA, 20 nt, Artificial Sequence
  Synthetic
guggcccgaugggcgccgag

SEQ ID NO: 24540 - RNA, 21 nt, Artificial Sequence
  Synthetic
uguggcccgaugggcgccgag

SEQ ID NO: 24541 - RNA, 22 nt, Artificial Sequence
  Synthetic
guguggcccgaugggcgccgag

SEQ ID NO: 24542 - RNA, 23 nt, Artificial Sequence
  Synthetic
cguguggcccgaugggcgccgag

SEQ ID NO: 24543 - RNA, 24 nt, Artificial Sequence
  Synthetic
ccguguggcccgaugggcgccgag

SEQ ID NO: 24544 - RNA, 18 nt, Artificial Sequence
  Synthetic
gcgggggucggggccgag

SEQ ID NO: 24545 - RNA, 19 nt, Artificial Sequence
  Synthetic
cgcgggggucggggccgag

SEQ ID NO: 24546 - RNA, 20 nt, Artificial Sequence
  Synthetic
ccgcgggggucggggccgag

SEQ ID NO: 24547 - RNA, 21 nt, Artificial Sequence
  Synthetic
cccgcgggggucggggccgag

SEQ ID NO: 24548 - RNA, 22 nt, Artificial Sequence
  Synthetic
ccccgcgggggucggggccgag

SEQ ID NO: 24549 - RNA, 23 nt, Artificial Sequence
  Synthetic
cccccgcgggggucggggccgag

SEQ ID NO: 24550 - RNA, 24 nt, Artificial Sequence
  Synthetic
gcccccgcgggggucggggccgag

SEQ ID NO: 24551 - RNA, 18 nt, Artificial Sequence
  Synthetic
ggccccugccggcgcgag

SEQ ID NO: 24552 - RNA, 19 nt, Artificial Sequence
  Synthetic
uggccccugccggcgcgag

SEQ ID NO: 24553 - RNA, 20 nt, Artificial Sequence
  Synthetic
uuggccccugccggcgcgag

SEQ ID NO: 24554 - RNA, 21 nt, Artificial Sequence
  Synthetic
cuuggccccugccggcgcgag

SEQ ID NO: 24555 - RNA, 22 nt, Artificial Sequence
  Synthetic
ucuuggccccugccggcgcgag

SEQ ID NO: 24556 - RNA, 23 nt, Artificial Sequence
  Synthetic
cucuuggccccugccggcgcgag

SEQ ID NO: 24557 - RNA, 24 nt, Artificial Sequence
  Synthetic
ccucuuggccccugccggcgcgag

SEQ ID NO: 24558 - RNA, 18 nt, Artificial Sequence
  Synthetic
acggccccgcccgaggag

SEQ ID NO: 24559 - RNA, 19 nt, Artificial Sequence
  Synthetic
gacggccccgcccgaggag

SEQ ID NO: 24560 - RNA, 20 nt, Artificial Sequence
  Synthetic
cgacggccccgcccgaggag

SEQ ID NO: 24561 - RNA, 21 nt, Artificial Sequence
  Synthetic
ccgacggccccgcccgaggag

SEQ ID NO: 24562 - RNA, 22 nt, Artificial Sequence
  Synthetic
accgacggccccgcccgaggag

SEQ ID NO: 24563 - RNA, 23 nt, Artificial Sequence
  Synthetic
caccgacggccccgcccgaggag

SEQ ID NO: 24564 - RNA, 24 nt, Artificial Sequence
  Synthetic
gcaccgacggccccgcccgaggag

SEQ ID NO: 24565 - RNA, 18 nt, Artificial Sequence
  Synthetic
gaggaggcggaagcggag

SEQ ID NO: 24566 - RNA, 19 nt, Artificial Sequence
  Synthetic
cgaggaggcggaagcggag

SEQ ID NO: 24567 - RNA, 20 nt, Artificial Sequence
  Synthetic
ccgaggaggcggaagcggag

SEQ ID NO: 24568 - RNA, 21 nt, Artificial Sequence
  Synthetic
cccgaggaggcggaagcggag

SEQ ID NO: 24569 - RNA, 22 nt, Artificial Sequence
  Synthetic
gcccgaggaggcggaagcggag

SEQ ID NO: 24570 - RNA, 23 nt, Artificial Sequence
  Synthetic
cgcccgaggaggcggaagcggag

SEQ ID NO: 24571 - RNA, 24 nt, Artificial Sequence
  Synthetic
ccgcccgaggaggcggaagcggag

SEQ ID NO: 24572 - RNA, 18 nt, Artificial Sequence
  Synthetic
ucgacagaggcggcggag

SEQ ID NO: 24573 - RNA, 19 nt, Artificial Sequence
  Synthetic
cucgacagaggcggcggag

SEQ ID NO: 24574 - RNA, 20 nt, Artificial Sequence
  Synthetic
gcucgacagaggcggcggag

SEQ ID NO: 24575 - RNA, 21 nt, Artificial Sequence
  Synthetic
ugcucgacagaggcggcggag

SEQ ID NO: 24576 - RNA, 22 nt, Artificial Sequence
  Synthetic
cugcucgacagaggcggcggag

SEQ ID NO: 24577 - RNA, 23 nt, Artificial Sequence
  Synthetic
ccugcucgacagaggcggcggag

SEQ ID NO: 24578 - RNA, 24 nt, Artificial Sequence
  Synthetic
uccugcucgacagaggcggcggag

SEQ ID NO: 24579 - RNA, 18 nt, Artificial Sequence
  Synthetic
cccggcccugagucggag

SEQ ID NO: 24580 - RNA, 19 nt, Artificial Sequence
  Synthetic
ccccggcccugagucggag

SEQ ID NO: 24581 - RNA, 20 nt, Artificial Sequence
  Synthetic
cccccggcccugagucggag

SEQ ID NO: 24582 - RNA, 21 nt, Artificial Sequence
  Synthetic
ccccccggcccugagucggag

SEQ ID NO: 24583 - RNA, 22 nt, Artificial Sequence
  Synthetic
cccccccggcccugagucggag

SEQ ID NO: 24584 - RNA, 23 nt, Artificial Sequence
  Synthetic
gcccccccggcccugagucggag

SEQ ID NO: 24585 - RNA, 24 nt, Artificial Sequence
  Synthetic
cgcccccccggcccugagucggag

SEQ ID NO: 24586 - RNA, 18 nt, Artificial Sequence
  Synthetic
agaggcggcggaggggag

SEQ ID NO: 24587 - RNA, 19 nt, Artificial Sequence
  Synthetic
cagaggcggcggaggggag

SEQ ID NO: 24588 - RNA, 20 nt, Artificial Sequence
  Synthetic
acagaggcggcggaggggag

SEQ ID NO: 24589 - RNA, 21 nt, Artificial Sequence
  Synthetic
gacagaggcggcggaggggag

SEQ ID NO: 24590 - RNA, 22 nt, Artificial Sequence
  Synthetic
cgacagaggcggcggaggggag

SEQ ID NO: 24591 - RNA, 23 nt, Artificial Sequence
  Synthetic
ucgacagaggcggcggaggggag

SEQ ID NO: 24592 - RNA, 24 nt, Artificial Sequence
  Synthetic
cucgacagaggcggcggaggggag

SEQ ID NO: 24593 - RNA, 18 nt, Artificial Sequence
  Synthetic
cgcccccccggcccugag

SEQ ID NO: 24594 - RNA, 19 nt, Artificial Sequence
  Synthetic
gcgcccccccggcccugag

SEQ ID NO: 24595 - RNA, 20 nt, Artificial Sequence
  Synthetic
cgcgcccccccggcccugag

SEQ ID NO: 24596 - RNA, 21 nt, Artificial Sequence
  Synthetic
ccgcgcccccccggcccugag

SEQ ID NO: 24597 - RNA, 22 nt, Artificial Sequence
  Synthetic
gccgcgcccccccggcccugag

SEQ ID NO: 24598 - RNA, 23 nt, Artificial Sequence
  Synthetic
ggccgcgcccccccggcccugag

SEQ ID NO: 24599 - RNA, 24 nt, Artificial Sequence
  Synthetic
uggccgcgcccccccggcccugag

SEQ ID NO: 24600 - RNA, 18 nt, Artificial Sequence
  Synthetic
gacgccccgcccgucacg

SEQ ID NO: 24601 - RNA, 19 nt, Artificial Sequence
  Synthetic
agacgccccgcccgucacg

SEQ ID NO: 24602 - RNA, 20 nt, Artificial Sequence
  Synthetic
gagacgccccgcccgucacg

SEQ ID NO: 24603 - RNA, 21 nt, Artificial Sequence
  Synthetic
ugagacgccccgcccgucacg

SEQ ID NO: 24604 - RNA, 22 nt, Artificial Sequence
  Synthetic
gugagacgccccgcccgucacg

SEQ ID NO: 24605 - RNA, 23 nt, Artificial Sequence
  Synthetic
cgugagacgccccgcccgucacg

SEQ ID NO: 24606 - RNA, 24 nt, Artificial Sequence
  Synthetic
gcgugagacgccccgcccgucacg

SEQ ID NO: 24607 - RNA, 18 nt, Artificial Sequence
  Synthetic
ggcuguuccacuccgacg

SEQ ID NO: 24608 - RNA, 19 nt, Artificial Sequence
  Synthetic
aggcuguuccacuccgacg

SEQ ID NO: 24609 - RNA, 20 nt, Artificial Sequence
  Synthetic
gaggcuguuccacuccgacg

SEQ ID NO: 24610 - RNA, 21 nt, Artificial Sequence
  Synthetic
agaggcuguuccacuccgacg

SEQ ID NO: 24611 - RNA, 22 nt, Artificial Sequence
  Synthetic
cagaggcuguuccacuccgacg

SEQ ID NO: 24612 - RNA, 23 nt, Artificial Sequence
  Synthetic
ccagaggcuguuccacuccgacg

SEQ ID NO: 24613 - RNA, 24 nt, Artificial Sequence
  Synthetic
uccagaggcuguuccacuccgacg

SEQ ID NO: 24614 - RNA, 18 nt, Artificial Sequence
  Synthetic
ccgacgcggccgcggacg

SEQ ID NO: 24615 - RNA, 19 nt, Artificial Sequence
  Synthetic
cccgacgcggccgcggacg

SEQ ID NO: 24616 - RNA, 20 nt, Artificial Sequence
  Synthetic
ucccgacgcggccgcggacg

SEQ ID NO: 24617 - RNA, 21 nt, Artificial Sequence
  Synthetic
gucccgacgcggccgcggacg

SEQ ID NO: 24618 - RNA, 22 nt, Artificial Sequence
  Synthetic
ggucccgacgcggccgcggacg

SEQ ID NO: 24619 - RNA, 23 nt, Artificial Sequence
  Synthetic
gggucccgacgcggccgcggacg

SEQ ID NO: 24620 - RNA, 24 nt, Artificial Sequence
  Synthetic
cgggucccgacgcggccgcggacg

SEQ ID NO: 24621 - RNA, 18 nt, Artificial Sequence
  Synthetic
ccccagggucagguaccg

SEQ ID NO: 24622 - RNA, 19 nt, Artificial Sequence
  Synthetic
cccccagggucagguaccg

SEQ ID NO: 24623 - RNA, 20 nt, Artificial Sequence
  Synthetic
ccccccagggucagguaccg

SEQ ID NO: 24624 - RNA, 21 nt, Artificial Sequence
  Synthetic
cccccccagggucagguaccg

SEQ ID NO: 24625 - RNA, 22 nt, Artificial Sequence
  Synthetic
gcccccccagggucagguaccg

SEQ ID NO: 24626 - RNA, 23 nt, Artificial Sequence
  Synthetic
ugcccccccagggucagguaccg

SEQ ID NO: 24627 - RNA, 24 nt, Artificial Sequence
  Synthetic
gugcccccccagggucagguaccg

SEQ ID NO: 24628 - RNA, 18 nt, Artificial Sequence
  Synthetic
auggugcugaacgacccg

SEQ ID NO: 24629 - RNA, 19 nt, Artificial Sequence
  Synthetic
gauggugcugaacgacccg

SEQ ID NO: 24630 - RNA, 20 nt, Artificial Sequence
  Synthetic
ggauggugcugaacgacccg

SEQ ID NO: 24631 - RNA, 21 nt, Artificial Sequence
  Synthetic
gggauggugcugaacgacccg

SEQ ID NO: 24632 - RNA, 22 nt, Artificial Sequence
  Synthetic
cgggauggugcugaacgacccg

SEQ ID NO: 24633 - RNA, 23 nt, Artificial Sequence
  Synthetic
ucgggauggugcugaacgacccg

SEQ ID NO: 24634 - RNA, 24 nt, Artificial Sequence
  Synthetic
aucgggauggugcugaacgacccg

SEQ ID NO: 24635 - RNA, 18 nt, Artificial Sequence
  Synthetic
ccaaccccaacccccccg

SEQ ID NO: 24636 - RNA, 19 nt, Artificial Sequence
  Synthetic
cccaaccccaacccccccg

SEQ ID NO: 24637 - RNA, 20 nt, Artificial Sequence
  Synthetic
ccccaaccccaacccccccg

SEQ ID NO: 24638 - RNA, 21 nt, Artificial Sequence
  Synthetic
accccaaccccaacccccccg

SEQ ID NO: 24639 - RNA, 22 nt, Artificial Sequence
  Synthetic
aaccccaaccccaacccccccg

SEQ ID NO: 24640 - RNA, 23 nt, Artificial Sequence
  Synthetic
caaccccaaccccaacccccccg

SEQ ID NO: 24641 - RNA, 24 nt, Artificial Sequence
  Synthetic
ccaaccccaaccccaacccccccg

SEQ ID NO: 24642 - RNA, 18 nt, Artificial Sequence
  Synthetic
cggaagaggcggcccccg

SEQ ID NO: 24643 - RNA, 19 nt, Artificial Sequence
  Synthetic
gcggaagaggcggcccccg

SEQ ID NO: 24644 - RNA, 20 nt, Artificial Sequence
  Synthetic
ggcggaagaggcggcccccg

SEQ ID NO: 24645 - RNA, 21 nt, Artificial Sequence
  Synthetic
cggcggaagaggcggcccccg

SEQ ID NO: 24646 - RNA, 22 nt, Artificial Sequence
  Synthetic
gcggcggaagaggcggcccccg

SEQ ID NO: 24647 - RNA, 23 nt, Artificial Sequence
  Synthetic
ggcggcggaagaggcggcccccg

SEQ ID NO: 24648 - RNA, 24 nt, Artificial Sequence
  Synthetic
cggcggcggaagaggcggcccccg

SEQ ID NO: 24649 - RNA, 18 nt, Artificial Sequence
  Synthetic
caccgacggccccgcccg

SEQ ID NO: 24650 - RNA, 19 nt, Artificial Sequence
  Synthetic
gcaccgacggccccgcccg

SEQ ID NO: 24651 - RNA, 20 nt, Artificial Sequence
  Synthetic
ggcaccgacggccccgcccg

SEQ ID NO: 24652 - RNA, 21 nt, Artificial Sequence
  Synthetic
gggcaccgacggccccgcccg

SEQ ID NO: 24653 - RNA, 22 nt, Artificial Sequence
  Synthetic
agggcaccgacggccccgcccg

SEQ ID NO: 24654 - RNA, 23 nt, Artificial Sequence
  Synthetic
cagggcaccgacggccccgcccg

SEQ ID NO: 24655 - RNA, 24 nt, Artificial Sequence
  Synthetic
ccagggcaccgacggccccgcccg

SEQ ID NO: 24656 - RNA, 18 nt, Artificial Sequence
  Synthetic
agcgcgugaggccgcccg

SEQ ID NO: 24657 - RNA, 19 nt, Artificial Sequence
  Synthetic
uagcgcgugaggccgcccg

SEQ ID NO: 24658 - RNA, 20 nt, Artificial Sequence
  Synthetic
guagcgcgugaggccgcccg

SEQ ID NO: 24659 - RNA, 21 nt, Artificial Sequence
  Synthetic
gguagcgcgugaggccgcccg

SEQ ID NO: 24660 - RNA, 22 nt, Artificial Sequence
  Synthetic
agguagcgcgugaggccgcccg

SEQ ID NO: 24661 - RNA, 23 nt, Artificial Sequence
  Synthetic
cagguagcgcgugaggccgcccg

SEQ ID NO: 24662 - RNA, 24 nt, Artificial Sequence
  Synthetic
gcagguagcgcgugaggccgcccg

SEQ ID NO: 24663 - RNA, 18 nt, Artificial Sequence
  Synthetic
cugcugccguguggcccg

SEQ ID NO: 24664 - RNA, 19 nt, Artificial Sequence
  Synthetic
acugcugccguguggcccg

SEQ ID NO: 24665 - RNA, 20 nt, Artificial Sequence
  Synthetic
uacugcugccguguggcccg

SEQ ID NO: 24666 - RNA, 21 nt, Artificial Sequence
  Synthetic
uuacugcugccguguggcccg

SEQ ID NO: 24667 - RNA, 22 nt, Artificial Sequence
  Synthetic
guuacugcugccguguggcccg

SEQ ID NO: 24668 - RNA, 23 nt, Artificial Sequence
  Synthetic
uguuacugcugccguguggcccg

SEQ ID NO: 24669 - RNA, 24 nt, Artificial Sequence
  Synthetic
guguuacugcugccguguggcccg

SEQ ID NO: 24670 - RNA, 18 nt, Artificial Sequence
  Synthetic
gggagcggggcggcgccg

SEQ ID NO: 24671 - RNA, 19 nt, Artificial Sequence
  Synthetic
ggggagcggggcggcgccg

SEQ ID NO: 24672 - RNA, 20 nt, Artificial Sequence
  Synthetic
aggggagcggggcggcgccg

SEQ ID NO: 24673 - RNA, 21 nt, Artificial Sequence
  Synthetic
gaggggagcggggcggcgccg

SEQ ID NO: 24674 - RNA, 22 nt, Artificial Sequence
  Synthetic
ggaggggagcggggcggcgccg

SEQ ID NO: 24675 - RNA, 23 nt, Artificial Sequence
  Synthetic
cggaggggagcggggcggcgccg

SEQ ID NO: 24676 - RNA, 24 nt, Artificial Sequence
  Synthetic
gcggaggggagcggggcggcgccg

SEQ ID NO: 24677 - RNA, 18 nt, Artificial Sequence
  Synthetic
ccggagggggcggcgccg

SEQ ID NO: 24678 - RNA, 19 nt, Artificial Sequence
  Synthetic
gccggagggggcggcgccg

SEQ ID NO: 24679 - RNA, 20 nt, Artificial Sequence
  Synthetic
cgccggagggggcggcgccg

SEQ ID NO: 24680 - RNA, 21 nt, Artificial Sequence
  Synthetic
gcgccggagggggcggcgccg

SEQ ID NO: 24681 - RNA, 22 nt, Artificial Sequence
  Synthetic
ggcgccggagggggcggcgccg

SEQ ID NO: 24682 - RNA, 23 nt, Artificial Sequence
  Synthetic
cggcgccggagggggcggcgccg

SEQ ID NO: 24683 - RNA, 24 nt, Artificial Sequence
  Synthetic
gcggcgccggagggggcggcgccg

SEQ ID NO: 24684 - RNA, 18 nt, Artificial Sequence
  Synthetic
agccuggcaugggcgccg

SEQ ID NO: 24685 - RNA, 19 nt, Artificial Sequence
  Synthetic
gagccuggcaugggcgccg

SEQ ID NO: 24686 - RNA, 20 nt, Artificial Sequence
  Synthetic
ggagccuggcaugggcgccg

SEQ ID NO: 24687 - RNA, 21 nt, Artificial Sequence
  Synthetic
cggagccuggcaugggcgccg

SEQ ID NO: 24688 - RNA, 22 nt, Artificial Sequence
  Synthetic
gcggagccuggcaugggcgccg

SEQ ID NO: 24689 - RNA, 23 nt, Artificial Sequence
  Synthetic
ggcggagccuggcaugggcgccg

SEQ ID NO: 24690 - RNA, 24 nt, Artificial Sequence
  Synthetic
gggcggagccuggcaugggcgccg

SEQ ID NO: 24691 - RNA, 18 nt, Artificial Sequence
  Synthetic
guggcccgaugggcgccg

SEQ ID NO: 24692 - RNA, 19 nt, Artificial Sequence
  Synthetic
uguggcccgaugggcgccg

SEQ ID NO: 24693 - RNA, 20 nt, Artificial Sequence
  Synthetic
guguggcccgaugggcgccg

SEQ ID NO: 24694 - RNA, 21 nt, Artificial Sequence
  Synthetic
cguguggcccgaugggcgccg

SEQ ID NO: 24695 - RNA, 22 nt, Artificial Sequence
  Synthetic
ccguguggcccgaugggcgccg

SEQ ID NO: 24696 - RNA, 23 nt, Artificial Sequence
  Synthetic
gccguguggcccgaugggcgccg

SEQ ID NO: 24697 - RNA, 24 nt, Artificial Sequence
  Synthetic
ugccguguggcccgaugggcgccg

SEQ ID NO: 24698 - RNA, 18 nt, Artificial Sequence
  Synthetic
gccuguggggagaggccg

SEQ ID NO: 24699 - RNA, 19 nt, Artificial Sequence
  Synthetic
ggccuguggggagaggccg

SEQ ID NO: 24700 - RNA, 20 nt, Artificial Sequence
  Synthetic
gggccuguggggagaggccg

SEQ ID NO: 24701 - RNA, 21 nt, Artificial Sequence
  Synthetic
ggggccuguggggagaggccg

SEQ ID NO: 24702 - RNA, 22 nt, Artificial Sequence
  Synthetic
gggggccuguggggagaggccg

SEQ ID NO: 24703 - RNA, 23 nt, Artificial Sequence
  Synthetic
ggggggccuguggggagaggccg

SEQ ID NO: 24704 - RNA, 24 nt, Artificial Sequence
  Synthetic
cggggggccuguggggagaggccg

SEQ ID NO: 24705 - RNA, 18 nt, Artificial Sequence
  Synthetic
aggaagaggcggaggccg

SEQ ID NO: 24706 - RNA, 19 nt, Artificial Sequence
  Synthetic
gaggaagaggcggaggccg

SEQ ID NO: 24707 - RNA, 20 nt, Artificial Sequence
  Synthetic
ggaggaagaggcggaggccg

SEQ ID NO: 24708 - RNA, 21 nt, Artificial Sequence
  Synthetic
aggaggaagaggcggaggccg

SEQ ID NO: 24709 - RNA, 22 nt, Artificial Sequence
  Synthetic
gaggaggaagaggcggaggccg

SEQ ID NO: 24710 - RNA, 23 nt, Artificial Sequence
  Synthetic
agaggaggaagaggcggaggccg

SEQ ID NO: 24711 - RNA, 24 nt, Artificial Sequence
  Synthetic
cagaggaggaagaggcggaggccg

SEQ ID NO: 24712 - RNA, 18 nt, Artificial Sequence
  Synthetic
ccgcgggggucggggccg

SEQ ID NO: 24713 - RNA, 19 nt, Artificial Sequence
  Synthetic
cccgcgggggucggggccg

SEQ ID NO: 24714 - RNA, 20 nt, Artificial Sequence
  Synthetic
ccccgcgggggucggggccg

SEQ ID NO: 24715 - RNA, 21 nt, Artificial Sequence
  Synthetic
cccccgcgggggucggggccg

SEQ ID NO: 24716 - RNA, 22 nt, Artificial Sequence
  Synthetic
gcccccgcgggggucggggccg

SEQ ID NO: 24717 - RNA, 23 nt, Artificial Sequence
  Synthetic
ggcccccgcgggggucggggccg

SEQ ID NO: 24718 - RNA, 24 nt, Artificial Sequence
  Synthetic
cggcccccgcgggggucggggccg

SEQ ID NO: 24719 - RNA, 18 nt, Artificial Sequence
  Synthetic
gaagcagcgcgggggccg

SEQ ID NO: 24720 - RNA, 19 nt, Artificial Sequence
  Synthetic
agaagcagcgcgggggccg

SEQ ID NO: 24721 - RNA, 20 nt, Artificial Sequence
  Synthetic
cagaagcagcgcgggggccg

SEQ ID NO: 24722 - RNA, 21 nt, Artificial Sequence
  Synthetic
ccagaagcagcgcgggggccg

SEQ ID NO: 24723 - RNA, 22 nt, Artificial Sequence
  Synthetic
cccagaagcagcgcgggggccg

SEQ ID NO: 24724 - RNA, 23 nt, Artificial Sequence
  Synthetic
gcccagaagcagcgcgggggccg

SEQ ID NO: 24725 - RNA, 24 nt, Artificial Sequence
  Synthetic
ggcccagaagcagcgcgggggccg

SEQ ID NO: 24726 - RNA, 18 nt, Artificial Sequence
  Synthetic
gcacacggcgcgcguccg

SEQ ID NO: 24727 - RNA, 19 nt, Artificial Sequence
  Synthetic
ggcacacggcgcgcguccg

SEQ ID NO: 24728 - RNA, 20 nt, Artificial Sequence
  Synthetic
gggcacacggcgcgcguccg

SEQ ID NO: 24729 - RNA, 21 nt, Artificial Sequence
  Synthetic
ggggcacacggcgcgcguccg

SEQ ID NO: 24730 - RNA, 22 nt, Artificial Sequence
  Synthetic
uggggcacacggcgcgcguccg

SEQ ID NO: 24731 - RNA, 23 nt, Artificial Sequence
  Synthetic
cuggggcacacggcgcgcguccg

SEQ ID NO: 24732 - RNA, 24 nt, Artificial Sequence
  Synthetic
acuggggcacacggcgcgcguccg

SEQ ID NO: 24733 - RNA, 18 nt, Artificial Sequence
  Synthetic
gggggcgcggggcguccg

SEQ ID NO: 24734 - RNA, 19 nt, Artificial Sequence
  Synthetic
ggggggcgcggggcguccg

SEQ ID NO: 24735 - RNA, 20 nt, Artificial Sequence
  Synthetic
gggggggcgcggggcguccg

SEQ ID NO: 24736 - RNA, 21 nt, Artificial Sequence
  Synthetic
ugggggggcgcggggcguccg

SEQ ID NO: 24737 - RNA, 22 nt, Artificial Sequence
  Synthetic
gugggggggcgcggggcguccg

SEQ ID NO: 24738 - RNA, 23 nt, Artificial Sequence
  Synthetic
cgugggggggcgcggggcguccg

SEQ ID NO: 24739 - RNA, 24 nt, Artificial Sequence
  Synthetic
gcgugggggggcgcggggcguccg

SEQ ID NO: 24740 - RNA, 18 nt, Artificial Sequence
  Synthetic
cccgaggaggcggaagcg

SEQ ID NO: 24741 - RNA, 19 nt, Artificial Sequence
  Synthetic
gcccgaggaggcggaagcg

SEQ ID NO: 24742 - RNA, 20 nt, Artificial Sequence
  Synthetic
cgcccgaggaggcggaagcg

SEQ ID NO: 24743 - RNA, 21 nt, Artificial Sequence
  Synthetic
ccgcccgaggaggcggaagcg

SEQ ID NO: 24744 - RNA, 22 nt, Artificial Sequence
  Synthetic
cccgcccgaggaggcggaagcg

SEQ ID NO: 24745 - RNA, 23 nt, Artificial Sequence
  Synthetic
ccccgcccgaggaggcggaagcg

SEQ ID NO: 24746 - RNA, 24 nt, Artificial Sequence
  Synthetic
gccccgcccgaggaggcggaagcg

SEQ ID NO: 24747 - RNA, 18 nt, Artificial Sequence
  Synthetic
cgcggcccagaagcagcg

SEQ ID NO: 24748 - RNA, 19 nt, Artificial Sequence
  Synthetic
ccgcggcccagaagcagcg

SEQ ID NO: 24749 - RNA, 20 nt, Artificial Sequence
  Synthetic
cccgcggcccagaagcagcg

SEQ ID NO: 24750 - RNA, 21 nt, Artificial Sequence
  Synthetic
ccccgcggcccagaagcagcg

SEQ ID NO: 24751 - RNA, 22 nt, Artificial Sequence
  Synthetic
cccccgcggcccagaagcagcg

SEQ ID NO: 24752 - RNA, 23 nt, Artificial Sequence
  Synthetic
gcccccgcggcccagaagcagcg

SEQ ID NO: 24753 - RNA, 24 nt, Artificial Sequence
  Synthetic
ggcccccgcggcccagaagcagcg

SEQ ID NO: 24754 - RNA, 18 nt, Artificial Sequence
  Synthetic
gacgcggccgcggacgcg

SEQ ID NO: 24755 - RNA, 19 nt, Artificial Sequence
  Synthetic
cgacgcggccgcggacgcg

SEQ ID NO: 24756 - RNA, 20 nt, Artificial Sequence
  Synthetic
ccgacgcggccgcggacgcg

SEQ ID NO: 24757 - RNA, 21 nt, Artificial Sequence
  Synthetic
cccgacgcggccgcggacgcg

SEQ ID NO: 24758 - RNA, 22 nt, Artificial Sequence
  Synthetic
ucccgacgcggccgcggacgcg

SEQ ID NO: 24759 - RNA, 23 nt, Artificial Sequence
  Synthetic
gucccgacgcggccgcggacgcg

SEQ ID NO: 24760 - RNA, 24 nt, Artificial Sequence
  Synthetic
ggucccgacgcggccgcggacgcg

SEQ ID NO: 24761 - RNA, 18 nt, Artificial Sequence
  Synthetic
ccuggcaugggcgccgcg

SEQ ID NO: 24762 - RNA, 19 nt, Artificial Sequence
  Synthetic
gccuggcaugggcgccgcg

SEQ ID NO: 24763 - RNA, 20 nt, Artificial Sequence
  Synthetic
agccuggcaugggcgccgcg

SEQ ID NO: 24764 - RNA, 21 nt, Artificial Sequence
  Synthetic
gagccuggcaugggcgccgcg

SEQ ID NO: 24765 - RNA, 22 nt, Artificial Sequence
  Synthetic
ggagccuggcaugggcgccgcg

SEQ ID NO: 24766 - RNA, 23 nt, Artificial Sequence
  Synthetic
cggagccuggcaugggcgccgcg

SEQ ID NO: 24767 - RNA, 24 nt, Artificial Sequence
  Synthetic
gcggagccuggcaugggcgccgcg

SEQ ID NO: 24768 - RNA, 18 nt, Artificial Sequence
  Synthetic
cacggggccacggccgcg

SEQ ID NO: 24769 - RNA, 19 nt, Artificial Sequence
  Synthetic
gcacggggccacggccgcg

SEQ ID NO: 24770 - RNA, 20 nt, Artificial Sequence
  Synthetic
cgcacggggccacggccgcg

SEQ ID NO: 24771 - RNA, 21 nt, Artificial Sequence
  Synthetic
acgcacggggccacggccgcg

SEQ ID NO: 24772 - RNA, 22 nt, Artificial Sequence
  Synthetic
cacgcacggggccacggccgcg

SEQ ID NO: 24773 - RNA, 23 nt, Artificial Sequence
  Synthetic
gcacgcacggggccacggccgcg

SEQ ID NO: 24774 - RNA, 24 nt, Artificial Sequence
  Synthetic
cgcacgcacggggccacggccgcg

SEQ ID NO: 24775 - RNA, 18 nt, Artificial Sequence
  Synthetic
uuggccccugccggcgcg

SEQ ID NO: 24776 - RNA, 19 nt, Artificial Sequence
  Synthetic
cuuggccccugccggcgcg

SEQ ID NO: 24777 - RNA, 20 nt, Artificial Sequence
  Synthetic
ucuuggccccugccggcgcg

SEQ ID NO: 24778 - RNA, 21 nt, Artificial Sequence
  Synthetic
cucuuggccccugccggcgcg

SEQ ID NO: 24779 - RNA, 22 nt, Artificial Sequence
  Synthetic
ccucuuggccccugccggcgcg

SEQ ID NO: 24780 - RNA, 23 nt, Artificial Sequence
  Synthetic
cccucuuggccccugccggcgcg

SEQ ID NO: 24781 - RNA, 24 nt, Artificial Sequence
  Synthetic
gcccucuuggccccugccggcgcg

SEQ ID NO: 24782 - RNA, 18 nt, Artificial Sequence
  Synthetic
uccugcucgacagaggcg

SEQ ID NO: 24783 - RNA, 19 nt, Artificial Sequence
  Synthetic
cuccugcucgacagaggcg

SEQ ID NO: 24784 - RNA, 20 nt, Artificial Sequence
  Synthetic
ccuccugcucgacagaggcg

SEQ ID NO: 24785 - RNA, 21 nt, Artificial Sequence
  Synthetic
gccuccugcucgacagaggcg

SEQ ID NO: 24786 - RNA, 22 nt, Artificial Sequence
  Synthetic
cgccuccugcucgacagaggcg

SEQ ID NO: 24787 - RNA, 23 nt, Artificial Sequence
  Synthetic
ccgccuccugcucgacagaggcg

SEQ ID NO: 24788 - RNA, 24 nt, Artificial Sequence
  Synthetic
gccgccuccugcucgacagaggcg

SEQ ID NO: 24789 - RNA, 18 nt, Artificial Sequence
  Synthetic
gaggacgcggccccggcg

SEQ ID NO: 24790 - RNA, 19 nt, Artificial Sequence
  Synthetic
ggaggacgcggccccggcg

SEQ ID NO: 24791 - RNA, 20 nt, Artificial Sequence
  Synthetic
aggaggacgcggccccggcg

SEQ ID NO: 24792 - RNA, 21 nt, Artificial Sequence
  Synthetic
gaggaggacgcggccccggcg

SEQ ID NO: 24793 - RNA, 22 nt, Artificial Sequence
  Synthetic
ggaggaggacgcggccccggcg

SEQ ID NO: 24794 - RNA, 23 nt, Artificial Sequence
  Synthetic
cggaggaggacgcggccccggcg

SEQ ID NO: 24795 - RNA, 24 nt, Artificial Sequence
  Synthetic
gcggaggaggacgcggccccggcg

SEQ ID NO: 24796 - RNA, 18 nt, Artificial Sequence
  Synthetic
ggcgcggggcguccggcg

SEQ ID NO: 24797 - RNA, 19 nt, Artificial Sequence
  Synthetic
gggcgcggggcguccggcg

SEQ ID NO: 24798 - RNA, 20 nt, Artificial Sequence
  Synthetic
ggggcgcggggcguccggcg

SEQ ID NO: 24799 - RNA, 21 nt, Artificial Sequence
  Synthetic
gggggcgcggggcguccggcg

SEQ ID NO: 24800 - RNA, 22 nt, Artificial Sequence
  Synthetic
ggggggcgcggggcguccggcg

SEQ ID NO: 24801 - RNA, 23 nt, Artificial Sequence
  Synthetic
gggggggcgcggggcguccggcg

SEQ ID NO: 24802 - RNA, 24 nt, Artificial Sequence
  Synthetic
ugggggggcgcggggcguccggcg

SEQ ID NO: 24803 - RNA, 18 nt, Artificial Sequence
  Synthetic
ugcucgacagaggcggcg

SEQ ID NO: 24804 - RNA, 19 nt, Artificial Sequence
  Synthetic
cugcucgacagaggcggcg

SEQ ID NO: 24805 - RNA, 20 nt, Artificial Sequence
  Synthetic
ccugcucgacagaggcggcg

SEQ ID NO: 24806 - RNA, 21 nt, Artificial Sequence
  Synthetic
uccugcucgacagaggcggcg

SEQ ID NO: 24807 - RNA, 22 nt, Artificial Sequence
  Synthetic
cuccugcucgacagaggcggcg

SEQ ID NO: 24808 - RNA, 23 nt, Artificial Sequence
  Synthetic
ccuccugcucgacagaggcggcg

SEQ ID NO: 24809 - RNA, 24 nt, Artificial Sequence
  Synthetic
gccuccugcucgacagaggcggcg

SEQ ID NO: 24810 - RNA, 18 nt, Artificial Sequence
  Synthetic
gaggggagcggggcggcg

SEQ ID NO: 24811 - RNA, 19 nt, Artificial Sequence
  Synthetic
ggaggggagcggggcggcg

SEQ ID NO: 24812 - RNA, 20 nt, Artificial Sequence
  Synthetic
cggaggggagcggggcggcg

SEQ ID NO: 24813 - RNA, 21 nt, Artificial Sequence
  Synthetic
gcggaggggagcggggcggcg

SEQ ID NO: 24814 - RNA, 22 nt, Artificial Sequence
  Synthetic
ggcggaggggagcggggcggcg

SEQ ID NO: 24815 - RNA, 23 nt, Artificial Sequence
  Synthetic
cggcggaggggagcggggcggcg

SEQ ID NO: 24816 - RNA, 24 nt, Artificial Sequence
  Synthetic
gcggcggaggggagcggggcggcg

SEQ ID NO: 24817 - RNA, 18 nt, Artificial Sequence
  Synthetic
cgcggggggcccggggcg

SEQ ID NO: 24818 - RNA, 19 nt, Artificial Sequence
  Synthetic
acgcggggggcccggggcg

SEQ ID NO: 24819 - RNA, 20 nt, Artificial Sequence
  Synthetic
gacgcggggggcccggggcg

SEQ ID NO: 24820 - RNA, 21 nt, Artificial Sequence
  Synthetic
ggacgcggggggcccggggcg

SEQ ID NO: 24821 - RNA, 22 nt, Artificial Sequence
  Synthetic
cggacgcggggggcccggggcg

SEQ ID NO: 24822 - RNA, 23 nt, Artificial Sequence
  Synthetic
gcggacgcggggggcccggggcg

SEQ ID NO: 24823 - RNA, 24 nt, Artificial Sequence
  Synthetic
cgcggacgcggggggcccggggcg

SEQ ID NO: 24824 - RNA, 18 nt, Artificial Sequence
  Synthetic
gccccgggggccggggcg

SEQ ID NO: 24825 - RNA, 19 nt, Artificial Sequence
  Synthetic
cgccccgggggccggggcg

SEQ ID NO: 24826 - RNA, 20 nt, Artificial Sequence
  Synthetic
ccgccccgggggccggggcg

SEQ ID NO: 24827 - RNA, 21 nt, Artificial Sequence
  Synthetic
uccgccccgggggccggggcg

SEQ ID NO: 24828 - RNA, 22 nt, Artificial Sequence
  Synthetic
cuccgccccgggggccggggcg

SEQ ID NO: 24829 - RNA, 23 nt, Artificial Sequence
  Synthetic
gcuccgccccgggggccggggcg

SEQ ID NO: 24830 - RNA, 24 nt, Artificial Sequence
  Synthetic
ggcuccgccccgggggccggggcg

SEQ ID NO: 24831 - RNA, 18 nt, Artificial Sequence
  Synthetic
ccucugcgugggggggcg

SEQ ID NO: 24832 - RNA, 19 nt, Artificial Sequence
  Synthetic
gccucugcgugggggggcg

SEQ ID NO: 24833 - RNA, 20 nt, Artificial Sequence
  Synthetic
cgccucugcgugggggggcg

SEQ ID NO: 24834 - RNA, 21 nt, Artificial Sequence
  Synthetic
gcgccucugcgugggggggcg

SEQ ID NO: 24835 - RNA, 22 nt, Artificial Sequence
  Synthetic
ggcgccucugcgugggggggcg

SEQ ID NO: 24836 - RNA, 23 nt, Artificial Sequence
  Synthetic
cggcgccucugcgugggggggcg

SEQ ID NO: 24837 - RNA, 24 nt, Artificial Sequence
  Synthetic
gcggcgccucugcgugggggggcg

SEQ ID NO: 24838 - RNA, 18 nt, Artificial Sequence
  Synthetic
cguguggcccgaugggcg

SEQ ID NO: 24839 - RNA, 19 nt, Artificial Sequence
  Synthetic
ccguguggcccgaugggcg

SEQ ID NO: 24840 - RNA, 20 nt, Artificial Sequence
  Synthetic
gccguguggcccgaugggcg

SEQ ID NO: 24841 - RNA, 21 nt, Artificial Sequence
  Synthetic
ugccguguggcccgaugggcg

SEQ ID NO: 24842 - RNA, 22 nt, Artificial Sequence
  Synthetic
cugccguguggcccgaugggcg

SEQ ID NO: 24843 - RNA, 23 nt, Artificial Sequence
  Synthetic
gcugccguguggcccgaugggcg

SEQ ID NO: 24844 - RNA, 24 nt, Artificial Sequence
  Synthetic
ugcugccguguggcccgaugggcg

SEQ ID NO: 24845 - RNA, 18 nt, Artificial Sequence
  Synthetic
cgcggcggcgccucugcg

SEQ ID NO: 24846 - RNA, 19 nt, Artificial Sequence
  Synthetic
gcgcggcggcgccucugcg

SEQ ID NO: 24847 - RNA, 20 nt, Artificial Sequence
  Synthetic
ggcgcggcggcgccucugcg

SEQ ID NO: 24848 - RNA, 21 nt, Artificial Sequence
  Synthetic
gggcgcggcggcgccucugcg

SEQ ID NO: 24849 - RNA, 22 nt, Artificial Sequence
  Synthetic
ggggcgcggcggcgccucugcg

SEQ ID NO: 24850 - RNA, 23 nt, Artificial Sequence
  Synthetic
gggggcgcggcggcgccucugcg

SEQ ID NO: 24851 - RNA, 24 nt, Artificial Sequence
  Synthetic
ggggggcgcggcggcgccucugcg

SEQ ID NO: 24852 - RNA, 18 nt, Artificial Sequence
  Synthetic
ggggccgucggguacucg

SEQ ID NO: 24853 - RNA, 19 nt, Artificial Sequence
  Synthetic
gggggccgucggguacucg

SEQ ID NO: 24854 - RNA, 20 nt, Artificial Sequence
  Synthetic
cgggggccgucggguacucg

SEQ ID NO: 24855 - RNA, 21 nt, Artificial Sequence
  Synthetic
gcgggggccgucggguacucg

SEQ ID NO: 24856 - RNA, 22 nt, Artificial Sequence
  Synthetic
cgcgggggccgucggguacucg

SEQ ID NO: 24857 - RNA, 23 nt, Artificial Sequence
  Synthetic
acgcgggggccgucggguacucg

SEQ ID NO: 24858 - RNA, 24 nt, Artificial Sequence
  Synthetic
gacgcgggggccgucggguacucg

SEQ ID NO: 24859 - RNA, 18 nt, Artificial Sequence
  Synthetic
ugguuacccgcggucucg

SEQ ID NO: 24860 - RNA, 19 nt, Artificial Sequence
  Synthetic
gugguuacccgcggucucg

SEQ ID NO: 24861 - RNA, 20 nt, Artificial Sequence
  Synthetic
cgugguuacccgcggucucg

SEQ ID NO: 24862 - RNA, 21 nt, Artificial Sequence
  Synthetic
acgugguuacccgcggucucg

SEQ ID NO: 24863 - RNA, 22 nt, Artificial Sequence
  Synthetic
cacgugguuacccgcggucucg

SEQ ID NO: 24864 - RNA, 23 nt, Artificial Sequence
  Synthetic
ucacgugguuacccgcggucucg

SEQ ID NO: 24865 - RNA, 24 nt, Artificial Sequence
  Synthetic
aucacgugguuacccgcggucucg

SEQ ID NO: 24866 - RNA, 18 nt, Artificial Sequence
  Synthetic
ccccccggcccugagucg

SEQ ID NO: 24867 - RNA, 19 nt, Artificial Sequence
  Synthetic
cccccccggcccugagucg

SEQ ID NO: 24868 - RNA, 20 nt, Artificial Sequence
  Synthetic
gcccccccggcccugagucg

SEQ ID NO: 24869 - RNA, 21 nt, Artificial Sequence
  Synthetic
cgcccccccggcccugagucg

SEQ ID NO: 24870 - RNA, 22 nt, Artificial Sequence
  Synthetic
gcgcccccccggcccugagucg

SEQ ID NO: 24871 - RNA, 23 nt, Artificial Sequence
  Synthetic
cgcgcccccccggcccugagucg

SEQ ID NO: 24872 - RNA, 24 nt, Artificial Sequence
  Synthetic
ccgcgcccccccggcccugagucg

SEQ ID NO: 24873 - RNA, 18 nt, Artificial Sequence
  Synthetic
cccgucuccauguccagg

SEQ ID NO: 24874 - RNA, 19 nt, Artificial Sequence
  Synthetic
ccccgucuccauguccagg

SEQ ID NO: 24875 - RNA, 20 nt, Artificial Sequence
  Synthetic
uccccgucuccauguccagg

SEQ ID NO: 24876 - RNA, 21 nt, Artificial Sequence
  Synthetic
uuccccgucuccauguccagg

SEQ ID NO: 24877 - RNA, 22 nt, Artificial Sequence
  Synthetic
guuccccgucuccauguccagg

SEQ ID NO: 24878 - RNA, 23 nt, Artificial Sequence
  Synthetic
uguuccccgucuccauguccagg

SEQ ID NO: 24879 - RNA, 24 nt, Artificial Sequence
  Synthetic
auguuccccgucuccauguccagg

SEQ ID NO: 24880 - RNA, 18 nt, Artificial Sequence
  Synthetic
aggcagaggaggaagagg

SEQ ID NO: 24881 - RNA, 19 nt, Artificial Sequence
  Synthetic
gaggcagaggaggaagagg

SEQ ID NO: 24882 - RNA, 20 nt, Artificial Sequence
  Synthetic
agaggcagaggaggaagagg

SEQ ID NO: 24883 - RNA, 21 nt, Artificial Sequence
  Synthetic
aagaggcagaggaggaagagg

SEQ ID NO: 24884 - RNA, 22 nt, Artificial Sequence
  Synthetic
gaagaggcagaggaggaagagg

SEQ ID NO: 24885 - RNA, 23 nt, Artificial Sequence
  Synthetic
ggaagaggcagaggaggaagagg

SEQ ID NO: 24886 - RNA, 24 nt, Artificial Sequence
  Synthetic
aggaagaggcagaggaggaagagg

SEQ ID NO: 24887 - RNA, 18 nt, Artificial Sequence
  Synthetic
gggccgaggaggaagagg

SEQ ID NO: 24888 - RNA, 19 nt, Artificial Sequence
  Synthetic
ggggccgaggaggaagagg

SEQ ID NO: 24889 - RNA, 20 nt, Artificial Sequence
  Synthetic
cggggccgaggaggaagagg

SEQ ID NO: 24890 - RNA, 21 nt, Artificial Sequence
  Synthetic
ucggggccgaggaggaagagg

SEQ ID NO: 24891 - RNA, 22 nt, Artificial Sequence
  Synthetic
gucggggccgaggaggaagagg

SEQ ID NO: 24892 - RNA, 23 nt, Artificial Sequence
  Synthetic
ggucggggccgaggaggaagagg

SEQ ID NO: 24893 - RNA, 24 nt, Artificial Sequence
  Synthetic
gggucggggccgaggaggaagagg

SEQ ID NO: 24894 - RNA, 18 nt, Artificial Sequence
  Synthetic
aggaggaagaggcagagg

SEQ ID NO: 24895 - RNA, 19 nt, Artificial Sequence
  Synthetic
gaggaggaagaggcagagg

SEQ ID NO: 24896 - RNA, 20 nt, Artificial Sequence
  Synthetic
cgaggaggaagaggcagagg

SEQ ID NO: 24897 - RNA, 21 nt, Artificial Sequence
  Synthetic
ccgaggaggaagaggcagagg

SEQ ID NO: 24898 - RNA, 22 nt, Artificial Sequence
  Synthetic
gccgaggaggaagaggcagagg

SEQ ID NO: 24899 - RNA, 23 nt, Artificial Sequence
  Synthetic
ggccgaggaggaagaggcagagg

SEQ ID NO: 24900 - RNA, 24 nt, Artificial Sequence
  Synthetic
gggccgaggaggaagaggcagagg

SEQ ID NO: 24901 - RNA, 18 nt, Artificial Sequence
  Synthetic
ggggccuguggggagagg

SEQ ID NO: 24902 - RNA, 19 nt, Artificial Sequence
  Synthetic
gggggccuguggggagagg

SEQ ID NO: 24903 - RNA, 20 nt, Artificial Sequence
  Synthetic
ggggggccuguggggagagg

SEQ ID NO: 24904 - RNA, 21 nt, Artificial Sequence
  Synthetic
cggggggccuguggggagagg

SEQ ID NO: 24905 - RNA, 22 nt, Artificial Sequence
  Synthetic
gcggggggccuguggggagagg

SEQ ID NO: 24906 - RNA, 23 nt, Artificial Sequence
  Synthetic
cgcggggggccuguggggagagg

SEQ ID NO: 24907 - RNA, 24 nt, Artificial Sequence
  Synthetic
ccgcggggggccuguggggagagg

SEQ ID NO: 24908 - RNA, 18 nt, Artificial Sequence
  Synthetic
cgggggucggggccgagg

SEQ ID NO: 24909 - RNA, 19 nt, Artificial Sequence
  Synthetic
gcgggggucggggccgagg

SEQ ID NO: 24910 - RNA, 20 nt, Artificial Sequence
  Synthetic
cgcgggggucggggccgagg

SEQ ID NO: 24911 - RNA, 21 nt, Artificial Sequence
  Synthetic
ccgcgggggucggggccgagg

SEQ ID NO: 24912 - RNA, 22 nt, Artificial Sequence
  Synthetic
cccgcgggggucggggccgagg

SEQ ID NO: 24913 - RNA, 23 nt, Artificial Sequence
  Synthetic
ccccgcgggggucggggccgagg

SEQ ID NO: 24914 - RNA, 24 nt, Artificial Sequence
  Synthetic
cccccgcgggggucggggccgagg

SEQ ID NO: 24915 - RNA, 18 nt, Artificial Sequence
  Synthetic
gccccugccggcgcgagg

SEQ ID NO: 24916 - RNA, 19 nt, Artificial Sequence
  Synthetic
ggccccugccggcgcgagg

SEQ ID NO: 24917 - RNA, 20 nt, Artificial Sequence
  Synthetic
uggccccugccggcgcgagg

SEQ ID NO: 24918 - RNA, 21 nt, Artificial Sequence
  Synthetic
uuggccccugccggcgcgagg

SEQ ID NO: 24919 - RNA, 22 nt, Artificial Sequence
  Synthetic
cuuggccccugccggcgcgagg

SEQ ID NO: 24920 - RNA, 23 nt, Artificial Sequence
  Synthetic
ucuuggccccugccggcgcgagg

SEQ ID NO: 24921 - RNA, 24 nt, Artificial Sequence
  Synthetic
cucuuggccccugccggcgcgagg

SEQ ID NO: 24922 - RNA, 18 nt, Artificial Sequence
  Synthetic
aggaagaggcagaggagg

SEQ ID NO: 24923 - RNA, 19 nt, Artificial Sequence
  Synthetic
gaggaagaggcagaggagg

SEQ ID NO: 24924 - RNA, 20 nt, Artificial Sequence
  Synthetic
ggaggaagaggcagaggagg

SEQ ID NO: 24925 - RNA, 21 nt, Artificial Sequence
  Synthetic
aggaggaagaggcagaggagg

SEQ ID NO: 24926 - RNA, 22 nt, Artificial Sequence
  Synthetic
gaggaggaagaggcagaggagg

SEQ ID NO: 24927 - RNA, 23 nt, Artificial Sequence
  Synthetic
cgaggaggaagaggcagaggagg

SEQ ID NO: 24928 - RNA, 24 nt, Artificial Sequence
  Synthetic
ccgaggaggaagaggcagaggagg

SEQ ID NO: 24929 - RNA, 18 nt, Artificial Sequence
  Synthetic
cggccccgcccgaggagg

SEQ ID NO: 24930 - RNA, 19 nt, Artificial Sequence
  Synthetic
acggccccgcccgaggagg

SEQ ID NO: 24931 - RNA, 20 nt, Artificial Sequence
  Synthetic
gacggccccgcccgaggagg

SEQ ID NO: 24932 - RNA, 21 nt, Artificial Sequence
  Synthetic
cgacggccccgcccgaggagg

SEQ ID NO: 24933 - RNA, 22 nt, Artificial Sequence
  Synthetic
ccgacggccccgcccgaggagg

SEQ ID NO: 24934 - RNA, 23 nt, Artificial Sequence
  Synthetic
accgacggccccgcccgaggagg

SEQ ID NO: 24935 - RNA, 24 nt, Artificial Sequence
  Synthetic
caccgacggccccgcccgaggagg

SEQ ID NO: 24936 - RNA, 18 nt, Artificial Sequence
  Synthetic
gggucggggccgaggagg

SEQ ID NO: 24937 - RNA, 19 nt, Artificial Sequence
  Synthetic
ggggucggggccgaggagg

SEQ ID NO: 24938 - RNA, 20 nt, Artificial Sequence
  Synthetic
gggggucggggccgaggagg

SEQ ID NO: 24939 - RNA, 21 nt, Artificial Sequence
  Synthetic
cgggggucggggccgaggagg

SEQ ID NO: 24940 - RNA, 22 nt, Artificial Sequence
  Synthetic
gcgggggucggggccgaggagg

SEQ ID NO: 24941 - RNA, 23 nt, Artificial Sequence
  Synthetic
cgcgggggucggggccgaggagg

SEQ ID NO: 24942 - RNA, 24 nt, Artificial Sequence
  Synthetic
ccgcgggggucggggccgaggagg

SEQ ID NO: 24943 - RNA, 18 nt, Artificial Sequence
  Synthetic
caaccccaacccccccgg

SEQ ID NO: 24944 - RNA, 19 nt, Artificial Sequence
  Synthetic
ccaaccccaacccccccgg

SEQ ID NO: 24945 - RNA, 20 nt, Artificial Sequence
  Synthetic
cccaaccccaacccccccgg

SEQ ID NO: 24946 - RNA, 21 nt, Artificial Sequence
  Synthetic
ccccaaccccaacccccccgg

SEQ ID NO: 24947 - RNA, 22 nt, Artificial Sequence
  Synthetic
accccaaccccaacccccccgg

SEQ ID NO: 24948 - RNA, 23 nt, Artificial Sequence
  Synthetic
aaccccaaccccaacccccccgg

SEQ ID NO: 24949 - RNA, 24 nt, Artificial Sequence
  Synthetic
caaccccaaccccaacccccccgg

SEQ ID NO: 24950 - RNA, 18 nt, Artificial Sequence
  Synthetic
ggagcggggcggcgccgg

SEQ ID NO: 24951 - RNA, 19 nt, Artificial Sequence
  Synthetic
gggagcggggcggcgccgg

SEQ ID NO: 24952 - RNA, 20 nt, Artificial Sequence
  Synthetic
ggggagcggggcggcgccgg

SEQ ID NO: 24953 - RNA, 21 nt, Artificial Sequence
  Synthetic
aggggagcggggcggcgccgg

SEQ ID NO: 24954 - RNA, 22 nt, Artificial Sequence
  Synthetic
gaggggagcggggcggcgccgg

SEQ ID NO: 24955 - RNA, 23 nt, Artificial Sequence
  Synthetic
ggaggggagcggggcggcgccgg

SEQ ID NO: 24956 - RNA, 24 nt, Artificial Sequence
  Synthetic
cggaggggagcggggcggcgccgg

SEQ ID NO: 24957 - RNA, 18 nt, Artificial Sequence
  Synthetic
ccuguggggagaggccgg

SEQ ID NO: 24958 - RNA, 19 nt, Artificial Sequence
  Synthetic
gccuguggggagaggccgg

SEQ ID NO: 24959 - RNA, 20 nt, Artificial Sequence
  Synthetic
ggccuguggggagaggccgg

SEQ ID NO: 24960 - RNA, 21 nt, Artificial Sequence
  Synthetic
gggccuguggggagaggccgg

SEQ ID NO: 24961 - RNA, 22 nt, Artificial Sequence
  Synthetic
ggggccuguggggagaggccgg

SEQ ID NO: 24962 - RNA, 23 nt, Artificial Sequence
  Synthetic
gggggccuguggggagaggccgg

SEQ ID NO: 24963 - RNA, 24 nt, Artificial Sequence
  Synthetic
ggggggccuguggggagaggccgg

SEQ ID NO: 24964 - RNA, 18 nt, Artificial Sequence
  Synthetic
uguccgagccgcggccgg

SEQ ID NO: 24965 - RNA, 19 nt, Artificial Sequence
  Synthetic
cuguccgagccgcggccgg

SEQ ID NO: 24966 - RNA, 20 nt, Artificial Sequence
  Synthetic
gcuguccgagccgcggccgg

SEQ ID NO: 24967 - RNA, 21 nt, Artificial Sequence
  Synthetic
cgcuguccgagccgcggccgg

SEQ ID NO: 24968 - RNA, 22 nt, Artificial Sequence
  Synthetic
gcgcuguccgagccgcggccgg

SEQ ID NO: 24969 - RNA, 23 nt, Artificial Sequence
  Synthetic
ggcgcuguccgagccgcggccgg

SEQ ID NO: 24970 - RNA, 24 nt, Artificial Sequence
  Synthetic
gggcgcuguccgagccgcggccgg

SEQ ID NO: 24971 - RNA, 18 nt, Artificial Sequence
  Synthetic
ggggcgcggggcguccgg

SEQ ID NO: 24972 - RNA, 19 nt, Artificial Sequence
  Synthetic
gggggcgcggggcguccgg

SEQ ID NO: 24973 - RNA, 20 nt, Artificial Sequence
  Synthetic
ggggggcgcggggcguccgg

SEQ ID NO: 24974 - RNA, 21 nt, Artificial Sequence
  Synthetic
gggggggcgcggggcguccgg

SEQ ID NO: 24975 - RNA, 22 nt, Artificial Sequence
  Synthetic
ugggggggcgcggggcguccgg

SEQ ID NO: 24976 - RNA, 23 nt, Artificial Sequence
  Synthetic
gugggggggcgcggggcguccgg

SEQ ID NO: 24977 - RNA, 24 nt, Artificial Sequence
  Synthetic
cgugggggggcgcggggcguccgg

SEQ ID NO: 24978 - RNA, 18 nt, Artificial Sequence
  Synthetic
ccgaggaggcggaagcgg

SEQ ID NO: 24979 - RNA, 19 nt, Artificial Sequence
  Synthetic
cccgaggaggcggaagcgg

SEQ ID NO: 24980 - RNA, 20 nt, Artificial Sequence
  Synthetic
gcccgaggaggcggaagcgg

SEQ ID NO: 24981 - RNA, 21 nt, Artificial Sequence
  Synthetic
cgcccgaggaggcggaagcgg

SEQ ID NO: 24982 - RNA, 22 nt, Artificial Sequence
  Synthetic
ccgcccgaggaggcggaagcgg

SEQ ID NO: 24983 - RNA, 23 nt, Artificial Sequence
  Synthetic
cccgcccgaggaggcggaagcgg

SEQ ID NO: 24984 - RNA, 24 nt, Artificial Sequence
  Synthetic
ccccgcccgaggaggcggaagcgg

SEQ ID NO: 24985 - RNA, 18 nt, Artificial Sequence
  Synthetic
gagggggcggcgccgcgg

SEQ ID NO: 24986 - RNA, 19 nt, Artificial Sequence
  Synthetic
ggagggggcggcgccgcgg

SEQ ID NO: 24987 - RNA, 20 nt, Artificial Sequence
  Synthetic
cggagggggcggcgccgcgg

SEQ ID NO: 24988 - RNA, 21 nt, Artificial Sequence
  Synthetic
ccggagggggcggcgccgcgg

SEQ ID NO: 24989 - RNA, 22 nt, Artificial Sequence
  Synthetic
gccggagggggcggcgccgcgg

SEQ ID NO: 24990 - RNA, 23 nt, Artificial Sequence
  Synthetic
cgccggagggggcggcgccgcgg

SEQ ID NO: 24991 - RNA, 24 nt, Artificial Sequence
  Synthetic
gcgccggagggggcggcgccgcgg

SEQ ID NO: 24992 - RNA, 18 nt, Artificial Sequence
  Synthetic
ccugcucgacagaggcgg

SEQ ID NO: 24993 - RNA, 19 nt, Artificial Sequence
  Synthetic
uccugcucgacagaggcgg

SEQ ID NO: 24994 - RNA, 20 nt, Artificial Sequence
  Synthetic
cuccugcucgacagaggcgg

SEQ ID NO: 24995 - RNA, 21 nt, Artificial Sequence
  Synthetic
ccuccugcucgacagaggcgg

SEQ ID NO: 24996 - RNA, 22 nt, Artificial Sequence
  Synthetic
gccuccugcucgacagaggcgg

SEQ ID NO: 24997 - RNA, 23 nt, Artificial Sequence
  Synthetic
cgccuccugcucgacagaggcgg

SEQ ID NO: 24998 - RNA, 24 nt, Artificial Sequence
  Synthetic
ccgccuccugcucgacagaggcgg

SEQ ID NO: 24999 - RNA, 18 nt, Artificial Sequence
  Synthetic
aggacgcggccccggcgg

SEQ ID NO: 25000 - RNA, 19 nt, Artificial Sequence
  Synthetic
gaggacgcggccccggcgg

SEQ ID NO: 25001 - RNA, 20 nt, Artificial Sequence
  Synthetic
ggaggacgcggccccggcgg

SEQ ID NO: 25002 - RNA, 21 nt, Artificial Sequence
  Synthetic
aggaggacgcggccccggcgg

SEQ ID NO: 25003 - RNA, 22 nt, Artificial Sequence
  Synthetic
gaggaggacgcggccccggcgg

SEQ ID NO: 25004 - RNA, 23 nt, Artificial Sequence
  Synthetic
ggaggaggacgcggccccggcgg

SEQ ID NO: 25005 - RNA, 24 nt, Artificial Sequence
  Synthetic
cggaggaggacgcggccccggcgg

SEQ ID NO: 25006 - RNA, 18 nt, Artificial Sequence
  Synthetic
gcucgacagaggcggcgg

SEQ ID NO: 25007 - RNA, 19 nt, Artificial Sequence
  Synthetic
ugcucgacagaggcggcgg

SEQ ID NO: 25008 - RNA, 20 nt, Artificial Sequence
  Synthetic
cugcucgacagaggcggcgg

SEQ ID NO: 25009 - RNA, 21 nt, Artificial Sequence
  Synthetic
ccugcucgacagaggcggcgg

SEQ ID NO: 25010 - RNA, 22 nt, Artificial Sequence
  Synthetic
uccugcucgacagaggcggcgg

SEQ ID NO: 25011 - RNA, 23 nt, Artificial Sequence
  Synthetic
cuccugcucgacagaggcggcgg

SEQ ID NO: 25012 - RNA, 24 nt, Artificial Sequence
  Synthetic
ccuccugcucgacagaggcggcgg

SEQ ID NO: 25013 - RNA, 18 nt, Artificial Sequence
  Synthetic
acgcggccccggcggcgg

SEQ ID NO: 25014 - RNA, 19 nt, Artificial Sequence
  Synthetic
gacgcggccccggcggcgg

SEQ ID NO: 25015 - RNA, 20 nt, Artificial Sequence
  Synthetic
ggacgcggccccggcggcgg

SEQ ID NO: 25016 - RNA, 21 nt, Artificial Sequence
  Synthetic
aggacgcggccccggcggcgg

SEQ ID NO: 25017 - RNA, 22 nt, Artificial Sequence
  Synthetic
gaggacgcggccccggcggcgg

SEQ ID NO: 25018 - RNA, 23 nt, Artificial Sequence
  Synthetic
ggaggacgcggccccggcggcgg

SEQ ID NO: 25019 - RNA, 24 nt, Artificial Sequence
  Synthetic
aggaggacgcggccccggcggcgg

SEQ ID NO: 25020 - RNA, 18 nt, Artificial Sequence
  Synthetic
cccccggcccugagucgg

SEQ ID NO: 25021 - RNA, 19 nt, Artificial Sequence
  Synthetic
ccccccggcccugagucgg

SEQ ID NO: 25022 - RNA, 20 nt, Artificial Sequence
  Synthetic
cccccccggcccugagucgg

SEQ ID NO: 25023 - RNA, 21 nt, Artificial Sequence
  Synthetic
gcccccccggcccugagucgg

SEQ ID NO: 25024 - RNA, 22 nt, Artificial Sequence
  Synthetic
cgcccccccggcccugagucgg

SEQ ID NO: 25025 - RNA, 23 nt, Artificial Sequence
  Synthetic
gcgcccccccggcccugagucgg

SEQ ID NO: 25026 - RNA, 24 nt, Artificial Sequence
  Synthetic
cgcgcccccccggcccugagucgg

SEQ ID NO: 25027 - RNA, 18 nt, Artificial Sequence
  Synthetic
ccccugccggcgcgaggg

SEQ ID NO: 25028 - RNA, 19 nt, Artificial Sequence
  Synthetic
gccccugccggcgcgaggg

SEQ ID NO: 25029 - RNA, 20 nt, Artificial Sequence
  Synthetic
ggccccugccggcgcgaggg

SEQ ID NO: 25030 - RNA, 21 nt, Artificial Sequence
  Synthetic
uggccccugccggcgcgaggg

SEQ ID NO: 25031 - RNA, 22 nt, Artificial Sequence
  Synthetic
uuggccccugccggcgcgaggg

SEQ ID NO: 25032 - RNA, 23 nt, Artificial Sequence
  Synthetic
cuuggccccugccggcgcgaggg

SEQ ID NO: 25033 - RNA, 24 nt, Artificial Sequence
  Synthetic
ucuuggccccugccggcgcgaggg

SEQ ID NO: 25034 - RNA, 18 nt, Artificial Sequence
  Synthetic
ggacgcggggggcccggg

SEQ ID NO: 25035 - RNA, 19 nt, Artificial Sequence
  Synthetic
cggacgcggggggcccggg

SEQ ID NO: 25036 - RNA, 20 nt, Artificial Sequence
  Synthetic
gcggacgcggggggcccggg

SEQ ID NO: 25037 - RNA, 21 nt, Artificial Sequence
  Synthetic
cgcggacgcggggggcccggg

SEQ ID NO: 25038 - RNA, 22 nt, Artificial Sequence
  Synthetic
ccgcggacgcggggggcccggg

SEQ ID NO: 25039 - RNA, 23 nt, Artificial Sequence
  Synthetic
gccgcggacgcggggggcccggg

SEQ ID NO: 25040 - RNA, 24 nt, Artificial Sequence
  Synthetic
ggccgcggacgcggggggcccggg

SEQ ID NO: 25041 - RNA, 18 nt, Artificial Sequence
  Synthetic
cuguggggagaggccggg

SEQ ID NO: 25042 - RNA, 19 nt, Artificial Sequence
  Synthetic
ccuguggggagaggccggg

SEQ ID NO: 25043 - RNA, 20 nt, Artificial Sequence
  Synthetic
gccuguggggagaggccggg

SEQ ID NO: 25044 - RNA, 21 nt, Artificial Sequence
  Synthetic
ggccuguggggagaggccggg

SEQ ID NO: 25045 - RNA, 22 nt, Artificial Sequence
  Synthetic
gggccuguggggagaggccggg

SEQ ID NO: 25046 - RNA, 23 nt, Artificial Sequence
  Synthetic
ggggccuguggggagaggccggg

SEQ ID NO: 25047 - RNA, 24 nt, Artificial Sequence
  Synthetic
gggggccuguggggagaggccggg

SEQ ID NO: 25048 - RNA, 18 nt, Artificial Sequence
  Synthetic
agggucagguaccgcggg

SEQ ID NO: 25049 - RNA, 19 nt, Artificial Sequence
  Synthetic
cagggucagguaccgcggg

SEQ ID NO: 25050 - RNA, 20 nt, Artificial Sequence
  Synthetic
ccagggucagguaccgcggg

SEQ ID NO: 25051 - RNA, 21 nt, Artificial Sequence
  Synthetic
cccagggucagguaccgcggg

SEQ ID NO: 25052 - RNA, 22 nt, Artificial Sequence
  Synthetic
ccccagggucagguaccgcggg

SEQ ID NO: 25053 - RNA, 23 nt, Artificial Sequence
  Synthetic
cccccagggucagguaccgcggg

SEQ ID NO: 25054 - RNA, 24 nt, Artificial Sequence
  Synthetic
ccccccagggucagguaccgcggg

SEQ ID NO: 25055 - RNA, 18 nt, Artificial Sequence
  Synthetic
acggcgcgcguccgcggg

SEQ ID NO: 25056 - RNA, 19 nt, Artificial Sequence
  Synthetic
cacggcgcgcguccgcggg

SEQ ID NO: 25057 - RNA, 20 nt, Artificial Sequence
  Synthetic
acacggcgcgcguccgcggg

SEQ ID NO: 25058 - RNA, 21 nt, Artificial Sequence
  Synthetic
cacacggcgcgcguccgcggg

SEQ ID NO: 25059 - RNA, 22 nt, Artificial Sequence
  Synthetic
gcacacggcgcgcguccgcggg

SEQ ID NO: 25060 - RNA, 23 nt, Artificial Sequence
  Synthetic
ggcacacggcgcgcguccgcggg

SEQ ID NO: 25061 - RNA, 24 nt, Artificial Sequence
  Synthetic
gggcacacggcgcgcguccgcggg

SEQ ID NO: 25062 - RNA, 18 nt, Artificial Sequence
  Synthetic
gacgcggggggcccgggg

SEQ ID NO: 25063 - RNA, 19 nt, Artificial Sequence
  Synthetic
ggacgcggggggcccgggg

SEQ ID NO: 25064 - RNA, 20 nt, Artificial Sequence
  Synthetic
cggacgcggggggcccgggg

SEQ ID NO: 25065 - RNA, 21 nt, Artificial Sequence
  Synthetic
gcggacgcggggggcccgggg

SEQ ID NO: 25066 - RNA, 22 nt, Artificial Sequence
  Synthetic
cgcggacgcggggggcccgggg

SEQ ID NO: 25067 - RNA, 23 nt, Artificial Sequence
  Synthetic
ccgcggacgcggggggcccgggg

SEQ ID NO: 25068 - RNA, 24 nt, Artificial Sequence
  Synthetic
gccgcggacgcggggggcccgggg

SEQ ID NO: 25069 - RNA, 18 nt, Artificial Sequence
  Synthetic
cccccgcgggggucgggg

SEQ ID NO: 25070 - RNA, 19 nt, Artificial Sequence
  Synthetic
gcccccgcgggggucgggg

SEQ ID NO: 25071 - RNA, 20 nt, Artificial Sequence
  Synthetic
ggcccccgcgggggucgggg

SEQ ID NO: 25072 - RNA, 21 nt, Artificial Sequence
  Synthetic
cggcccccgcgggggucgggg

SEQ ID NO: 25073 - RNA, 22 nt, Artificial Sequence
  Synthetic
gcggcccccgcgggggucgggg

SEQ ID NO: 25074 - RNA, 23 nt, Artificial Sequence
  Synthetic
ggcggcccccgcgggggucgggg

SEQ ID NO: 25075 - RNA, 24 nt, Artificial Sequence
  Synthetic
aggcggcccccgcgggggucgggg

SEQ ID NO: 25076 - RNA, 18 nt, Artificial Sequence
  Synthetic
ccggcuccgccccggggg

SEQ ID NO: 25077 - RNA, 19 nt, Artificial Sequence
  Synthetic
gccggcuccgccccggggg

SEQ ID NO: 25078 - RNA, 20 nt, Artificial Sequence
  Synthetic
ggccggcuccgccccggggg

SEQ ID NO: 25079 - RNA, 21 nt, Artificial Sequence
  Synthetic
cggccggcuccgccccggggg

SEQ ID NO: 25080 - RNA, 22 nt, Artificial Sequence
  Synthetic
gcggccggcuccgccccggggg

SEQ ID NO: 25081 - RNA, 23 nt, Artificial Sequence
  Synthetic
ggcggccggcuccgccccggggg

SEQ ID NO: 25082 - RNA, 24 nt, Artificial Sequence
  Synthetic
gggcggccggcuccgccccggggg

SEQ ID NO: 25083 - RNA, 18 nt, Artificial Sequence
  Synthetic
aggcggcccccgcggggg

SEQ ID NO: 25084 - RNA, 19 nt, Artificial Sequence
  Synthetic
gaggcggcccccgcggggg

SEQ ID NO: 25085 - RNA, 20 nt, Artificial Sequence
  Synthetic
agaggcggcccccgcggggg

SEQ ID NO: 25086 - RNA, 21 nt, Artificial Sequence
  Synthetic
aagaggcggcccccgcggggg

SEQ ID NO: 25087 - RNA, 22 nt, Artificial Sequence
  Synthetic
gaagaggcggcccccgcggggg

SEQ ID NO: 25088 - RNA, 23 nt, Artificial Sequence
  Synthetic
ggaagaggcggcccccgcggggg

SEQ ID NO: 25089 - RNA, 24 nt, Artificial Sequence
  Synthetic
cggaagaggcggcccccgcggggg

SEQ ID NO: 25090 - RNA, 18 nt, Artificial Sequence
  Synthetic
ccagaagcagcgcggggg

SEQ ID NO: 25091 - RNA, 19 nt, Artificial Sequence
  Synthetic
cccagaagcagcgcggggg

SEQ ID NO: 25092 - RNA, 20 nt, Artificial Sequence
  Synthetic
gcccagaagcagcgcggggg

SEQ ID NO: 25093 - RNA, 21 nt, Artificial Sequence
  Synthetic
ggcccagaagcagcgcggggg

SEQ ID NO: 25094 - RNA, 22 nt, Artificial Sequence
  Synthetic
cggcccagaagcagcgcggggg

SEQ ID NO: 25095 - RNA, 23 nt, Artificial Sequence
  Synthetic
gcggcccagaagcagcgcggggg

SEQ ID NO: 25096 - RNA, 24 nt, Artificial Sequence
  Synthetic
cgcggcccagaagcagcgcggggg

SEQ ID NO: 25097 - RNA, 18 nt, Artificial Sequence
  Synthetic
ggggccggggcgcggggg

SEQ ID NO: 25098 - RNA, 19 nt, Artificial Sequence
  Synthetic
gggggccggggcgcggggg

SEQ ID NO: 25099 - RNA, 20 nt, Artificial Sequence
  Synthetic
cgggggccggggcgcggggg

SEQ ID NO: 25100 - RNA, 21 nt, Artificial Sequence
  Synthetic
ccgggggccggggcgcggggg

SEQ ID NO: 25101 - RNA, 22 nt, Artificial Sequence
  Synthetic
cccgggggccggggcgcggggg

SEQ ID NO: 25102 - RNA, 23 nt, Artificial Sequence
  Synthetic
ccccgggggccggggcgcggggg

SEQ ID NO: 25103 - RNA, 24 nt, Artificial Sequence
  Synthetic
gccccgggggccggggcgcggggg

SEQ ID NO: 25104 - RNA, 18 nt, Artificial Sequence
  Synthetic
cggggcguccggcggggg

SEQ ID NO: 25105 - RNA, 19 nt, Artificial Sequence
  Synthetic
gcggggcguccggcggggg

SEQ ID NO: 25106 - RNA, 20 nt, Artificial Sequence
  Synthetic
cgcggggcguccggcggggg

SEQ ID NO: 25107 - RNA, 21 nt, Artificial Sequence
  Synthetic
gcgcggggcguccggcggggg

SEQ ID NO: 25108 - RNA, 22 nt, Artificial Sequence
  Synthetic
ggcgcggggcguccggcggggg

SEQ ID NO: 25109 - RNA, 23 nt, Artificial Sequence
  Synthetic
gggcgcggggcguccggcggggg

SEQ ID NO: 25110 - RNA, 24 nt, Artificial Sequence
  Synthetic
ggggcgcggggcguccggcggggg

SEQ ID NO: 25111 - RNA, 18 nt, Artificial Sequence
  Synthetic
gggggcccggggcggggg

SEQ ID NO: 25112 - RNA, 19 nt, Artificial Sequence
  Synthetic
ggggggcccggggcggggg

SEQ ID NO: 25113 - RNA, 20 nt, Artificial Sequence
  Synthetic
cggggggcccggggcggggg

SEQ ID NO: 25114 - RNA, 21 nt, Artificial Sequence
  Synthetic
gcggggggcccggggcggggg

SEQ ID NO: 25115 - RNA, 22 nt, Artificial Sequence
  Synthetic
cgcggggggcccggggcggggg

SEQ ID NO: 25116 - RNA, 23 nt, Artificial Sequence
  Synthetic
acgcggggggcccggggcggggg

SEQ ID NO: 25117 - RNA, 24 nt, Artificial Sequence
  Synthetic
gacgcggggggcccggggcggggg

SEQ ID NO: 25118 - RNA, 18 nt, Artificial Sequence
  Synthetic
ggggcccggggcgggggg

SEQ ID NO: 25119 - RNA, 19 nt, Artificial Sequence
  Synthetic
gggggcccggggcgggggg

SEQ ID NO: 25120 - RNA, 20 nt, Artificial Sequence
  Synthetic
ggggggcccggggcgggggg

SEQ ID NO: 25121 - RNA, 21 nt, Artificial Sequence
  Synthetic
cggggggcccggggcgggggg

SEQ ID NO: 25122 - RNA, 22 nt, Artificial Sequence
  Synthetic
gcggggggcccggggcgggggg

SEQ ID NO: 25123 - RNA, 23 nt, Artificial Sequence
  Synthetic
cgcggggggcccggggcgggggg

SEQ ID NO: 25124 - RNA, 24 nt, Artificial Sequence
  Synthetic
acgcggggggcccggggcgggggg

SEQ ID NO: 25125 - RNA, 18 nt, Artificial Sequence
  Synthetic
ggacgcguggacuggggg

SEQ ID NO: 25126 - RNA, 19 nt, Artificial Sequence
  Synthetic
gggacgcguggacuggggg

SEQ ID NO: 25127 - RNA, 20 nt, Artificial Sequence
  Synthetic
ggggacgcguggacuggggg

SEQ ID NO: 25128 - RNA, 21 nt, Artificial Sequence
  Synthetic
gggggacgcguggacuggggg

SEQ ID NO: 25129 - RNA, 22 nt, Artificial Sequence
  Synthetic
ggggggacgcguggacuggggg

SEQ ID NO: 25130 - RNA, 23 nt, Artificial Sequence
  Synthetic
gggggggacgcguggacuggggg

SEQ ID NO: 25131 - RNA, 24 nt, Artificial Sequence
  Synthetic
agggggggacgcguggacuggggg

SEQ ID NO: 25132 - RNA, 18 nt, Artificial Sequence
  Synthetic
ggggacgcguggacuggg

SEQ ID NO: 25133 - RNA, 19 nt, Artificial Sequence
  Synthetic
gggggacgcguggacuggg

SEQ ID NO: 25134 - RNA, 20 nt, Artificial Sequence
  Synthetic
ggggggacgcguggacuggg

SEQ ID NO: 25135 - RNA, 21 nt, Artificial Sequence
  Synthetic
gggggggacgcguggacuggg

SEQ ID NO: 25136 - RNA, 22 nt, Artificial Sequence
  Synthetic
agggggggacgcguggacuggg

SEQ ID NO: 25137 - RNA, 23 nt, Artificial Sequence
  Synthetic
gagggggggacgcguggacuggg

SEQ ID NO: 25138 - RNA, 24 nt, Artificial Sequence
  Synthetic
cgagggggggacgcguggacuggg

SEQ ID NO: 25139 - RNA, 18 nt, Artificial Sequence
  Synthetic
ccgcggggggccuguggg

SEQ ID NO: 25140 - RNA, 19 nt, Artificial Sequence
  Synthetic
gccgcggggggccuguggg

SEQ ID NO: 25141 - RNA, 20 nt, Artificial Sequence
  Synthetic
cgccgcggggggccuguggg

SEQ ID NO: 25142 - RNA, 21 nt, Artificial Sequence
  Synthetic
gcgccgcggggggccuguggg

SEQ ID NO: 25143 - RNA, 22 nt, Artificial Sequence
  Synthetic
ggcgccgcggggggccuguggg

SEQ ID NO: 25144 - RNA, 23 nt, Artificial Sequence
  Synthetic
gggcgccgcggggggccuguggg

SEQ ID NO: 25145 - RNA, 24 nt, Artificial Sequence
  Synthetic
ugggcgccgcggggggccuguggg

SEQ ID NO: 25146 - RNA, 18 nt, Artificial Sequence
  Synthetic
gccgcggcucgcgacugg

SEQ ID NO: 25147 - RNA, 19 nt, Artificial Sequence
  Synthetic
cgccgcggcucgcgacugg

SEQ ID NO: 25148 - RNA, 20 nt, Artificial Sequence
  Synthetic
gcgccgcggcucgcgacugg

SEQ ID NO: 25149 - RNA, 21 nt, Artificial Sequence
  Synthetic
ggcgccgcggcucgcgacugg

SEQ ID NO: 25150 - RNA, 22 nt, Artificial Sequence
  Synthetic
cggcgccgcggcucgcgacugg

SEQ ID NO: 25151 - RNA, 23 nt, Artificial Sequence
  Synthetic
gcggcgccgcggcucgcgacugg

SEQ ID NO: 25152 - RNA, 24 nt, Artificial Sequence
  Synthetic
cgcggcgccgcggcucgcgacugg

SEQ ID NO: 25153 - RNA, 18 nt, Artificial Sequence
  Synthetic
gggggacgcguggacugg

SEQ ID NO: 25154 - RNA, 19 nt, Artificial Sequence
  Synthetic
ggggggacgcguggacugg

SEQ ID NO: 25155 - RNA, 20 nt, Artificial Sequence
  Synthetic
gggggggacgcguggacugg

SEQ ID NO: 25156 - RNA, 21 nt, Artificial Sequence
  Synthetic
agggggggacgcguggacugg

SEQ ID NO: 25157 - RNA, 22 nt, Artificial Sequence
  Synthetic
gagggggggacgcguggacugg

SEQ ID NO: 25158 - RNA, 23 nt, Artificial Sequence
  Synthetic
cgagggggggacgcguggacugg

SEQ ID NO: 25159 - RNA, 24 nt, Artificial Sequence
  Synthetic
gcgagggggggacgcguggacugg

SEQ ID NO: 25160 - RNA, 18 nt, Artificial Sequence
  Synthetic
cccacuagggugcccugg

SEQ ID NO: 25161 - RNA, 19 nt, Artificial Sequence
  Synthetic
gcccacuagggugcccugg

SEQ ID NO: 25162 - RNA, 20 nt, Artificial Sequence
  Synthetic
cgcccacuagggugcccugg

SEQ ID NO: 25163 - RNA, 21 nt, Artificial Sequence
  Synthetic
gcgcccacuagggugcccugg

SEQ ID NO: 25164 - RNA, 22 nt, Artificial Sequence
  Synthetic
ggcgcccacuagggugcccugg

SEQ ID NO: 25165 - RNA, 23 nt, Artificial Sequence
  Synthetic
gggcgcccacuagggugcccugg

SEQ ID NO: 25166 - RNA, 24 nt, Artificial Sequence
  Synthetic
agggcgcccacuagggugcccugg

SEQ ID NO: 25167 - RNA, 18 nt, Artificial Sequence
  Synthetic
ggcggcgccucugcgugg

SEQ ID NO: 25168 - RNA, 19 nt, Artificial Sequence
  Synthetic
cggcggcgccucugcgugg

SEQ ID NO: 25169 - RNA, 20 nt, Artificial Sequence
  Synthetic
gcggcggcgccucugcgugg

SEQ ID NO: 25170 - RNA, 21 nt, Artificial Sequence
  Synthetic
cgcggcggcgccucugcgugg

SEQ ID NO: 25171 - RNA, 22 nt, Artificial Sequence
  Synthetic
gcgcggcggcgccucugcgugg

SEQ ID NO: 25172 - RNA, 23 nt, Artificial Sequence
  Synthetic
ggcgcggcggcgccucugcgugg

SEQ ID NO: 25173 - RNA, 24 nt, Artificial Sequence
  Synthetic
gggcgcggcggcgccucugcgugg

SEQ ID NO: 25174 - RNA, 18 nt, Artificial Sequence
  Synthetic
guggugggcuccgggugg

SEQ ID NO: 25175 - RNA, 19 nt, Artificial Sequence
  Synthetic
cguggugggcuccgggugg

SEQ ID NO: 25176 - RNA, 20 nt, Artificial Sequence
  Synthetic
ccguggugggcuccgggugg

SEQ ID NO: 25177 - RNA, 21 nt, Artificial Sequence
  Synthetic
uccguggugggcuccgggugg

SEQ ID NO: 25178 - RNA, 22 nt, Artificial Sequence
  Synthetic
guccguggugggcuccgggugg

SEQ ID NO: 25179 - RNA, 23 nt, Artificial Sequence
  Synthetic
cguccguggugggcuccgggugg

SEQ ID NO: 25180 - RNA, 24 nt, Artificial Sequence
  Synthetic
ucguccguggugggcuccgggugg

SEQ ID NO: 25181 - RNA, 18 nt, Artificial Sequence
  Synthetic
cgccgcggcucgcgacug

SEQ ID NO: 25182 - RNA, 19 nt, Artificial Sequence
  Synthetic
gcgccgcggcucgcgacug

SEQ ID NO: 25183 - RNA, 20 nt, Artificial Sequence
  Synthetic
ggcgccgcggcucgcgacug

SEQ ID NO: 25184 - RNA, 21 nt, Artificial Sequence
  Synthetic
cggcgccgcggcucgcgacug

SEQ ID NO: 25185 - RNA, 22 nt, Artificial Sequence
  Synthetic
gcggcgccgcggcucgcgacug

SEQ ID NO: 25186 - RNA, 23 nt, Artificial Sequence
  Synthetic
cgcggcgccgcggcucgcgacug

SEQ ID NO: 25187 - RNA, 24 nt, Artificial Sequence
  Synthetic
ccgcggcgccgcggcucgcgacug

SEQ ID NO: 25188 - RNA, 18 nt, Artificial Sequence
  Synthetic
ggggggacgcguggacug

SEQ ID NO: 25189 - RNA, 19 nt, Artificial Sequence
  Synthetic
gggggggacgcguggacug

SEQ ID NO: 25190 - RNA, 20 nt, Artificial Sequence
  Synthetic
agggggggacgcguggacug

SEQ ID NO: 25191 - RNA, 21 nt, Artificial Sequence
  Synthetic
gagggggggacgcguggacug

SEQ ID NO: 25192 - RNA, 22 nt, Artificial Sequence
  Synthetic
cgagggggggacgcguggacug

SEQ ID NO: 25193 - RNA, 23 nt, Artificial Sequence
  Synthetic
gcgagggggggacgcguggacug

SEQ ID NO: 25194 - RNA, 24 nt, Artificial Sequence
  Synthetic
cgcgagggggggacgcguggacug

SEQ ID NO: 25195 - RNA, 18 nt, Artificial Sequence
  Synthetic
ggcgccgcggggggccug

SEQ ID NO: 25196 - RNA, 19 nt, Artificial Sequence
  Synthetic
gggcgccgcggggggccug

SEQ ID NO: 25197 - RNA, 20 nt, Artificial Sequence
  Synthetic
ugggcgccgcggggggccug

SEQ ID NO: 25198 - RNA, 21 nt, Artificial Sequence
  Synthetic
augggcgccgcggggggccug

SEQ ID NO: 25199 - RNA, 22 nt, Artificial Sequence
  Synthetic
caugggcgccgcggggggccug

SEQ ID NO: 25200 - RNA, 23 nt, Artificial Sequence
  Synthetic
gcaugggcgccgcggggggccug

SEQ ID NO: 25201 - RNA, 24 nt, Artificial Sequence
  Synthetic
ggcaugggcgccgcggggggccug

SEQ ID NO: 25202 - RNA, 18 nt, Artificial Sequence
  Synthetic
ugccgagaccgcaggcug

SEQ ID NO: 25203 - RNA, 19 nt, Artificial Sequence
  Synthetic
gugccgagaccgcaggcug

SEQ ID NO: 25204 - RNA, 20 nt, Artificial Sequence
  Synthetic
ggugccgagaccgcaggcug

SEQ ID NO: 25205 - RNA, 21 nt, Artificial Sequence
  Synthetic
gggugccgagaccgcaggcug

SEQ ID NO: 25206 - RNA, 22 nt, Artificial Sequence
  Synthetic
cgggugccgagaccgcaggcug

SEQ ID NO: 25207 - RNA, 23 nt, Artificial Sequence
  Synthetic
acgggugccgagaccgcaggcug

SEQ ID NO: 25208 - RNA, 24 nt, Artificial Sequence
  Synthetic
cacgggugccgagaccgcaggcug

SEQ ID NO: 25209 - RNA, 18 nt, Artificial Sequence
  Synthetic
ccgagccgcggccggcug

SEQ ID NO: 25210 - RNA, 19 nt, Artificial Sequence
  Synthetic
uccgagccgcggccggcug

SEQ ID NO: 25211 - RNA, 20 nt, Artificial Sequence
  Synthetic
guccgagccgcggccggcug

SEQ ID NO: 25212 - RNA, 21 nt, Artificial Sequence
  Synthetic
uguccgagccgcggccggcug

SEQ ID NO: 25213 - RNA, 22 nt, Artificial Sequence
  Synthetic
cuguccgagccgcggccggcug

SEQ ID NO: 25214 - RNA, 23 nt, Artificial Sequence
  Synthetic
gcuguccgagccgcggccggcug

SEQ ID NO: 25215 - RNA, 24 nt, Artificial Sequence
  Synthetic
cgcuguccgagccgcggccggcug

SEQ ID NO: 25216 - RNA, 18 nt, Artificial Sequence
  Synthetic
ucgucauccucguccgug

SEQ ID NO: 25217 - RNA, 19 nt, Artificial Sequence
  Synthetic
gucgucauccucguccgug

SEQ ID NO: 25218 - RNA, 20 nt, Artificial Sequence
  Synthetic
cgucgucauccucguccgug

SEQ ID NO: 25219 - RNA, 21 nt, Artificial Sequence
  Synthetic
ucgucgucauccucguccgug

SEQ ID NO: 25220 - RNA, 22 nt, Artificial Sequence
  Synthetic
gucgucgucauccucguccgug

SEQ ID NO: 25221 - RNA, 23 nt, Artificial Sequence
  Synthetic
ggucgucgucauccucguccgug

SEQ ID NO: 25222 - RNA, 24 nt, Artificial Sequence
  Synthetic
aggucgucgucauccucguccgug

SEQ ID NO: 25223 - RNA, 18 nt, Artificial Sequence
  Synthetic
cggcggcgccucugcgug

SEQ ID NO: 25224 - RNA, 19 nt, Artificial Sequence
  Synthetic
gcggcggcgccucugcgug

SEQ ID NO: 25225 - RNA, 20 nt, Artificial Sequence
  Synthetic
cgcggcggcgccucugcgug

SEQ ID NO: 25226 - RNA, 21 nt, Artificial Sequence
  Synthetic
gcgcggcggcgccucugcgug

SEQ ID NO: 25227 - RNA, 22 nt, Artificial Sequence
  Synthetic
ggcgcggcggcgccucugcgug

SEQ ID NO: 25228 - RNA, 23 nt, Artificial Sequence
  Synthetic
gggcgcggcggcgccucugcgug

SEQ ID NO: 25229 - RNA, 24 nt, Artificial Sequence
  Synthetic
ggggcgcggcggcgccucugcgug

SEQ ID NO: 25230 - RNA, 18 nt, Artificial Sequence
  Synthetic
cuccccggaccacgggug

SEQ ID NO: 25231 - RNA, 19 nt, Artificial Sequence
  Synthetic
gcuccccggaccacgggug

SEQ ID NO: 25232 - RNA, 20 nt, Artificial Sequence
  Synthetic
ugcuccccggaccacgggug

SEQ ID NO: 25233 - RNA, 21 nt, Artificial Sequence
  Synthetic
cugcuccccggaccacgggug

SEQ ID NO: 25234 - RNA, 22 nt, Artificial Sequence
  Synthetic
ccugcuccccggaccacgggug

SEQ ID NO: 25235 - RNA, 23 nt, Artificial Sequence
  Synthetic
cccugcuccccggaccacgggug

SEQ ID NO: 25236 - RNA, 24 nt, Artificial Sequence
  Synthetic
ccccugcuccccggaccacgggug

SEQ ID NO: 25237 - RNA, 18 nt, Artificial Sequence
  Synthetic
uucacgaucgggauggug

SEQ ID NO: 25238 - RNA, 19 nt, Artificial Sequence
  Synthetic
guucacgaucgggauggug

SEQ ID NO: 25239 - RNA, 20 nt, Artificial Sequence
  Synthetic
cguucacgaucgggauggug

SEQ ID NO: 25240 - RNA, 21 nt, Artificial Sequence
  Synthetic
ucguucacgaucgggauggug

SEQ ID NO: 25241 - RNA, 22 nt, Artificial Sequence
  Synthetic
gucguucacgaucgggauggug

SEQ ID NO: 25242 - RNA, 23 nt, Artificial Sequence
  Synthetic
ggucguucacgaucgggauggug

SEQ ID NO: 25243 - RNA, 24 nt, Artificial Sequence
  Synthetic
gggucguucacgaucgggauggug

SEQ ID NO: 25244 - RNA, 18 nt, Artificial Sequence
  Synthetic
cgccgcggggggccugug

SEQ ID NO: 25245 - RNA, 19 nt, Artificial Sequence
  Synthetic
gcgccgcggggggccugug

SEQ ID NO: 25246 - RNA, 20 nt, Artificial Sequence
  Synthetic
ggcgccgcggggggccugug

SEQ ID NO: 25247 - RNA, 21 nt, Artificial Sequence
  Synthetic
gggcgccgcggggggccugug

SEQ ID NO: 25248 - RNA, 22 nt, Artificial Sequence
  Synthetic
ugggcgccgcggggggccugug

SEQ ID NO: 25249 - RNA, 23 nt, Artificial Sequence
  Synthetic
augggcgccgcggggggccugug

SEQ ID NO: 25250 - RNA, 24 nt, Artificial Sequence
  Synthetic
caugggcgccgcggggggccugug

SEQ ID NO: 25251 - RNA, 18 nt, Artificial Sequence
  Synthetic
ggggagucgcugaucacu

SEQ ID NO: 25252 - RNA, 19 nt, Artificial Sequence
  Synthetic
gggggagucgcugaucacu

SEQ ID NO: 25253 - RNA, 20 nt, Artificial Sequence
  Synthetic
ggggggagucgcugaucacu

SEQ ID NO: 25254 - RNA, 21 nt, Artificial Sequence
  Synthetic
gggggggagucgcugaucacu

SEQ ID NO: 25255 - RNA, 22 nt, Artificial Sequence
  Synthetic
cgggggggagucgcugaucacu

SEQ ID NO: 25256 - RNA, 23 nt, Artificial Sequence
  Synthetic
ccgggggggagucgcugaucacu

SEQ ID NO: 25257 - RNA, 24 nt, Artificial Sequence
  Synthetic
gccgggggggagucgcugaucacu

SEQ ID NO: 25258 - RNA, 18 nt, Artificial Sequence
  Synthetic
gggggggacgcguggacu

SEQ ID NO: 25259 - RNA, 19 nt, Artificial Sequence
  Synthetic
agggggggacgcguggacu

SEQ ID NO: 25260 - RNA, 20 nt, Artificial Sequence
  Synthetic
gagggggggacgcguggacu

SEQ ID NO: 25261 - RNA, 21 nt, Artificial Sequence
  Synthetic
cgagggggggacgcguggacu

SEQ ID NO: 25262 - RNA, 22 nt, Artificial Sequence
  Synthetic
gcgagggggggacgcguggacu

SEQ ID NO: 25263 - RNA, 23 nt, Artificial Sequence
  Synthetic
cgcgagggggggacgcguggacu

SEQ ID NO: 25264 - RNA, 24 nt, Artificial Sequence
  Synthetic
gcgcgagggggggacgcguggacu

SEQ ID NO: 25265 - RNA, 18 nt, Artificial Sequence
  Synthetic
cgggggccgucggguacu

SEQ ID NO: 25266 - RNA, 19 nt, Artificial Sequence
  Synthetic
gcgggggccgucggguacu

SEQ ID NO: 25267 - RNA, 20 nt, Artificial Sequence
  Synthetic
cgcgggggccgucggguacu

SEQ ID NO: 25268 - RNA, 21 nt, Artificial Sequence
  Synthetic
acgcgggggccgucggguacu

SEQ ID NO: 25269 - RNA, 22 nt, Artificial Sequence
  Synthetic
gacgcgggggccgucggguacu

SEQ ID NO: 25270 - RNA, 23 nt, Artificial Sequence
  Synthetic
cgacgcgggggccgucggguacu

SEQ ID NO: 25271 - RNA, 24 nt, Artificial Sequence
  Synthetic
ccgacgcgggggccgucggguacu

SEQ ID NO: 25272 - RNA, 18 nt, Artificial Sequence
  Synthetic
gggcgccgcggggggccu

SEQ ID NO: 25273 - RNA, 19 nt, Artificial Sequence
  Synthetic
ugggcgccgcggggggccu

SEQ ID NO: 25274 - RNA, 20 nt, Artificial Sequence
  Synthetic
augggcgccgcggggggccu

SEQ ID NO: 25275 - RNA, 21 nt, Artificial Sequence
  Synthetic
caugggcgccgcggggggccu

SEQ ID NO: 25276 - RNA, 22 nt, Artificial Sequence
  Synthetic
gcaugggcgccgcggggggccu

SEQ ID NO: 25277 - RNA, 23 nt, Artificial Sequence
  Synthetic
ggcaugggcgccgcggggggccu

SEQ ID NO: 25278 - RNA, 24 nt, Artificial Sequence
  Synthetic
uggcaugggcgccgcggggggccu

SEQ ID NO: 25279 - RNA, 18 nt, Artificial Sequence
  Synthetic
gugccgagaccgcaggcu

SEQ ID NO: 25280 - RNA, 19 nt, Artificial Sequence
  Synthetic
ggugccgagaccgcaggcu

SEQ ID NO: 25281 - RNA, 20 nt, Artificial Sequence
  Synthetic
gggugccgagaccgcaggcu

SEQ ID NO: 25282 - RNA, 21 nt, Artificial Sequence
  Synthetic
cgggugccgagaccgcaggcu

SEQ ID NO: 25283 - RNA, 22 nt, Artificial Sequence
  Synthetic
acgggugccgagaccgcaggcu

SEQ ID NO: 25284 - RNA, 23 nt, Artificial Sequence
  Synthetic
cacgggugccgagaccgcaggcu

SEQ ID NO: 25285 - RNA, 24 nt, Artificial Sequence
  Synthetic
ccacgggugccgagaccgcaggcu

SEQ ID NO: 25286 - RNA, 18 nt, Artificial Sequence
  Synthetic
uccgagccgcggccggcu

SEQ ID NO: 25287 - RNA, 19 nt, Artificial Sequence
  Synthetic
guccgagccgcggccggcu

SEQ ID NO: 25288 - RNA, 20 nt, Artificial Sequence
  Synthetic
uguccgagccgcggccggcu

SEQ ID NO: 25289 - RNA, 21 nt, Artificial Sequence
  Synthetic
cuguccgagccgcggccggcu

SEQ ID NO: 25290 - RNA, 22 nt, Artificial Sequence
  Synthetic
gcuguccgagccgcggccggcu

SEQ ID NO: 25291 - RNA, 23 nt, Artificial Sequence
  Synthetic
cgcuguccgagccgcggccggcu

SEQ ID NO: 25292 - RNA, 24 nt, Artificial Sequence
  Synthetic
gcgcuguccgagccgcggccggcu

SEQ ID NO: 25293 - RNA, 18 nt, Artificial Sequence
  Synthetic
cgugguuacccgcggucu

SEQ ID NO: 25294 - RNA, 19 nt, Artificial Sequence
  Synthetic
acgugguuacccgcggucu

SEQ ID NO: 25295 - RNA, 20 nt, Artificial Sequence
  Synthetic
cacgugguuacccgcggucu

SEQ ID NO: 25296 - RNA, 21 nt, Artificial Sequence
  Synthetic
ucacgugguuacccgcggucu

SEQ ID NO: 25297 - RNA, 22 nt, Artificial Sequence
  Synthetic
aucacgugguuacccgcggucu

SEQ ID NO: 25298 - RNA, 23 nt, Artificial Sequence
  Synthetic
caucacgugguuacccgcggucu

SEQ ID NO: 25299 - RNA, 24 nt, Artificial Sequence
  Synthetic
gcaucacgugguuacccgcggucu

SEQ ID NO: 25300 - RNA, 18 nt, Artificial Sequence
  Synthetic
gcccccccggcccugagu

SEQ ID NO: 25301 - RNA, 19 nt, Artificial Sequence
  Synthetic
cgcccccccggcccugagu

SEQ ID NO: 25302 - RNA, 20 nt, Artificial Sequence
  Synthetic
gcgcccccccggcccugagu

SEQ ID NO: 25303 - RNA, 21 nt, Artificial Sequence
  Synthetic
cgcgcccccccggcccugagu

SEQ ID NO: 25304 - RNA, 22 nt, Artificial Sequence
  Synthetic
ccgcgcccccccggcccugagu

SEQ ID NO: 25305 - RNA, 23 nt, Artificial Sequence
  Synthetic
gccgcgcccccccggcccugagu

SEQ ID NO: 25306 - RNA, 24 nt, Artificial Sequence
  Synthetic
ggccgcgcccccccggcccugagu

SEQ ID NO: 25307 - RNA, 18 nt, Artificial Sequence
  Synthetic
ggaggccgccgaggacgu

SEQ ID NO: 25308 - RNA, 19 nt, Artificial Sequence
  Synthetic
cggaggccgccgaggacgu

SEQ ID NO: 25309 - RNA, 20 nt, Artificial Sequence
  Synthetic
gcggaggccgccgaggacgu

SEQ ID NO: 25310 - RNA, 21 nt, Artificial Sequence
  Synthetic
ggcggaggccgccgaggacgu

SEQ ID NO: 25311 - RNA, 22 nt, Artificial Sequence
  Synthetic
aggcggaggccgccgaggacgu

SEQ ID NO: 25312 - RNA, 23 nt, Artificial Sequence
  Synthetic
gaggcggaggccgccgaggacgu

SEQ ID NO: 25313 - RNA, 24 nt, Artificial Sequence
  Synthetic
agaggcggaggccgccgaggacgu

SEQ ID NO: 25314 - RNA, 18 nt, Artificial Sequence
  Synthetic
gcggcggcgccucugcgu

SEQ ID NO: 25315 - RNA, 19 nt, Artificial Sequence
  Synthetic
cgcggcggcgccucugcgu

SEQ ID NO: 25316 - RNA, 20 nt, Artificial Sequence
  Synthetic
gcgcggcggcgccucugcgu

SEQ ID NO: 25317 - RNA, 21 nt, Artificial Sequence
  Synthetic
ggcgcggcggcgccucugcgu

SEQ ID NO: 25318 - RNA, 22 nt, Artificial Sequence
  Synthetic
gggcgcggcggcgccucugcgu

SEQ ID NO: 25319 - RNA, 23 nt, Artificial Sequence
  Synthetic
ggggcgcggcggcgccucugcgu

SEQ ID NO: 25320 - RNA, 24 nt, Artificial Sequence
  Synthetic
gggggcgcggcggcgccucugcgu

SEQ ID NO: 25321 - RNA, 18 nt, Artificial Sequence
  Synthetic
cucggccuccaugcgggu

SEQ ID NO: 25322 - RNA, 19 nt, Artificial Sequence
  Synthetic
ccucggccuccaugcgggu

SEQ ID NO: 25323 - RNA, 20 nt, Artificial Sequence
  Synthetic
uccucggccuccaugcgggu

SEQ ID NO: 25324 - RNA, 21 nt, Artificial Sequence
  Synthetic
cuccucggccuccaugcgggu

SEQ ID NO: 25325 - RNA, 22 nt, Artificial Sequence
  Synthetic
ccuccucggccuccaugcgggu

SEQ ID NO: 25326 - RNA, 23 nt, Artificial Sequence
  Synthetic
gccuccucggccuccaugcgggu

SEQ ID NO: 25327 - RNA, 24 nt, Artificial Sequence
  Synthetic
ggccuccucggccuccaugcgggu

SEQ ID NO: 25328 - RNA, 18 nt, Artificial Sequence
  Synthetic
ggcggcccccgcgggggu

SEQ ID NO: 25329 - RNA, 19 nt, Artificial Sequence
  Synthetic
aggcggcccccgcgggggu

SEQ ID NO: 25330 - RNA, 20 nt, Artificial Sequence
  Synthetic
gaggcggcccccgcgggggu

SEQ ID NO: 25331 - RNA, 21 nt, Artificial Sequence
  Synthetic
agaggcggcccccgcgggggu

SEQ ID NO: 25332 - RNA, 22 nt, Artificial Sequence
  Synthetic
aagaggcggcccccgcgggggu

SEQ ID NO: 25333 - RNA, 23 nt, Artificial Sequence
  Synthetic
gaagaggcggcccccgcgggggu

SEQ ID NO: 25334 - RNA, 24 nt, Artificial Sequence
  Synthetic
ggaagaggcggcccccgcgggggu

SEQ ID NO: 25335 - RNA, 18 nt, Artificial Sequence
  Synthetic
gcgccgcggggggccugu

SEQ ID NO: 25336 - RNA, 19 nt, Artificial Sequence
  Synthetic
ggcgccgcggggggccugu

SEQ ID NO: 25337 - RNA, 20 nt, Artificial Sequence
  Synthetic
gggcgccgcggggggccugu

SEQ ID NO: 25338 - RNA, 21 nt, Artificial Sequence
  Synthetic
ugggcgccgcggggggccugu

SEQ ID NO: 25339 - RNA, 22 nt, Artificial Sequence
  Synthetic
augggcgccgcggggggccugu

SEQ ID NO: 25340 - RNA, 23 nt, Artificial Sequence
  Synthetic
caugggcgccgcggggggccugu

SEQ ID NO: 25341 - RNA, 24 nt, Artificial Sequence
  Synthetic
gcaugggcgccgcggggggccugu

SEQ ID NO: 25342 - RNA, 18 nt, Artificial Sequence
  Synthetic
cgccgaggggggcgcugu

SEQ ID NO: 25343 - RNA, 19 nt, Artificial Sequence
  Synthetic
gcgccgaggggggcgcugu

SEQ ID NO: 25344 - RNA, 20 nt, Artificial Sequence
  Synthetic
ggcgccgaggggggcgcugu

SEQ ID NO: 25345 - RNA, 21 nt, Artificial Sequence
  Synthetic
gggcgccgaggggggcgcugu

SEQ ID NO: 25346 - RNA, 22 nt, Artificial Sequence
  Synthetic
ugggcgccgaggggggcgcugu

SEQ ID NO: 25347 - RNA, 23 nt, Artificial Sequence
  Synthetic
augggcgccgaggggggcgcugu

SEQ ID NO: 25348 - RNA, 24 nt, Artificial Sequence
  Synthetic
gaugggcgccgaggggggcgcugu

SEQ ID NO: 25349 - RNA, 18 nt, Artificial Sequence
  Synthetic
cuccgcguggcgcgucuu

SEQ ID NO: 25350 - RNA, 19 nt, Artificial Sequence
  Synthetic
ucuccgcguggcgcgucuu

SEQ ID NO: 25351 - RNA, 20 nt, Artificial Sequence
  Synthetic
gucuccgcguggcgcgucuu

SEQ ID NO: 25352 - RNA, 21 nt, Artificial Sequence
  Synthetic
agucuccgcguggcgcgucuu

SEQ ID NO: 25353 - RNA, 22 nt, Artificial Sequence
  Synthetic
aagucuccgcguggcgcgucuu

SEQ ID NO: 25354 - RNA, 23 nt, Artificial Sequence
  Synthetic
gaagucuccgcguggcgcgucuu

SEQ ID NO: 25355 - RNA, 24 nt, Artificial Sequence
  Synthetic
ggaagucuccgcguggcgcgucuu

SEQ ID NO: 25356 - RNA, 18 nt, Artificial Sequence
  Synthetic
cgccccccuugcaaacaa

SEQ ID NO: 25357 - RNA, 19 nt, Artificial Sequence
  Synthetic
ccgccccccuugcaaacaa

SEQ ID NO: 25358 - RNA, 20 nt, Artificial Sequence
  Synthetic
cccgccccccuugcaaacaa

SEQ ID NO: 25359 - RNA, 21 nt, Artificial Sequence
  Synthetic
acccgccccccuugcaaacaa

SEQ ID NO: 25360 - RNA, 22 nt, Artificial Sequence
  Synthetic
gacccgccccccuugcaaacaa

SEQ ID NO: 25361 - RNA, 23 nt, Artificial Sequence
  Synthetic
agacccgccccccuugcaaacaa

SEQ ID NO: 25362 - RNA, 24 nt, Artificial Sequence
  Synthetic
cagacccgccccccuugcaaacaa

SEQ ID NO: 25363 - RNA, 18 nt, Artificial Sequence
  Synthetic
gcccugggagggagacaa

SEQ ID NO: 25364 - RNA, 19 nt, Artificial Sequence
  Synthetic
ugcccugggagggagacaa

SEQ ID NO: 25365 - RNA, 20 nt, Artificial Sequence
  Synthetic
gugcccugggagggagacaa

SEQ ID NO: 25366 - RNA, 21 nt, Artificial Sequence
  Synthetic
ggugcccugggagggagacaa

SEQ ID NO: 25367 - RNA, 22 nt, Artificial Sequence
  Synthetic
cggugcccugggagggagacaa

SEQ ID NO: 25368 - RNA, 23 nt, Artificial Sequence
  Synthetic
ucggugcccugggagggagacaa

SEQ ID NO: 25369 - RNA, 24 nt, Artificial Sequence
  Synthetic
gucggugcccugggagggagacaa

SEQ ID NO: 25370 - RNA, 18 nt, Artificial Sequence
  Synthetic
cgcgccggcaggggccaa

SEQ ID NO: 25371 - RNA, 19 nt, Artificial Sequence
  Synthetic
ucgcgccggcaggggccaa

SEQ ID NO: 25372 - RNA, 20 nt, Artificial Sequence
  Synthetic
cucgcgccggcaggggccaa

SEQ ID NO: 25373 - RNA, 21 nt, Artificial Sequence
  Synthetic
ccucgcgccggcaggggccaa

SEQ ID NO: 25374 - RNA, 22 nt, Artificial Sequence
  Synthetic
cccucgcgccggcaggggccaa

SEQ ID NO: 25375 - RNA, 23 nt, Artificial Sequence
  Synthetic
ccccucgcgccggcaggggccaa

SEQ ID NO: 25376 - RNA, 24 nt, Artificial Sequence
  Synthetic
cccccucgcgccggcaggggccaa

SEQ ID NO: 25377 - RNA, 18 nt, Artificial Sequence
  Synthetic
gggguugggguuguugaa

SEQ ID NO: 25378 - RNA, 19 nt, Artificial Sequence
  Synthetic
ugggguugggguuguugaa

SEQ ID NO: 25379 - RNA, 20 nt, Artificial Sequence
  Synthetic
uugggguugggguuguugaa

SEQ ID NO: 25380 - RNA, 21 nt, Artificial Sequence
  Synthetic
guugggguugggguuguugaa

SEQ ID NO: 25381 - RNA, 22 nt, Artificial Sequence
  Synthetic
gguugggguugggguuguugaa

SEQ ID NO: 25382 - RNA, 23 nt, Artificial Sequence
  Synthetic
ggguugggguugggguuguugaa

SEQ ID NO: 25383 - RNA, 24 nt, Artificial Sequence
  Synthetic
gggguugggguugggguuguugaa

SEQ ID NO: 25384 - RNA, 18 nt, Artificial Sequence
  Synthetic
acauggagacggggaaca

SEQ ID NO: 25385 - RNA, 19 nt, Artificial Sequence
  Synthetic
gacauggagacggggaaca

SEQ ID NO: 25386 - RNA, 20 nt, Artificial Sequence
  Synthetic
ggacauggagacggggaaca

SEQ ID NO: 25387 - RNA, 21 nt, Artificial Sequence
  Synthetic
uggacauggagacggggaaca

SEQ ID NO: 25388 - RNA, 22 nt, Artificial Sequence
  Synthetic
cuggacauggagacggggaaca

SEQ ID NO: 25389 - RNA, 23 nt, Artificial Sequence
  Synthetic
ccuggacauggagacggggaaca

SEQ ID NO: 25390 - RNA, 24 nt, Artificial Sequence
  Synthetic
uccuggacauggagacggggaaca

SEQ ID NO: 25391 - RNA, 18 nt, Artificial Sequence
  Synthetic
gccugcccauccuggaca

SEQ ID NO: 25392 - RNA, 19 nt, Artificial Sequence
  Synthetic
ugccugcccauccuggaca

SEQ ID NO: 25393 - RNA, 20 nt, Artificial Sequence
  Synthetic
cugccugcccauccuggaca

SEQ ID NO: 25394 - RNA, 21 nt, Artificial Sequence
  Synthetic
acugccugcccauccuggaca

SEQ ID NO: 25395 - RNA, 22 nt, Artificial Sequence
  Synthetic
gacugccugcccauccuggaca

SEQ ID NO: 25396 - RNA, 23 nt, Artificial Sequence
  Synthetic
ggacugccugcccauccuggaca

SEQ ID NO: 25397 - RNA, 24 nt, Artificial Sequence
  Synthetic
gggacugccugcccauccuggaca

SEQ ID NO: 25398 - RNA, 18 nt, Artificial Sequence
  Synthetic
cgccccccucggcgccca

SEQ ID NO: 25399 - RNA, 19 nt, Artificial Sequence
  Synthetic
gcgccccccucggcgccca

SEQ ID NO: 25400 - RNA, 20 nt, Artificial Sequence
  Synthetic
agcgccccccucggcgccca

SEQ ID NO: 25401 - RNA, 21 nt, Artificial Sequence
  Synthetic
cagcgccccccucggcgccca

SEQ ID NO: 25402 - RNA, 22 nt, Artificial Sequence
  Synthetic
acagcgccccccucggcgccca

SEQ ID NO: 25403 - RNA, 23 nt, Artificial Sequence
  Synthetic
gacagcgccccccucggcgccca

SEQ ID NO: 25404 - RNA, 24 nt, Artificial Sequence
  Synthetic
ggacagcgccccccucggcgccca

SEQ ID NO: 25405 - RNA, 18 nt, Artificial Sequence
  Synthetic
cccgugguccggggagca

SEQ ID NO: 25406 - RNA, 19 nt, Artificial Sequence
  Synthetic
acccgugguccggggagca

SEQ ID NO: 25407 - RNA, 20 nt, Artificial Sequence
  Synthetic
cacccgugguccggggagca

SEQ ID NO: 25408 - RNA, 21 nt, Artificial Sequence
  Synthetic
gcacccgugguccggggagca

SEQ ID NO: 25409 - RNA, 22 nt, Artificial Sequence
  Synthetic
ggcacccgugguccggggagca

SEQ ID NO: 25410 - RNA, 23 nt, Artificial Sequence
  Synthetic
cggcacccgugguccggggagca

SEQ ID NO: 25411 - RNA, 24 nt, Artificial Sequence
  Synthetic
ucggcacccgugguccggggagca

SEQ ID NO: 25412 - RNA, 18 nt, Artificial Sequence
  Synthetic
acgacccccagacccgca

SEQ ID NO: 25413 - RNA, 19 nt, Artificial Sequence
  Synthetic
aacgacccccagacccgca

SEQ ID NO: 25414 - RNA, 20 nt, Artificial Sequence
  Synthetic
gaacgacccccagacccgca

SEQ ID NO: 25415 - RNA, 21 nt, Artificial Sequence
  Synthetic
ugaacgacccccagacccgca

SEQ ID NO: 25416 - RNA, 22 nt, Artificial Sequence
  Synthetic
gugaacgacccccagacccgca

SEQ ID NO: 25417 - RNA, 23 nt, Artificial Sequence
  Synthetic
cgugaacgacccccagacccgca

SEQ ID NO: 25418 - RNA, 24 nt, Artificial Sequence
  Synthetic
ucgugaacgacccccagacccgca

SEQ ID NO: 25419 - RNA, 18 nt, Artificial Sequence
  Synthetic
acgugaacaagacuauca

SEQ ID NO: 25420 - RNA, 19 nt, Artificial Sequence
  Synthetic
uacgugaacaagacuauca

SEQ ID NO: 25421 - RNA, 20 nt, Artificial Sequence
  Synthetic
uuacgugaacaagacuauca

SEQ ID NO: 25422 - RNA, 21 nt, Artificial Sequence
  Synthetic
cuuacgugaacaagacuauca

SEQ ID NO: 25423 - RNA, 22 nt, Artificial Sequence
  Synthetic
ccuuacgugaacaagacuauca

SEQ ID NO: 25424 - RNA, 23 nt, Artificial Sequence
  Synthetic
gccuuacgugaacaagacuauca

SEQ ID NO: 25425 - RNA, 24 nt, Artificial Sequence
  Synthetic
cgccuuacgugaacaagacuauca

SEQ ID NO: 25426 - RNA, 18 nt, Artificial Sequence
  Synthetic
ugguccugguggaccaga

SEQ ID NO: 25427 - RNA, 19 nt, Artificial Sequence
  Synthetic
gugguccugguggaccaga

SEQ ID NO: 25428 - RNA, 20 nt, Artificial Sequence
  Synthetic
cgugguccugguggaccaga

SEQ ID NO: 25429 - RNA, 21 nt, Artificial Sequence
  Synthetic
acgugguccugguggaccaga

SEQ ID NO: 25430 - RNA, 22 nt, Artificial Sequence
  Synthetic
uacgugguccugguggaccaga

SEQ ID NO: 25431 - RNA, 23 nt, Artificial Sequence
  Synthetic
guacgugguccugguggaccaga

SEQ ID NO: 25432 - RNA, 24 nt, Artificial Sequence
  Synthetic
cguacgugguccugguggaccaga

SEQ ID NO: 25433 - RNA, 18 nt, Artificial Sequence
  Synthetic
ccauccuggacauggaga

SEQ ID NO: 25434 - RNA, 19 nt, Artificial Sequence
  Synthetic
cccauccuggacauggaga

SEQ ID NO: 25435 - RNA, 20 nt, Artificial Sequence
  Synthetic
gcccauccuggacauggaga

SEQ ID NO: 25436 - RNA, 21 nt, Artificial Sequence
  Synthetic
ugcccauccuggacauggaga

SEQ ID NO: 25437 - RNA, 22 nt, Artificial Sequence
  Synthetic
cugcccauccuggacauggaga

SEQ ID NO: 25438 - RNA, 23 nt, Artificial Sequence
  Synthetic
ccugcccauccuggacauggaga

SEQ ID NO: 25439 - RNA, 24 nt, Artificial Sequence
  Synthetic
gccugcccauccuggacauggaga

SEQ ID NO: 25440 - RNA, 18 nt, Artificial Sequence
  Synthetic
ggcgucgacccgggacga

SEQ ID NO: 25441 - RNA, 19 nt, Artificial Sequence
  Synthetic
gggcgucgacccgggacga

SEQ ID NO: 25442 - RNA, 20 nt, Artificial Sequence
  Synthetic
ggggcgucgacccgggacga

SEQ ID NO: 25443 - RNA, 21 nt, Artificial Sequence
  Synthetic
gggggcgucgacccgggacga

SEQ ID NO: 25444 - RNA, 22 nt, Artificial Sequence
  Synthetic
agggggcgucgacccgggacga

SEQ ID NO: 25445 - RNA, 23 nt, Artificial Sequence
  Synthetic
cagggggcgucgacccgggacga

SEQ ID NO: 25446 - RNA, 24 nt, Artificial Sequence
  Synthetic
gcagggggcgucgacccgggacga

SEQ ID NO: 25447 - RNA, 18 nt, Artificial Sequence
  Synthetic
gacggcccccgcgucgga

SEQ ID NO: 25448 - RNA, 19 nt, Artificial Sequence
  Synthetic
cgacggcccccgcgucgga

SEQ ID NO: 25449 - RNA, 20 nt, Artificial Sequence
  Synthetic
ccgacggcccccgcgucgga

SEQ ID NO: 25450 - RNA, 21 nt, Artificial Sequence
  Synthetic
cccgacggcccccgcgucgga

SEQ ID NO: 25451 - RNA, 22 nt, Artificial Sequence
  Synthetic
acccgacggcccccgcgucgga

SEQ ID NO: 25452 - RNA, 23 nt, Artificial Sequence
  Synthetic
uacccgacggcccccgcgucgga

SEQ ID NO: 25453 - RNA, 24 nt, Artificial Sequence
  Synthetic
guacccgacggcccccgcgucgga

SEQ ID NO: 25454 - RNA, 18 nt, Artificial Sequence
  Synthetic
gccgucggugcccuggga

SEQ ID NO: 25455 - RNA, 19 nt, Artificial Sequence
  Synthetic
ggccgucggugcccuggga

SEQ ID NO: 25456 - RNA, 20 nt, Artificial Sequence
  Synthetic
gggccgucggugcccuggga

SEQ ID NO: 25457 - RNA, 21 nt, Artificial Sequence
  Synthetic
ggggccgucggugcccuggga

SEQ ID NO: 25458 - RNA, 22 nt, Artificial Sequence
  Synthetic
cggggccgucggugcccuggga

SEQ ID NO: 25459 - RNA, 23 nt, Artificial Sequence
  Synthetic
gcggggccgucggugcccuggga

SEQ ID NO: 25460 - RNA, 24 nt, Artificial Sequence
  Synthetic
ggcggggccgucggugcccuggga

SEQ ID NO: 25461 - RNA, 18 nt, Artificial Sequence
  Synthetic
uucgaccagggcacccua

SEQ ID NO: 25462 - RNA, 19 nt, Artificial Sequence
  Synthetic
guucgaccagggcacccua

SEQ ID NO: 25463 - RNA, 20 nt, Artificial Sequence
  Synthetic
uguucgaccagggcacccua

SEQ ID NO: 25464 - RNA, 21 nt, Artificial Sequence
  Synthetic
cuguucgaccagggcacccua

SEQ ID NO: 25465 - RNA, 22 nt, Artificial Sequence
  Synthetic
gcuguucgaccagggcacccua

SEQ ID NO: 25466 - RNA, 23 nt, Artificial Sequence
  Synthetic
ugcuguucgaccagggcacccua

SEQ ID NO: 25467 - RNA, 24 nt, Artificial Sequence
  Synthetic
augcuguucgaccagggcacccua

SEQ ID NO: 25468 - RNA, 18 nt, Artificial Sequence
  Synthetic
gcccugucgcccacccac

SEQ ID NO: 25469 - RNA, 19 nt, Artificial Sequence
  Synthetic
ggcccugucgcccacccac

SEQ ID NO: 25470 - RNA, 20 nt, Artificial Sequence
  Synthetic
gggcccugucgcccacccac

SEQ ID NO: 25471 - RNA, 21 nt, Artificial Sequence
  Synthetic
agggcccugucgcccacccac

SEQ ID NO: 25472 - RNA, 22 nt, Artificial Sequence
  Synthetic
gagggcccugucgcccacccac

SEQ ID NO: 25473 - RNA, 23 nt, Artificial Sequence
  Synthetic
ugagggcccugucgcccacccac

SEQ ID NO: 25474 - RNA, 24 nt, Artificial Sequence
  Synthetic
gugagggcccugucgcccacccac

SEQ ID NO: 25475 - RNA, 18 nt, Artificial Sequence
  Synthetic
gcccggaagacgcgccac

SEQ ID NO: 25476 - RNA, 19 nt, Artificial Sequence
  Synthetic
ugcccggaagacgcgccac

SEQ ID NO: 25477 - RNA, 20 nt, Artificial Sequence
  Synthetic
gugcccggaagacgcgccac

SEQ ID NO: 25478 - RNA, 21 nt, Artificial Sequence
  Synthetic
ugugcccggaagacgcgccac

SEQ ID NO: 25479 - RNA, 22 nt, Artificial Sequence
  Synthetic
gugugcccggaagacgcgccac

SEQ ID NO: 25480 - RNA, 23 nt, Artificial Sequence
  Synthetic
agugugcccggaagacgcgccac

SEQ ID NO: 25481 - RNA, 24 nt, Artificial Sequence
  Synthetic
aagugugcccggaagacgcgccac

SEQ ID NO: 25482 - RNA, 18 nt, Artificial Sequence
  Synthetic
cgugaacaagacuaucac

SEQ ID NO: 25483 - RNA, 19 nt, Artificial Sequence
  Synthetic
acgugaacaagacuaucac

SEQ ID NO: 25484 - RNA, 20 nt, Artificial Sequence
  Synthetic
uacgugaacaagacuaucac

SEQ ID NO: 25485 - RNA, 21 nt, Artificial Sequence
  Synthetic
uuacgugaacaagacuaucac

SEQ ID NO: 25486 - RNA, 22 nt, Artificial Sequence
  Synthetic
cuuacgugaacaagacuaucac

SEQ ID NO: 25487 - RNA, 23 nt, Artificial Sequence
  Synthetic
ccuuacgugaacaagacuaucac

SEQ ID NO: 25488 - RNA, 24 nt, Artificial Sequence
  Synthetic
gccuuacgugaacaagacuaucac

SEQ ID NO: 25489 - RNA, 18 nt, Artificial Sequence
  Synthetic
gguccugguggaccagac

SEQ ID NO: 25490 - RNA, 19 nt, Artificial Sequence
  Synthetic
ugguccugguggaccagac

SEQ ID NO: 25491 - RNA, 20 nt, Artificial Sequence
  Synthetic
gugguccugguggaccagac

SEQ ID NO: 25492 - RNA, 21 nt, Artificial Sequence
  Synthetic
cgugguccugguggaccagac

SEQ ID NO: 25493 - RNA, 22 nt, Artificial Sequence
  Synthetic
acgugguccugguggaccagac

SEQ ID NO: 25494 - RNA, 23 nt, Artificial Sequence
  Synthetic
uacgugguccugguggaccagac

SEQ ID NO: 25495 - RNA, 24 nt, Artificial Sequence
  Synthetic
guacgugguccugguggaccagac

SEQ ID NO: 25496 - RNA, 18 nt, Artificial Sequence
  Synthetic
gugcccugggagggagac

SEQ ID NO: 25497 - RNA, 19 nt, Artificial Sequence
  Synthetic
ggugcccugggagggagac

SEQ ID NO: 25498 - RNA, 20 nt, Artificial Sequence
  Synthetic
cggugcccugggagggagac

SEQ ID NO: 25499 - RNA, 21 nt, Artificial Sequence
  Synthetic
ucggugcccugggagggagac

SEQ ID NO: 25500 - RNA, 22 nt, Artificial Sequence
  Synthetic
gucggugcccugggagggagac

SEQ ID NO: 25501 - RNA, 23 nt, Artificial Sequence
  Synthetic
cgucggugcccugggagggagac

SEQ ID NO: 25502 - RNA, 24 nt, Artificial Sequence
  Synthetic
ccgucggugcccugggagggagac

SEQ ID NO: 25503 - RNA, 18 nt, Artificial Sequence
  Synthetic
cauccuggacauggagac

SEQ ID NO: 25504 - RNA, 19 nt, Artificial Sequence
  Synthetic
ccauccuggacauggagac

SEQ ID NO: 25505 - RNA, 20 nt, Artificial Sequence
  Synthetic
cccauccuggacauggagac

SEQ ID NO: 25506 - RNA, 21 nt, Artificial Sequence
  Synthetic
gcccauccuggacauggagac

SEQ ID NO: 25507 - RNA, 22 nt, Artificial Sequence
  Synthetic
ugcccauccuggacauggagac

SEQ ID NO: 25508 - RNA, 23 nt, Artificial Sequence
  Synthetic
cugcccauccuggacauggagac

SEQ ID NO: 25509 - RNA, 24 nt, Artificial Sequence
  Synthetic
ccugcccauccuggacauggagac

SEQ ID NO: 25510 - RNA, 18 nt, Artificial Sequence
  Synthetic
gacgaggaugacgacgac

SEQ ID NO: 25511 - RNA, 19 nt, Artificial Sequence
  Synthetic
ggacgaggaugacgacgac

SEQ ID NO: 25512 - RNA, 20 nt, Artificial Sequence
  Synthetic
cggacgaggaugacgacgac

SEQ ID NO: 25513 - RNA, 21 nt, Artificial Sequence
  Synthetic
acggacgaggaugacgacgac

SEQ ID NO: 25514 - RNA, 22 nt, Artificial Sequence
  Synthetic
cacggacgaggaugacgacgac

SEQ ID NO: 25515 - RNA, 23 nt, Artificial Sequence
  Synthetic
ccacggacgaggaugacgacgac

SEQ ID NO: 25516 - RNA, 24 nt, Artificial Sequence
  Synthetic
accacggacgaggaugacgacgac

SEQ ID NO: 25517 - RNA, 18 nt, Artificial Sequence
  Synthetic
ggagcagggggcgucgac

SEQ ID NO: 25518 - RNA, 19 nt, Artificial Sequence
  Synthetic
gggagcagggggcgucgac

SEQ ID NO: 25519 - RNA, 20 nt, Artificial Sequence
  Synthetic
ggggagcagggggcgucgac

SEQ ID NO: 25520 - RNA, 21 nt, Artificial Sequence
  Synthetic
cggggagcagggggcgucgac

SEQ ID NO: 25521 - RNA, 22 nt, Artificial Sequence
  Synthetic
ccggggagcagggggcgucgac

SEQ ID NO: 25522 - RNA, 23 nt, Artificial Sequence
  Synthetic
uccggggagcagggggcgucgac

SEQ ID NO: 25523 - RNA, 24 nt, Artificial Sequence
  Synthetic
guccggggagcagggggcgucgac

SEQ ID NO: 25524 - RNA, 18 nt, Artificial Sequence
  Synthetic
gggaacaugcuguucgac

SEQ ID NO: 25525 - RNA, 19 nt, Artificial Sequence
  Synthetic
ggggaacaugcuguucgac

SEQ ID NO: 25526 - RNA, 20 nt, Artificial Sequence
  Synthetic
uggggaacaugcuguucgac

SEQ ID NO: 25527 - RNA, 21 nt, Artificial Sequence
  Synthetic
guggggaacaugcuguucgac

SEQ ID NO: 25528 - RNA, 22 nt, Artificial Sequence
  Synthetic
cguggggaacaugcuguucgac

SEQ ID NO: 25529 - RNA, 23 nt, Artificial Sequence
  Synthetic
ccguggggaacaugcuguucgac

SEQ ID NO: 25530 - RNA, 24 nt, Artificial Sequence
  Synthetic
cccguggggaacaugcuguucgac

SEQ ID NO: 25531 - RNA, 18 nt, Artificial Sequence
  Synthetic
ggggcgucgacccgggac

SEQ ID NO: 25532 - RNA, 19 nt, Artificial Sequence
  Synthetic
gggggcgucgacccgggac

SEQ ID NO: 25533 - RNA, 20 nt, Artificial Sequence
  Synthetic
agggggcgucgacccgggac

SEQ ID NO: 25534 - RNA, 21 nt, Artificial Sequence
  Synthetic
cagggggcgucgacccgggac

SEQ ID NO: 25535 - RNA, 22 nt, Artificial Sequence
  Synthetic
gcagggggcgucgacccgggac

SEQ ID NO: 25536 - RNA, 23 nt, Artificial Sequence
  Synthetic
agcagggggcgucgacccgggac

SEQ ID NO: 25537 - RNA, 24 nt, Artificial Sequence
  Synthetic
gagcagggggcgucgacccgggac

SEQ ID NO: 25538 - RNA, 18 nt, Artificial Sequence
  Synthetic
ugccugcccauccuggac

SEQ ID NO: 25539 - RNA, 19 nt, Artificial Sequence
  Synthetic
cugccugcccauccuggac

SEQ ID NO: 25540 - RNA, 20 nt, Artificial Sequence
  Synthetic
acugccugcccauccuggac

SEQ ID NO: 25541 - RNA, 21 nt, Artificial Sequence
  Synthetic
gacugccugcccauccuggac

SEQ ID NO: 25542 - RNA, 22 nt, Artificial Sequence
  Synthetic
ggacugccugcccauccuggac

SEQ ID NO: 25543 - RNA, 23 nt, Artificial Sequence
  Synthetic
gggacugccugcccauccuggac

SEQ ID NO: 25544 - RNA, 24 nt, Artificial Sequence
  Synthetic
ggggacugccugcccauccuggac

SEQ ID NO: 25545 - RNA, 18 nt, Artificial Sequence
  Synthetic
gucgcccugucgccuuac

SEQ ID NO: 25546 - RNA, 19 nt, Artificial Sequence
  Synthetic
ggucgcccugucgccuuac

SEQ ID NO: 25547 - RNA, 20 nt, Artificial Sequence
  Synthetic
uggucgcccugucgccuuac

SEQ ID NO: 25548 - RNA, 21 nt, Artificial Sequence
  Synthetic
guggucgcccugucgccuuac

SEQ ID NO: 25549 - RNA, 22 nt, Artificial Sequence
  Synthetic
cguggucgcccugucgccuuac

SEQ ID NO: 25550 - RNA, 23 nt, Artificial Sequence
  Synthetic
gcguggucgcccugucgccuuac

SEQ ID NO: 25551 - RNA, 24 nt, Artificial Sequence
  Synthetic
agcguggucgcccugucgccuuac

SEQ ID NO: 25552 - RNA, 18 nt, Artificial Sequence
  Synthetic
uggcucaggccgcgaacc

SEQ ID NO: 25553 - RNA, 19 nt, Artificial Sequence
  Synthetic
cuggcucaggccgcgaacc

SEQ ID NO: 25554 - RNA, 20 nt, Artificial Sequence
  Synthetic
ccuggcucaggccgcgaacc

SEQ ID NO: 25555 - RNA, 21 nt, Artificial Sequence
  Synthetic
cccuggcucaggccgcgaacc

SEQ ID NO: 25556 - RNA, 22 nt, Artificial Sequence
  Synthetic
ucccuggcucaggccgcgaacc

SEQ ID NO: 25557 - RNA, 23 nt, Artificial Sequence
  Synthetic
gucccuggcucaggccgcgaacc

SEQ ID NO: 25558 - RNA, 24 nt, Artificial Sequence
  Synthetic
cgucccuggcucaggccgcgaacc

SEQ ID NO: 25559 - RNA, 18 nt, Artificial Sequence
  Synthetic
cccugucgcccacccacc

SEQ ID NO: 25560 - RNA, 19 nt, Artificial Sequence
  Synthetic
gcccugucgcccacccacc

SEQ ID NO: 25561 - RNA, 20 nt, Artificial Sequence
  Synthetic
ggcccugucgcccacccacc

SEQ ID NO: 25562 - RNA, 21 nt, Artificial Sequence
  Synthetic
gggcccugucgcccacccacc

SEQ ID NO: 25563 - RNA, 22 nt, Artificial Sequence
  Synthetic
agggcccugucgcccacccacc

SEQ ID NO: 25564 - RNA, 23 nt, Artificial Sequence
  Synthetic
gagggcccugucgcccacccacc

SEQ ID NO: 25565 - RNA, 24 nt, Artificial Sequence
  Synthetic
ugagggcccugucgcccacccacc

SEQ ID NO: 25566 - RNA, 18 nt, Artificial Sequence
  Synthetic
acccacccggagcccacc

SEQ ID NO: 25567 - RNA, 19 nt, Artificial Sequence
  Synthetic
cacccacccggagcccacc

SEQ ID NO: 25568 - RNA, 20 nt, Artificial Sequence
  Synthetic
ccacccacccggagcccacc

SEQ ID NO: 25569 - RNA, 21 nt, Artificial Sequence
  Synthetic
cccacccacccggagcccacc

SEQ ID NO: 25570 - RNA, 22 nt, Artificial Sequence
  Synthetic
gcccacccacccggagcccacc

SEQ ID NO: 25571 - RNA, 23 nt, Artificial Sequence
  Synthetic
cgcccacccacccggagcccacc

SEQ ID NO: 25572 - RNA, 24 nt, Artificial Sequence
  Synthetic
ucgcccacccacccggagcccacc

SEQ ID NO: 25573 - RNA, 18 nt, Artificial Sequence
  Synthetic
gagcagggggcgucgacc

SEQ ID NO: 25574 - RNA, 19 nt, Artificial Sequence
  Synthetic
ggagcagggggcgucgacc

SEQ ID NO: 25575 - RNA, 20 nt, Artificial Sequence
  Synthetic
gggagcagggggcgucgacc

SEQ ID NO: 25576 - RNA, 21 nt, Artificial Sequence
  Synthetic
ggggagcagggggcgucgacc

SEQ ID NO: 25577 - RNA, 22 nt, Artificial Sequence
  Synthetic
cggggagcagggggcgucgacc

SEQ ID NO: 25578 - RNA, 23 nt, Artificial Sequence
  Synthetic
ccggggagcagggggcgucgacc

SEQ ID NO: 25579 - RNA, 24 nt, Artificial Sequence
  Synthetic
uccggggagcagggggcgucgacc

SEQ ID NO: 25580 - RNA, 18 nt, Artificial Sequence
  Synthetic
gccccgcgguaccugacc

SEQ ID NO: 25581 - RNA, 19 nt, Artificial Sequence
  Synthetic
cgccccgcgguaccugacc

SEQ ID NO: 25582 - RNA, 20 nt, Artificial Sequence
  Synthetic
ucgccccgcgguaccugacc

SEQ ID NO: 25583 - RNA, 21 nt, Artificial Sequence
  Synthetic
uucgccccgcgguaccugacc

SEQ ID NO: 25584 - RNA, 22 nt, Artificial Sequence
  Synthetic
guucgccccgcgguaccugacc

SEQ ID NO: 25585 - RNA, 23 nt, Artificial Sequence
  Synthetic
gguucgccccgcgguaccugacc

SEQ ID NO: 25586 - RNA, 24 nt, Artificial Sequence
  Synthetic
cgguucgccccgcgguaccugacc

SEQ ID NO: 25587 - RNA, 18 nt, Artificial Sequence
  Synthetic
ccccgcgguaccugaccc

SEQ ID NO: 25588 - RNA, 19 nt, Artificial Sequence
  Synthetic
gccccgcgguaccugaccc

SEQ ID NO: 25589 - RNA, 20 nt, Artificial Sequence
  Synthetic
cgccccgcgguaccugaccc

SEQ ID NO: 25590 - RNA, 21 nt, Artificial Sequence
  Synthetic
ucgccccgcgguaccugaccc

SEQ ID NO: 25591 - RNA, 22 nt, Artificial Sequence
  Synthetic
uucgccccgcgguaccugaccc

SEQ ID NO: 25592 - RNA, 23 nt, Artificial Sequence
  Synthetic
guucgccccgcgguaccugaccc

SEQ ID NO: 25593 - RNA, 24 nt, Artificial Sequence
  Synthetic
gguucgccccgcgguaccugaccc

SEQ ID NO: 25594 - RNA, 18 nt, Artificial Sequence
  Synthetic
uccucggccccgaccccc

SEQ ID NO: 25595 - RNA, 19 nt, Artificial Sequence
  Synthetic
cuccucggccccgaccccc

SEQ ID NO: 25596 - RNA, 20 nt, Artificial Sequence
  Synthetic
ccuccucggccccgaccccc

SEQ ID NO: 25597 - RNA, 21 nt, Artificial Sequence
  Synthetic
uccuccucggccccgaccccc

SEQ ID NO: 25598 - RNA, 22 nt, Artificial Sequence
  Synthetic
uuccuccucggccccgaccccc

SEQ ID NO: 25599 - RNA, 23 nt, Artificial Sequence
  Synthetic
cuuccuccucggccccgaccccc

SEQ ID NO: 25600 - RNA, 24 nt, Artificial Sequence
  Synthetic
ucuuccuccucggccccgaccccc

SEQ ID NO: 25601 - RNA, 18 nt, Artificial Sequence
  Synthetic
agccucuggaugaccccc

SEQ ID NO: 25602 - RNA, 19 nt, Artificial Sequence
  Synthetic
cagccucuggaugaccccc

SEQ ID NO: 25603 - RNA, 20 nt, Artificial Sequence
  Synthetic
acagccucuggaugaccccc

SEQ ID NO: 25604 - RNA, 21 nt, Artificial Sequence
  Synthetic
aacagccucuggaugaccccc

SEQ ID NO: 25605 - RNA, 22 nt, Artificial Sequence
  Synthetic
gaacagccucuggaugaccccc

SEQ ID NO: 25606 - RNA, 23 nt, Artificial Sequence
  Synthetic
ggaacagccucuggaugaccccc

SEQ ID NO: 25607 - RNA, 24 nt, Artificial Sequence
  Synthetic
uggaacagccucuggaugaccccc

SEQ ID NO: 25608 - RNA, 18 nt, Artificial Sequence
  Synthetic
gagccggccgcccgcccc

SEQ ID NO: 25609 - RNA, 19 nt, Artificial Sequence
  Synthetic
ggagccggccgcccgcccc

SEQ ID NO: 25610 - RNA, 20 nt, Artificial Sequence
  Synthetic
cggagccggccgcccgcccc

SEQ ID NO: 25611 - RNA, 21 nt, Artificial Sequence
  Synthetic
gcggagccggccgcccgcccc

SEQ ID NO: 25612 - RNA, 22 nt, Artificial Sequence
  Synthetic
ggcggagccggccgcccgcccc

SEQ ID NO: 25613 - RNA, 23 nt, Artificial Sequence
  Synthetic
gggcggagccggccgcccgcccc

SEQ ID NO: 25614 - RNA, 24 nt, Artificial Sequence
  Synthetic
ggggcggagccggccgcccgcccc

SEQ ID NO: 25615 - RNA, 18 nt, Artificial Sequence
  Synthetic
cccccgcgccccggcccc

SEQ ID NO: 25616 - RNA, 19 nt, Artificial Sequence
  Synthetic
gcccccgcgccccggcccc

SEQ ID NO: 25617 - RNA, 20 nt, Artificial Sequence
  Synthetic
ggcccccgcgccccggcccc

SEQ ID NO: 25618 - RNA, 21 nt, Artificial Sequence
  Synthetic
cggcccccgcgccccggcccc

SEQ ID NO: 25619 - RNA, 22 nt, Artificial Sequence
  Synthetic
ccggcccccgcgccccggcccc

SEQ ID NO: 25620 - RNA, 23 nt, Artificial Sequence
  Synthetic
cccggcccccgcgccccggcccc

SEQ ID NO: 25621 - RNA, 24 nt, Artificial Sequence
  Synthetic
gcccggcccccgcgccccggcccc

SEQ ID NO: 25622 - RNA, 18 nt, Artificial Sequence
  Synthetic
acuuccggggccgucccc

SEQ ID NO: 25623 - RNA, 19 nt, Artificial Sequence
  Synthetic
gacuuccggggccgucccc

SEQ ID NO: 25624 - RNA, 20 nt, Artificial Sequence
  Synthetic
agacuuccggggccgucccc

SEQ ID NO: 25625 - RNA, 21 nt, Artificial Sequence
  Synthetic
gagacuuccggggccgucccc

SEQ ID NO: 25626 - RNA, 22 nt, Artificial Sequence
  Synthetic
ggagacuuccggggccgucccc

SEQ ID NO: 25627 - RNA, 23 nt, Artificial Sequence
  Synthetic
cggagacuuccggggccgucccc

SEQ ID NO: 25628 - RNA, 24 nt, Artificial Sequence
  Synthetic
gcggagacuuccggggccgucccc

SEQ ID NO: 25629 - RNA, 18 nt, Artificial Sequence
  Synthetic
gcccccgcgccccggccc

SEQ ID NO: 25630 - RNA, 19 nt, Artificial Sequence
  Synthetic
ggcccccgcgccccggccc

SEQ ID NO: 25631 - RNA, 20 nt, Artificial Sequence
  Synthetic
cggcccccgcgccccggccc

SEQ ID NO: 25632 - RNA, 21 nt, Artificial Sequence
  Synthetic
ccggcccccgcgccccggccc

SEQ ID NO: 25633 - RNA, 22 nt, Artificial Sequence
  Synthetic
cccggcccccgcgccccggccc

SEQ ID NO: 25634 - RNA, 23 nt, Artificial Sequence
  Synthetic
gcccggcccccgcgccccggccc

SEQ ID NO: 25635 - RNA, 24 nt, Artificial Sequence
  Synthetic
ggcccggcccccgcgccccggccc

SEQ ID NO: 25636 - RNA, 18 nt, Artificial Sequence
  Synthetic
gcggggccgucggugccc

SEQ ID NO: 25637 - RNA, 19 nt, Artificial Sequence
  Synthetic
ggcggggccgucggugccc

SEQ ID NO: 25638 - RNA, 20 nt, Artificial Sequence
  Synthetic
gggcggggccgucggugccc

SEQ ID NO: 25639 - RNA, 21 nt, Artificial Sequence
  Synthetic
cgggcggggccgucggugccc

SEQ ID NO: 25640 - RNA, 22 nt, Artificial Sequence
  Synthetic
ucgggcggggccgucggugccc

SEQ ID NO: 25641 - RNA, 23 nt, Artificial Sequence
  Synthetic
cucgggcggggccgucggugccc

SEQ ID NO: 25642 - RNA, 24 nt, Artificial Sequence
  Synthetic
ccucgggcggggccgucggugccc

SEQ ID NO: 25643 - RNA, 18 nt, Artificial Sequence
  Synthetic
caggcuccgccccccgcc

SEQ ID NO: 25644 - RNA, 19 nt, Artificial Sequence
  Synthetic
ccaggcuccgccccccgcc

SEQ ID NO: 25645 - RNA, 20 nt, Artificial Sequence
  Synthetic
gccaggcuccgccccccgcc

SEQ ID NO: 25646 - RNA, 21 nt, Artificial Sequence
  Synthetic
ugccaggcuccgccccccgcc

SEQ ID NO: 25647 - RNA, 22 nt, Artificial Sequence
  Synthetic
augccaggcuccgccccccgcc

SEQ ID NO: 25648 - RNA, 23 nt, Artificial Sequence
  Synthetic
caugccaggcuccgccccccgcc

SEQ ID NO: 25649 - RNA, 24 nt, Artificial Sequence
  Synthetic
ccaugccaggcuccgccccccgcc

SEQ ID NO: 25650 - RNA, 18 nt, Artificial Sequence
  Synthetic
gucgcgagccgcggcgcc

SEQ ID NO: 25651 - RNA, 19 nt, Artificial Sequence
  Synthetic
agucgcgagccgcggcgcc

SEQ ID NO: 25652 - RNA, 20 nt, Artificial Sequence
  Synthetic
cagucgcgagccgcggcgcc

SEQ ID NO: 25653 - RNA, 21 nt, Artificial Sequence
  Synthetic
ccagucgcgagccgcggcgcc

SEQ ID NO: 25654 - RNA, 22 nt, Artificial Sequence
  Synthetic
gccagucgcgagccgcggcgcc

SEQ ID NO: 25655 - RNA, 23 nt, Artificial Sequence
  Synthetic
cgccagucgcgagccgcggcgcc

SEQ ID NO: 25656 - RNA, 24 nt, Artificial Sequence
  Synthetic
ccgccagucgcgagccgcggcgcc

SEQ ID NO: 25657 - RNA, 18 nt, Artificial Sequence
  Synthetic
ggcacccuagugggcgcc

SEQ ID NO: 25658 - RNA, 19 nt, Artificial Sequence
  Synthetic
gggcacccuagugggcgcc

SEQ ID NO: 25659 - RNA, 20 nt, Artificial Sequence
  Synthetic
agggcacccuagugggcgcc

SEQ ID NO: 25660 - RNA, 21 nt, Artificial Sequence
  Synthetic
cagggcacccuagugggcgcc

SEQ ID NO: 25661 - RNA, 22 nt, Artificial Sequence
  Synthetic
ccagggcacccuagugggcgcc

SEQ ID NO: 25662 - RNA, 23 nt, Artificial Sequence
  Synthetic
accagggcacccuagugggcgcc

SEQ ID NO: 25663 - RNA, 24 nt, Artificial Sequence
  Synthetic
gaccagggcacccuagugggcgcc

SEQ ID NO: 25664 - RNA, 18 nt, Artificial Sequence
  Synthetic
ucgucccuggcucaggcc

SEQ ID NO: 25665 - RNA, 19 nt, Artificial Sequence
  Synthetic
cucgucccuggcucaggcc

SEQ ID NO: 25666 - RNA, 20 nt, Artificial Sequence
  Synthetic
acucgucccuggcucaggcc

SEQ ID NO: 25667 - RNA, 21 nt, Artificial Sequence
  Synthetic
cacucgucccuggcucaggcc

SEQ ID NO: 25668 - RNA, 22 nt, Artificial Sequence
  Synthetic
gcacucgucccuggcucaggcc

SEQ ID NO: 25669 - RNA, 23 nt, Artificial Sequence
  Synthetic
cgcacucgucccuggcucaggcc

SEQ ID NO: 25670 - RNA, 24 nt, Artificial Sequence
  Synthetic
ucgcacucgucccuggcucaggcc

SEQ ID NO: 25671 - RNA, 18 nt, Artificial Sequence
  Synthetic
cagacccgcauggaggcc

SEQ ID NO: 25672 - RNA, 19 nt, Artificial Sequence
  Synthetic
ccagacccgcauggaggcc

SEQ ID NO: 25673 - RNA, 20 nt, Artificial Sequence
  Synthetic
cccagacccgcauggaggcc

SEQ ID NO: 25674 - RNA, 21 nt, Artificial Sequence
  Synthetic
ccccagacccgcauggaggcc

SEQ ID NO: 25675 - RNA, 22 nt, Artificial Sequence
  Synthetic
cccccagacccgcauggaggcc

SEQ ID NO: 25676 - RNA, 23 nt, Artificial Sequence
  Synthetic
acccccagacccgcauggaggcc

SEQ ID NO: 25677 - RNA, 24 nt, Artificial Sequence
  Synthetic
gacccccagacccgcauggaggcc

SEQ ID NO: 25678 - RNA, 18 nt, Artificial Sequence
  Synthetic
gucagggcgggcacggcc

SEQ ID NO: 25679 - RNA, 19 nt, Artificial Sequence
  Synthetic
cgucagggcgggcacggcc

SEQ ID NO: 25680 - RNA, 20 nt, Artificial Sequence
  Synthetic
ccgucagggcgggcacggcc

SEQ ID NO: 25681 - RNA, 21 nt, Artificial Sequence
  Synthetic
gccgucagggcgggcacggcc

SEQ ID NO: 25682 - RNA, 22 nt, Artificial Sequence
  Synthetic
ggccgucagggcgggcacggcc

SEQ ID NO: 25683 - RNA, 23 nt, Artificial Sequence
  Synthetic
aggccgucagggcgggcacggcc

SEQ ID NO: 25684 - RNA, 24 nt, Artificial Sequence
  Synthetic
gaggccgucagggcgggcacggcc

SEQ ID NO: 25685 - RNA, 18 nt, Artificial Sequence
  Synthetic
agcggaggcggggcggcc

SEQ ID NO: 25686 - RNA, 19 nt, Artificial Sequence
  Synthetic
aagcggaggcggggcggcc

SEQ ID NO: 25687 - RNA, 20 nt, Artificial Sequence
  Synthetic
gaagcggaggcggggcggcc

SEQ ID NO: 25688 - RNA, 21 nt, Artificial Sequence
  Synthetic
ugaagcggaggcggggcggcc

SEQ ID NO: 25689 - RNA, 22 nt, Artificial Sequence
  Synthetic
uugaagcggaggcggggcggcc

SEQ ID NO: 25690 - RNA, 23 nt, Artificial Sequence
  Synthetic
guugaagcggaggcggggcggcc

SEQ ID NO: 25691 - RNA, 24 nt, Artificial Sequence
  Synthetic
uguugaagcggaggcggggcggcc

SEQ ID NO: 25692 - RNA, 18 nt, Artificial Sequence
  Synthetic
ccccuccgacucagggcc

SEQ ID NO: 25693 - RNA, 19 nt, Artificial Sequence
  Synthetic
cccccuccgacucagggcc

SEQ ID NO: 25694 - RNA, 20 nt, Artificial Sequence
  Synthetic
ccccccuccgacucagggcc

SEQ ID NO: 25695 - RNA, 21 nt, Artificial Sequence
  Synthetic
cccccccuccgacucagggcc

SEQ ID NO: 25696 - RNA, 22 nt, Artificial Sequence
  Synthetic
acccccccuccgacucagggcc

SEQ ID NO: 25697 - RNA, 23 nt, Artificial Sequence
  Synthetic
cacccccccuccgacucagggcc

SEQ ID NO: 25698 - RNA, 24 nt, Artificial Sequence
  Synthetic
gcacccccccuccgacucagggcc

SEQ ID NO: 25699 - RNA, 18 nt, Artificial Sequence
  Synthetic
agaggcgcgggucgggcc

SEQ ID NO: 25700 - RNA, 19 nt, Artificial Sequence
  Synthetic
aagaggcgcgggucgggcc

SEQ ID NO: 25701 - RNA, 20 nt, Artificial Sequence
  Synthetic
gaagaggcgcgggucgggcc

SEQ ID NO: 25702 - RNA, 21 nt, Artificial Sequence
  Synthetic
ggaagaggcgcgggucgggcc

SEQ ID NO: 25703 - RNA, 22 nt, Artificial Sequence
  Synthetic
aggaagaggcgcgggucgggcc

SEQ ID NO: 25704 - RNA, 23 nt, Artificial Sequence
  Synthetic
gaggaagaggcgcgggucgggcc

SEQ ID NO: 25705 - RNA, 24 nt, Artificial Sequence
  Synthetic
cgaggaagaggcgcgggucgggcc

SEQ ID NO: 25706 - RNA, 18 nt, Artificial Sequence
  Synthetic
cucgcgccggcaggggcc

SEQ ID NO: 25707 - RNA, 19 nt, Artificial Sequence
  Synthetic
ccucgcgccggcaggggcc

SEQ ID NO: 25708 - RNA, 20 nt, Artificial Sequence
  Synthetic
cccucgcgccggcaggggcc

SEQ ID NO: 25709 - RNA, 21 nt, Artificial Sequence
  Synthetic
ccccucgcgccggcaggggcc

SEQ ID NO: 25710 - RNA, 22 nt, Artificial Sequence
  Synthetic
cccccucgcgccggcaggggcc

SEQ ID NO: 25711 - RNA, 23 nt, Artificial Sequence
  Synthetic
ccccccucgcgccggcaggggcc

SEQ ID NO: 25712 - RNA, 24 nt, Artificial Sequence
  Synthetic
cccccccucgcgccggcaggggcc

SEQ ID NO: 25713 - RNA, 18 nt, Artificial Sequence
  Synthetic
uucugggccgcgggggcc

SEQ ID NO: 25714 - RNA, 19 nt, Artificial Sequence
  Synthetic
cuucugggccgcgggggcc

SEQ ID NO: 25715 - RNA, 20 nt, Artificial Sequence
  Synthetic
gcuucugggccgcgggggcc

SEQ ID NO: 25716 - RNA, 21 nt, Artificial Sequence
  Synthetic
ugcuucugggccgcgggggcc

SEQ ID NO: 25717 - RNA, 22 nt, Artificial Sequence
  Synthetic
cugcuucugggccgcgggggcc

SEQ ID NO: 25718 - RNA, 23 nt, Artificial Sequence
  Synthetic
gcugcuucugggccgcgggggcc

SEQ ID NO: 25719 - RNA, 24 nt, Artificial Sequence
  Synthetic
cgcugcuucugggccgcgggggcc

SEQ ID NO: 25720 - RNA, 18 nt, Artificial Sequence
  Synthetic
ccgcgcugcuucugggcc

SEQ ID NO: 25721 - RNA, 19 nt, Artificial Sequence
  Synthetic
cccgcgcugcuucugggcc

SEQ ID NO: 25722 - RNA, 20 nt, Artificial Sequence
  Synthetic
ccccgcgcugcuucugggcc

SEQ ID NO: 25723 - RNA, 21 nt, Artificial Sequence
  Synthetic
cccccgcgcugcuucugggcc

SEQ ID NO: 25724 - RNA, 22 nt, Artificial Sequence
  Synthetic
gcccccgcgcugcuucugggcc

SEQ ID NO: 25725 - RNA, 23 nt, Artificial Sequence
  Synthetic
ggcccccgcgcugcuucugggcc

SEQ ID NO: 25726 - RNA, 24 nt, Artificial Sequence
  Synthetic
cggcccccgcgcugcuucugggcc

SEQ ID NO: 25727 - RNA, 18 nt, Artificial Sequence
  Synthetic
gcgcggccagggugggcc

SEQ ID NO: 25728 - RNA, 19 nt, Artificial Sequence
  Synthetic
ggcgcggccagggugggcc

SEQ ID NO: 25729 - RNA, 20 nt, Artificial Sequence
  Synthetic
gggcgcggccagggugggcc

SEQ ID NO: 25730 - RNA, 21 nt, Artificial Sequence
  Synthetic
ggggcgcggccagggugggcc

SEQ ID NO: 25731 - RNA, 22 nt, Artificial Sequence
  Synthetic
gggggcgcggccagggugggcc

SEQ ID NO: 25732 - RNA, 23 nt, Artificial Sequence
  Synthetic
ggggggcgcggccagggugggcc

SEQ ID NO: 25733 - RNA, 24 nt, Artificial Sequence
  Synthetic
gggggggcgcggccagggugggcc

SEQ ID NO: 25734 - RNA, 18 nt, Artificial Sequence
  Synthetic
ggcggggccgucggugcc

SEQ ID NO: 25735 - RNA, 19 nt, Artificial Sequence
  Synthetic
gggcggggccgucggugcc

SEQ ID NO: 25736 - RNA, 20 nt, Artificial Sequence
  Synthetic
cgggcggggccgucggugcc

SEQ ID NO: 25737 - RNA, 21 nt, Artificial Sequence
  Synthetic
ucgggcggggccgucggugcc

SEQ ID NO: 25738 - RNA, 22 nt, Artificial Sequence
  Synthetic
cucgggcggggccgucggugcc

SEQ ID NO: 25739 - RNA, 23 nt, Artificial Sequence
  Synthetic
ccucgggcggggccgucggugcc

SEQ ID NO: 25740 - RNA, 24 nt, Artificial Sequence
  Synthetic
uccucgggcggggccgucggugcc

SEQ ID NO: 25741 - RNA, 18 nt, Artificial Sequence
  Synthetic
gggccgaggaagugugcc

SEQ ID NO: 25742 - RNA, 19 nt, Artificial Sequence
  Synthetic
ggggccgaggaagugugcc

SEQ ID NO: 25743 - RNA, 20 nt, Artificial Sequence
  Synthetic
gggggccgaggaagugugcc

SEQ ID NO: 25744 - RNA, 21 nt, Artificial Sequence
  Synthetic
cgggggccgaggaagugugcc

SEQ ID NO: 25745 - RNA, 22 nt, Artificial Sequence
  Synthetic
gcgggggccgaggaagugugcc

SEQ ID NO: 25746 - RNA, 23 nt, Artificial Sequence
  Synthetic
cgcgggggccgaggaagugugcc

SEQ ID NO: 25747 - RNA, 24 nt, Artificial Sequence
  Synthetic
ccgcgggggccgaggaagugugcc

SEQ ID NO: 25748 - RNA, 18 nt, Artificial Sequence
  Synthetic
ggggcgucuggccccucc

SEQ ID NO: 25749 - RNA, 19 nt, Artificial Sequence
  Synthetic
gggggcgucuggccccucc

SEQ ID NO: 25750 - RNA, 20 nt, Artificial Sequence
  Synthetic
ggggggcgucuggccccucc

SEQ ID NO: 25751 - RNA, 21 nt, Artificial Sequence
  Synthetic
cggggggcgucuggccccucc

SEQ ID NO: 25752 - RNA, 22 nt, Artificial Sequence
  Synthetic
gcggggggcgucuggccccucc

SEQ ID NO: 25753 - RNA, 23 nt, Artificial Sequence
  Synthetic
cgcggggggcgucuggccccucc

SEQ ID NO: 25754 - RNA, 24 nt, Artificial Sequence
  Synthetic
ccgcggggggcgucuggccccucc

SEQ ID NO: 25755 - RNA, 18 nt, Artificial Sequence
  Synthetic
uccuccgcuuccgccucc

SEQ ID NO: 25756 - RNA, 19 nt, Artificial Sequence
  Synthetic
cuccuccgcuuccgccucc

SEQ ID NO: 25757 - RNA, 20 nt, Artificial Sequence
  Synthetic
ccuccuccgcuuccgccucc

SEQ ID NO: 25758 - RNA, 21 nt, Artificial Sequence
  Synthetic
uccuccuccgcuuccgccucc

SEQ ID NO: 25759 - RNA, 22 nt, Artificial Sequence
  Synthetic
guccuccuccgcuuccgccucc

SEQ ID NO: 25760 - RNA, 23 nt, Artificial Sequence
  Synthetic
cguccuccuccgcuuccgccucc

SEQ ID NO: 25761 - RNA, 24 nt, Artificial Sequence
  Synthetic
gcguccuccuccgcuuccgccucc

SEQ ID NO: 25762 - RNA, 18 nt, Artificial Sequence
  Synthetic
gccgccgcacccugcucc

SEQ ID NO: 25763 - RNA, 19 nt, Artificial Sequence
  Synthetic
agccgccgcacccugcucc

SEQ ID NO: 25764 - RNA, 20 nt, Artificial Sequence
  Synthetic
gagccgccgcacccugcucc

SEQ ID NO: 25765 - RNA, 21 nt, Artificial Sequence
  Synthetic
ggagccgccgcacccugcucc

SEQ ID NO: 25766 - RNA, 22 nt, Artificial Sequence
  Synthetic
uggagccgccgcacccugcucc

SEQ ID NO: 25767 - RNA, 23 nt, Artificial Sequence
  Synthetic
cuggagccgccgcacccugcucc

SEQ ID NO: 25768 - RNA, 24 nt, Artificial Sequence
  Synthetic
gcuggagccgccgcacccugcucc

SEQ ID NO: 25769 - RNA, 18 nt, Artificial Sequence
  Synthetic
ggaggcggcggugcgucc

SEQ ID NO: 25770 - RNA, 19 nt, Artificial Sequence
  Synthetic
aggaggcggcggugcgucc

SEQ ID NO: 25771 - RNA, 20 nt, Artificial Sequence
  Synthetic
caggaggcggcggugcgucc

SEQ ID NO: 25772 - RNA, 21 nt, Artificial Sequence
  Synthetic
gcaggaggcggcggugcgucc

SEQ ID NO: 25773 - RNA, 22 nt, Artificial Sequence
  Synthetic
agcaggaggcggcggugcgucc

SEQ ID NO: 25774 - RNA, 23 nt, Artificial Sequence
  Synthetic
gagcaggaggcggcggugcgucc

SEQ ID NO: 25775 - RNA, 24 nt, Artificial Sequence
  Synthetic
cgagcaggaggcggcggugcgucc

SEQ ID NO: 25776 - RNA, 18 nt, Artificial Sequence
  Synthetic
ucucggcacccguggucc

SEQ ID NO: 25777 - RNA, 19 nt, Artificial Sequence
  Synthetic
gucucggcacccguggucc

SEQ ID NO: 25778 - RNA, 20 nt, Artificial Sequence
  Synthetic
ggucucggcacccguggucc

SEQ ID NO: 25779 - RNA, 21 nt, Artificial Sequence
  Synthetic
cggucucggcacccguggucc

SEQ ID NO: 25780 - RNA, 22 nt, Artificial Sequence
  Synthetic
gcggucucggcacccguggucc

SEQ ID NO: 25781 - RNA, 23 nt, Artificial Sequence
  Synthetic
ugcggucucggcacccguggucc

SEQ ID NO: 25782 - RNA, 24 nt, Artificial Sequence
  Synthetic
cugcggucucggcacccguggucc

SEQ ID NO: 25783 - RNA, 18 nt, Artificial Sequence
  Synthetic
ccgccgccucugucgagc

SEQ ID NO: 25784 - RNA, 19 nt, Artificial Sequence
  Synthetic
uccgccgccucugucgagc

SEQ ID NO: 25785 - RNA, 20 nt, Artificial Sequence
  Synthetic
cuccgccgccucugucgagc

SEQ ID NO: 25786 - RNA, 21 nt, Artificial Sequence
  Synthetic
ccuccgccgccucugucgagc

SEQ ID NO: 25787 - RNA, 22 nt, Artificial Sequence
  Synthetic
cccuccgccgccucugucgagc

SEQ ID NO: 25788 - RNA, 23 nt, Artificial Sequence
  Synthetic
ccccuccgccgccucugucgagc

SEQ ID NO: 25789 - RNA, 24 nt, Artificial Sequence
  Synthetic
uccccuccgccgccucugucgagc

SEQ ID NO: 25790 - RNA, 18 nt, Artificial Sequence
  Synthetic
acccgugguccggggagc

SEQ ID NO: 25791 - RNA, 19 nt, Artificial Sequence
  Synthetic
cacccgugguccggggagc

SEQ ID NO: 25792 - RNA, 20 nt, Artificial Sequence
  Synthetic
gcacccgugguccggggagc

SEQ ID NO: 25793 - RNA, 21 nt, Artificial Sequence
  Synthetic
ggcacccgugguccggggagc

SEQ ID NO: 25794 - RNA, 22 nt, Artificial Sequence
  Synthetic
cggcacccgugguccggggagc

SEQ ID NO: 25795 - RNA, 23 nt, Artificial Sequence
  Synthetic
ucggcacccgugguccggggagc

SEQ ID NO: 25796 - RNA, 24 nt, Artificial Sequence
  Synthetic
cucggcacccgugguccggggagc

SEQ ID NO: 25797 - RNA, 18 nt, Artificial Sequence
  Synthetic
aacgacccccagacccgc

SEQ ID NO: 25798 - RNA, 19 nt, Artificial Sequence
  Synthetic
gaacgacccccagacccgc

SEQ ID NO: 25799 - RNA, 20 nt, Artificial Sequence
  Synthetic
ugaacgacccccagacccgc

SEQ ID NO: 25800 - RNA, 21 nt, Artificial Sequence
  Synthetic
gugaacgacccccagacccgc

SEQ ID NO: 25801 - RNA, 22 nt, Artificial Sequence
  Synthetic
cgugaacgacccccagacccgc

SEQ ID NO: 25802 - RNA, 23 nt, Artificial Sequence
  Synthetic
ucgugaacgacccccagacccgc

SEQ ID NO: 25803 - RNA, 24 nt, Artificial Sequence
  Synthetic
aucgugaacgacccccagacccgc

SEQ ID NO: 25804 - RNA, 18 nt, Artificial Sequence
  Synthetic
cucggccccgacccccgc

SEQ ID NO: 25805 - RNA, 19 nt, Artificial Sequence
  Synthetic
ccucggccccgacccccgc

SEQ ID NO: 25806 - RNA, 20 nt, Artificial Sequence
  Synthetic
uccucggccccgacccccgc

SEQ ID NO: 25807 - RNA, 21 nt, Artificial Sequence
  Synthetic
cuccucggccccgacccccgc

SEQ ID NO: 25808 - RNA, 22 nt, Artificial Sequence
  Synthetic
ccuccucggccccgacccccgc

SEQ ID NO: 25809 - RNA, 23 nt, Artificial Sequence
  Synthetic
uccuccucggccccgacccccgc

SEQ ID NO: 25810 - RNA, 24 nt, Artificial Sequence
  Synthetic
uuccuccucggccccgacccccgc

SEQ ID NO: 25811 - RNA, 18 nt, Artificial Sequence
  Synthetic
ggccgccucuuccgccgc

SEQ ID NO: 25812 - RNA, 19 nt, Artificial Sequence
  Synthetic
gggccgccucuuccgccgc

SEQ ID NO: 25813 - RNA, 20 nt, Artificial Sequence
  Synthetic
ggggccgccucuuccgccgc

SEQ ID NO: 25814 - RNA, 21 nt, Artificial Sequence
  Synthetic
gggggccgccucuuccgccgc

SEQ ID NO: 25815 - RNA, 22 nt, Artificial Sequence
  Synthetic
cgggggccgccucuuccgccgc

SEQ ID NO: 25816 - RNA, 23 nt, Artificial Sequence
  Synthetic
gcgggggccgccucuuccgccgc

SEQ ID NO: 25817 - RNA, 24 nt, Artificial Sequence
  Synthetic
cgcgggggccgccucuuccgccgc

SEQ ID NO: 25818 - RNA, 18 nt, Artificial Sequence
  Synthetic
cgcgagccgcggcgccgc

SEQ ID NO: 25819 - RNA, 19 nt, Artificial Sequence
  Synthetic
ucgcgagccgcggcgccgc

SEQ ID NO: 25820 - RNA, 20 nt, Artificial Sequence
  Synthetic
gucgcgagccgcggcgccgc

SEQ ID NO: 25821 - RNA, 21 nt, Artificial Sequence
  Synthetic
agucgcgagccgcggcgccgc

SEQ ID NO: 25822 - RNA, 22 nt, Artificial Sequence
  Synthetic
cagucgcgagccgcggcgccgc

SEQ ID NO: 25823 - RNA, 23 nt, Artificial Sequence
  Synthetic
ccagucgcgagccgcggcgccgc

SEQ ID NO: 25824 - RNA, 24 nt, Artificial Sequence
  Synthetic
gccagucgcgagccgcggcgccgc

SEQ ID NO: 25825 - RNA, 18 nt, Artificial Sequence
  Synthetic
gcgcugcuucugggccgc

SEQ ID NO: 25826 - RNA, 19 nt, Artificial Sequence
  Synthetic
cgcgcugcuucugggccgc

SEQ ID NO: 25827 - RNA, 20 nt, Artificial Sequence
  Synthetic
ccgcgcugcuucugggccgc

SEQ ID NO: 25828 - RNA, 21 nt, Artificial Sequence
  Synthetic
cccgcgcugcuucugggccgc

SEQ ID NO: 25829 - RNA, 22 nt, Artificial Sequence
  Synthetic
ccccgcgcugcuucugggccgc

SEQ ID NO: 25830 - RNA, 23 nt, Artificial Sequence
  Synthetic
cccccgcgcugcuucugggccgc

SEQ ID NO: 25831 - RNA, 24 nt, Artificial Sequence
  Synthetic
gcccccgcgcugcuucugggccgc

SEQ ID NO: 25832 - RNA, 18 nt, Artificial Sequence
  Synthetic
cgggccgcgguccccggc

SEQ ID NO: 25833 - RNA, 19 nt, Artificial Sequence
  Synthetic
gcgggccgcgguccccggc

SEQ ID NO: 25834 - RNA, 20 nt, Artificial Sequence
  Synthetic
ugcgggccgcgguccccggc

SEQ ID NO: 25835 - RNA, 21 nt, Artificial Sequence
  Synthetic
cugcgggccgcgguccccggc

SEQ ID NO: 25836 - RNA, 22 nt, Artificial Sequence
  Synthetic
gcugcgggccgcgguccccggc

SEQ ID NO: 25837 - RNA, 23 nt, Artificial Sequence
  Synthetic
ggcugcgggccgcgguccccggc

SEQ ID NO: 25838 - RNA, 24 nt, Artificial Sequence
  Synthetic
cggcugcgggccgcgguccccggc

SEQ ID NO: 25839 - RNA, 18 nt, Artificial Sequence
  Synthetic
ucccccccucgcgccggc

SEQ ID NO: 25840 - RNA, 19 nt, Artificial Sequence
  Synthetic
gucccccccucgcgccggc

SEQ ID NO: 25841 - RNA, 20 nt, Artificial Sequence
  Synthetic
cgucccccccucgcgccggc

SEQ ID NO: 25842 - RNA, 21 nt, Artificial Sequence
  Synthetic
gcgucccccccucgcgccggc

SEQ ID NO: 25843 - RNA, 22 nt, Artificial Sequence
  Synthetic
cgcgucccccccucgcgccggc

SEQ ID NO: 25844 - RNA, 23 nt, Artificial Sequence
  Synthetic
acgcgucccccccucgcgccggc

SEQ ID NO: 25845 - RNA, 24 nt, Artificial Sequence
  Synthetic
cacgcgucccccccucgcgccggc

SEQ ID NO: 25846 - RNA, 18 nt, Artificial Sequence
  Synthetic
cccccagccggccgcggc

SEQ ID NO: 25847 - RNA, 19 nt, Artificial Sequence
  Synthetic
ccccccagccggccgcggc

SEQ ID NO: 25848 - RNA, 20 nt, Artificial Sequence
  Synthetic
gccccccagccggccgcggc

SEQ ID NO: 25849 - RNA, 21 nt, Artificial Sequence
  Synthetic
agccccccagccggccgcggc

SEQ ID NO: 25850 - RNA, 22 nt, Artificial Sequence
  Synthetic
cagccccccagccggccgcggc

SEQ ID NO: 25851 - RNA, 23 nt, Artificial Sequence
  Synthetic
gcagccccccagccggccgcggc

SEQ ID NO: 25852 - RNA, 24 nt, Artificial Sequence
  Synthetic
cgcagccccccagccggccgcggc

SEQ ID NO: 25853 - RNA, 18 nt, Artificial Sequence
  Synthetic
gcgacgguggcgcgcggc

SEQ ID NO: 25854 - RNA, 19 nt, Artificial Sequence
  Synthetic
ugcgacgguggcgcgcggc

SEQ ID NO: 25855 - RNA, 20 nt, Artificial Sequence
  Synthetic
gugcgacgguggcgcgcggc

SEQ ID NO: 25856 - RNA, 21 nt, Artificial Sequence
  Synthetic
cgugcgacgguggcgcgcggc

SEQ ID NO: 25857 - RNA, 22 nt, Artificial Sequence
  Synthetic
gcgugcgacgguggcgcgcggc

SEQ ID NO: 25858 - RNA, 23 nt, Artificial Sequence
  Synthetic
cgcgugcgacgguggcgcgcggc

SEQ ID NO: 25859 - RNA, 24 nt, Artificial Sequence
  Synthetic
gcgcgugcgacgguggcgcgcggc

SEQ ID NO: 25860 - RNA, 18 nt, Artificial Sequence
  Synthetic
cccccuccgacucagggc

SEQ ID NO: 25861 - RNA, 19 nt, Artificial Sequence
  Synthetic
ccccccuccgacucagggc

SEQ ID NO: 25862 - RNA, 20 nt, Artificial Sequence
  Synthetic
cccccccuccgacucagggc

SEQ ID NO: 25863 - RNA, 21 nt, Artificial Sequence
  Synthetic
acccccccuccgacucagggc

SEQ ID NO: 25864 - RNA, 22 nt, Artificial Sequence
  Synthetic
cacccccccuccgacucagggc

SEQ ID NO: 25865 - RNA, 23 nt, Artificial Sequence
  Synthetic
gcacccccccuccgacucagggc

SEQ ID NO: 25866 - RNA, 24 nt, Artificial Sequence
  Synthetic
cgcacccccccuccgacucagggc

SEQ ID NO: 25867 - RNA, 18 nt, Artificial Sequence
  Synthetic
ggcucgggggggccgggc

SEQ ID NO: 25868 - RNA, 19 nt, Artificial Sequence
  Synthetic
cggcucgggggggccgggc

SEQ ID NO: 25869 - RNA, 20 nt, Artificial Sequence
  Synthetic
gcggcucgggggggccgggc

SEQ ID NO: 25870 - RNA, 21 nt, Artificial Sequence
  Synthetic
cgcggcucgggggggccgggc

SEQ ID NO: 25871 - RNA, 22 nt, Artificial Sequence
  Synthetic
gcgcggcucgggggggccgggc

SEQ ID NO: 25872 - RNA, 23 nt, Artificial Sequence
  Synthetic
cgcgcggcucgggggggccgggc

SEQ ID NO: 25873 - RNA, 24 nt, Artificial Sequence
  Synthetic
gcgcgcggcucgggggggccgggc

SEQ ID NO: 25874 - RNA, 18 nt, Artificial Sequence
  Synthetic
aagaggcgcgggucgggc

SEQ ID NO: 25875 - RNA, 19 nt, Artificial Sequence
  Synthetic
gaagaggcgcgggucgggc

SEQ ID NO: 25876 - RNA, 20 nt, Artificial Sequence
  Synthetic
ggaagaggcgcgggucgggc

SEQ ID NO: 25877 - RNA, 21 nt, Artificial Sequence
  Synthetic
aggaagaggcgcgggucgggc

SEQ ID NO: 25878 - RNA, 22 nt, Artificial Sequence
  Synthetic
gaggaagaggcgcgggucgggc

SEQ ID NO: 25879 - RNA, 23 nt, Artificial Sequence
  Synthetic
cgaggaagaggcgcgggucgggc

SEQ ID NO: 25880 - RNA, 24 nt, Artificial Sequence
  Synthetic
ccgaggaagaggcgcgggucgggc

SEQ ID NO: 25881 - RNA, 18 nt, Artificial Sequence
  Synthetic
ggcgcggccagggugggc

SEQ ID NO: 25882 - RNA, 19 nt, Artificial Sequence
  Synthetic
gggcgcggccagggugggc

SEQ ID NO: 25883 - RNA, 20 nt, Artificial Sequence
  Synthetic
ggggcgcggccagggugggc

SEQ ID NO: 25884 - RNA, 21 nt, Artificial Sequence
  Synthetic
gggggcgcggccagggugggc

SEQ ID NO: 25885 - RNA, 22 nt, Artificial Sequence
  Synthetic
ggggggcgcggccagggugggc

SEQ ID NO: 25886 - RNA, 23 nt, Artificial Sequence
  Synthetic
gggggggcgcggccagggugggc

SEQ ID NO: 25887 - RNA, 24 nt, Artificial Sequence
  Synthetic
cgggggggcgcggccagggugggc

SEQ ID NO: 25888 - RNA, 18 nt, Artificial Sequence
  Synthetic
cgggcguggagggugggc

SEQ ID NO: 25889 - RNA, 19 nt, Artificial Sequence
  Synthetic
ccgggcguggagggugggc

SEQ ID NO: 25890 - RNA, 20 nt, Artificial Sequence
  Synthetic
gccgggcguggagggugggc

SEQ ID NO: 25891 - RNA, 21 nt, Artificial Sequence
  Synthetic
ggccgggcguggagggugggc

SEQ ID NO: 25892 - RNA, 22 nt, Artificial Sequence
  Synthetic
gggccgggcguggagggugggc

SEQ ID NO: 25893 - RNA, 23 nt, Artificial Sequence
  Synthetic
ggggccgggcguggagggugggc

SEQ ID NO: 25894 - RNA, 24 nt, Artificial Sequence
  Synthetic
gggggccgggcguggagggugggc

SEQ ID NO: 25895 - RNA, 18 nt, Artificial Sequence
  Synthetic
ggggccgaggaagugugc

SEQ ID NO: 25896 - RNA, 19 nt, Artificial Sequence
  Synthetic
gggggccgaggaagugugc

SEQ ID NO: 25897 - RNA, 20 nt, Artificial Sequence
  Synthetic
cgggggccgaggaagugugc

SEQ ID NO: 25898 - RNA, 21 nt, Artificial Sequence
  Synthetic
gcgggggccgaggaagugugc

SEQ ID NO: 25899 - RNA, 22 nt, Artificial Sequence
  Synthetic
cgcgggggccgaggaagugugc

SEQ ID NO: 25900 - RNA, 23 nt, Artificial Sequence
  Synthetic
ccgcgggggccgaggaagugugc

SEQ ID NO: 25901 - RNA, 24 nt, Artificial Sequence
  Synthetic
gccgcgggggccgaggaagugugc

SEQ ID NO: 25902 - RNA, 18 nt, Artificial Sequence
  Synthetic
acgcgcuaccugcccauc

SEQ ID NO: 25903 - RNA, 19 nt, Artificial Sequence
  Synthetic
cacgcgcuaccugcccauc

SEQ ID NO: 25904 - RNA, 20 nt, Artificial Sequence
  Synthetic
ucacgcgcuaccugcccauc

SEQ ID NO: 25905 - RNA, 21 nt, Artificial Sequence
  Synthetic
cucacgcgcuaccugcccauc

SEQ ID NO: 25906 - RNA, 22 nt, Artificial Sequence
  Synthetic
ccucacgcgcuaccugcccauc

SEQ ID NO: 25907 - RNA, 23 nt, Artificial Sequence
  Synthetic
gccucacgcgcuaccugcccauc

SEQ ID NO: 25908 - RNA, 24 nt, Artificial Sequence
  Synthetic
ggccucacgcgcuaccugcccauc

SEQ ID NO: 25909 - RNA, 18 nt, Artificial Sequence
  Synthetic
ggggacugccugcccauc

SEQ ID NO: 25910 - RNA, 19 nt, Artificial Sequence
  Synthetic
gggggacugccugcccauc

SEQ ID NO: 25911 - RNA, 20 nt, Artificial Sequence
  Synthetic
cgggggacugccugcccauc

SEQ ID NO: 25912 - RNA, 21 nt, Artificial Sequence
  Synthetic
acgggggacugccugcccauc

SEQ ID NO: 25913 - RNA, 22 nt, Artificial Sequence
  Synthetic
cacgggggacugccugcccauc

SEQ ID NO: 25914 - RNA, 23 nt, Artificial Sequence
  Synthetic
ucacgggggacugccugcccauc

SEQ ID NO: 25915 - RNA, 24 nt, Artificial Sequence
  Synthetic
aucacgggggacugccugcccauc

SEQ ID NO: 25916 - RNA, 18 nt, Artificial Sequence
  Synthetic
uucagcaccaucccgauc

SEQ ID NO: 25917 - RNA, 19 nt, Artificial Sequence
  Synthetic
guucagcaccaucccgauc

SEQ ID NO: 25918 - RNA, 20 nt, Artificial Sequence
  Synthetic
cguucagcaccaucccgauc

SEQ ID NO: 25919 - RNA, 21 nt, Artificial Sequence
  Synthetic
ucguucagcaccaucccgauc

SEQ ID NO: 25920 - RNA, 22 nt, Artificial Sequence
  Synthetic
gucguucagcaccaucccgauc

SEQ ID NO: 25921 - RNA, 23 nt, Artificial Sequence
  Synthetic
ggucguucagcaccaucccgauc

SEQ ID NO: 25922 - RNA, 24 nt, Artificial Sequence
  Synthetic
gggucguucagcaccaucccgauc

SEQ ID NO: 25923 - RNA, 18 nt, Artificial Sequence
  Synthetic
uacgugaacaagacuauc

SEQ ID NO: 25924 - RNA, 19 nt, Artificial Sequence
  Synthetic
uuacgugaacaagacuauc

SEQ ID NO: 25925 - RNA, 20 nt, Artificial Sequence
  Synthetic
cuuacgugaacaagacuauc

SEQ ID NO: 25926 - RNA, 21 nt, Artificial Sequence
  Synthetic
ccuuacgugaacaagacuauc

SEQ ID NO: 25927 - RNA, 22 nt, Artificial Sequence
  Synthetic
gccuuacgugaacaagacuauc

SEQ ID NO: 25928 - RNA, 23 nt, Artificial Sequence
  Synthetic
cgccuuacgugaacaagacuauc

SEQ ID NO: 25929 - RNA, 24 nt, Artificial Sequence
  Synthetic
ucgccuuacgugaacaagacuauc

SEQ ID NO: 25930 - RNA, 18 nt, Artificial Sequence
  Synthetic
gggggcgucuggccccuc

SEQ ID NO: 25931 - RNA, 19 nt, Artificial Sequence
  Synthetic
ggggggcgucuggccccuc

SEQ ID NO: 25932 - RNA, 20 nt, Artificial Sequence
  Synthetic
cggggggcgucuggccccuc

SEQ ID NO: 25933 - RNA, 21 nt, Artificial Sequence
  Synthetic
gcggggggcgucuggccccuc

SEQ ID NO: 25934 - RNA, 22 nt, Artificial Sequence
  Synthetic
cgcggggggcgucuggccccuc

SEQ ID NO: 25935 - RNA, 23 nt, Artificial Sequence
  Synthetic
ccgcggggggcgucuggccccuc

SEQ ID NO: 25936 - RNA, 24 nt, Artificial Sequence
  Synthetic
gccgcggggggcgucuggccccuc

SEQ ID NO: 25937 - RNA, 18 nt, Artificial Sequence
  Synthetic
gcgugcgagcgccgccuc

SEQ ID NO: 25938 - RNA, 19 nt, Artificial Sequence
  Synthetic
ugcgugcgagcgccgccuc

SEQ ID NO: 25939 - RNA, 20 nt, Artificial Sequence
  Synthetic
gugcgugcgagcgccgccuc

SEQ ID NO: 25940 - RNA, 21 nt, Artificial Sequence
  Synthetic
cgugcgugcgagcgccgccuc

SEQ ID NO: 25941 - RNA, 22 nt, Artificial Sequence
  Synthetic
ccgugcgugcgagcgccgccuc

SEQ ID NO: 25942 - RNA, 23 nt, Artificial Sequence
  Synthetic
cccgugcgugcgagcgccgccuc

SEQ ID NO: 25943 - RNA, 24 nt, Artificial Sequence
  Synthetic
ccccgugcgugcgagcgccgccuc

SEQ ID NO: 25944 - RNA, 18 nt, Artificial Sequence
  Synthetic
gacgguggcgcgcggcuc

SEQ ID NO: 25945 - RNA, 19 nt, Artificial Sequence
  Synthetic
cgacgguggcgcgcggcuc

SEQ ID NO: 25946 - RNA, 20 nt, Artificial Sequence
  Synthetic
gcgacgguggcgcgcggcuc

SEQ ID NO: 25947 - RNA, 21 nt, Artificial Sequence
  Synthetic
ugcgacgguggcgcgcggcuc

SEQ ID NO: 25948 - RNA, 22 nt, Artificial Sequence
  Synthetic
gugcgacgguggcgcgcggcuc

SEQ ID NO: 25949 - RNA, 23 nt, Artificial Sequence
  Synthetic
cgugcgacgguggcgcgcggcuc

SEQ ID NO: 25950 - RNA, 24 nt, Artificial Sequence
  Synthetic
gcgugcgacgguggcgcgcggcuc

SEQ ID NO: 25951 - RNA, 18 nt, Artificial Sequence
  Synthetic
cggcggcucccgccaguc

SEQ ID NO: 25952 - RNA, 19 nt, Artificial Sequence
  Synthetic
gcggcggcucccgccaguc

SEQ ID NO: 25953 - RNA, 20 nt, Artificial Sequence
  Synthetic
ggcggcggcucccgccaguc

SEQ ID NO: 25954 - RNA, 21 nt, Artificial Sequence
  Synthetic
cggcggcggcucccgccaguc

SEQ ID NO: 25955 - RNA, 22 nt, Artificial Sequence
  Synthetic
gcggcggcggcucccgccaguc

SEQ ID NO: 25956 - RNA, 23 nt, Artificial Sequence
  Synthetic
ggcggcggcggcucccgccaguc

SEQ ID NO: 25957 - RNA, 24 nt, Artificial Sequence
  Synthetic
cggcggcggcggcucccgccaguc

SEQ ID NO: 25958 - RNA, 18 nt, Artificial Sequence
  Synthetic
gucucggcacccgugguc

SEQ ID NO: 25959 - RNA, 19 nt, Artificial Sequence
  Synthetic
ggucucggcacccgugguc

SEQ ID NO: 25960 - RNA, 20 nt, Artificial Sequence
  Synthetic
cggucucggcacccgugguc

SEQ ID NO: 25961 - RNA, 21 nt, Artificial Sequence
  Synthetic
gcggucucggcacccgugguc

SEQ ID NO: 25962 - RNA, 22 nt, Artificial Sequence
  Synthetic
ugcggucucggcacccgugguc

SEQ ID NO: 25963 - RNA, 23 nt, Artificial Sequence
  Synthetic
cugcggucucggcacccgugguc

SEQ ID NO: 25964 - RNA, 24 nt, Artificial Sequence
  Synthetic
ccugcggucucggcacccgugguc

SEQ ID NO: 25965 - RNA, 18 nt, Artificial Sequence
  Synthetic
gcgccacgcggagacuuc

SEQ ID NO: 25966 - RNA, 19 nt, Artificial Sequence
  Synthetic
cgcgccacgcggagacuuc

SEQ ID NO: 25967 - RNA, 20 nt, Artificial Sequence
  Synthetic
acgcgccacgcggagacuuc

SEQ ID NO: 25968 - RNA, 21 nt, Artificial Sequence
  Synthetic
gacgcgccacgcggagacuuc

SEQ ID NO: 25969 - RNA, 22 nt, Artificial Sequence
  Synthetic
agacgcgccacgcggagacuuc

SEQ ID NO: 25970 - RNA, 23 nt, Artificial Sequence
  Synthetic
aagacgcgccacgcggagacuuc

SEQ ID NO: 25971 - RNA, 24 nt, Artificial Sequence
  Synthetic
gaagacgcgccacgcggagacuuc

SEQ ID NO: 25972 - RNA, 18 nt, Artificial Sequence
  Synthetic
cccugggagggagacaag

SEQ ID NO: 25973 - RNA, 19 nt, Artificial Sequence
  Synthetic
gcccugggagggagacaag

SEQ ID NO: 25974 - RNA, 20 nt, Artificial Sequence
  Synthetic
ugcccugggagggagacaag

SEQ ID NO: 25975 - RNA, 21 nt, Artificial Sequence
  Synthetic
gugcccugggagggagacaag

SEQ ID NO: 25976 - RNA, 22 nt, Artificial Sequence
  Synthetic
ggugcccugggagggagacaag

SEQ ID NO: 25977 - RNA, 23 nt, Artificial Sequence
  Synthetic
cggugcccugggagggagacaag

SEQ ID NO: 25978 - RNA, 24 nt, Artificial Sequence
  Synthetic
ucggugcccugggagggagacaag

SEQ ID NO: 25979 - RNA, 18 nt, Artificial Sequence
  Synthetic
ggguugggguuguugaag

SEQ ID NO: 25980 - RNA, 19 nt, Artificial Sequence
  Synthetic
gggguugggguuguugaag

SEQ ID NO: 25981 - RNA, 20 nt, Artificial Sequence
  Synthetic
ugggguugggguuguugaag

SEQ ID NO: 25982 - RNA, 21 nt, Artificial Sequence
  Synthetic
uugggguugggguuguugaag

SEQ ID NO: 25983 - RNA, 22 nt, Artificial Sequence
  Synthetic
guugggguugggguuguugaag

SEQ ID NO: 25984 - RNA, 23 nt, Artificial Sequence
  Synthetic
gguugggguugggguuguugaag

SEQ ID NO: 25985 - RNA, 24 nt, Artificial Sequence
  Synthetic
ggguugggguugggguuguugaag

SEQ ID NO: 25986 - RNA, 18 nt, Artificial Sequence
  Synthetic
gugguccugguggaccag

SEQ ID NO: 25987 - RNA, 19 nt, Artificial Sequence
  Synthetic
cgugguccugguggaccag

SEQ ID NO: 25988 - RNA, 20 nt, Artificial Sequence
  Synthetic
acgugguccugguggaccag

SEQ ID NO: 25989 - RNA, 21 nt, Artificial Sequence
  Synthetic
uacgugguccugguggaccag

SEQ ID NO: 25990 - RNA, 22 nt, Artificial Sequence
  Synthetic
guacgugguccugguggaccag

SEQ ID NO: 25991 - RNA, 23 nt, Artificial Sequence
  Synthetic
cguacgugguccugguggaccag

SEQ ID NO: 25992 - RNA, 24 nt, Artificial Sequence
  Synthetic
gcguacgugguccugguggaccag

SEQ ID NO: 25993 - RNA, 18 nt, Artificial Sequence
  Synthetic
uccgccgccucugucgag

SEQ ID NO: 25994 - RNA, 19 nt, Artificial Sequence
  Synthetic
cuccgccgccucugucgag

SEQ ID NO: 25995 - RNA, 20 nt, Artificial Sequence
  Synthetic
ccuccgccgccucugucgag

SEQ ID NO: 25996 - RNA, 21 nt, Artificial Sequence
  Synthetic
cccuccgccgccucugucgag

SEQ ID NO: 25997 - RNA, 22 nt, Artificial Sequence
  Synthetic
ccccuccgccgccucugucgag

SEQ ID NO: 25998 - RNA, 23 nt, Artificial Sequence
  Synthetic
uccccuccgccgccucugucgag

SEQ ID NO: 25999 - RNA, 24 nt, Artificial Sequence
  Synthetic
cuccccuccgccgccucugucgag

SEQ ID NO: 26000 - RNA, 18 nt, Artificial Sequence
  Synthetic
gggguuguugaagcggag

SEQ ID NO: 26001 - RNA, 19 nt, Artificial Sequence
  Synthetic
ugggguuguugaagcggag

SEQ ID NO: 26002 - RNA, 20 nt, Artificial Sequence
  Synthetic
uugggguuguugaagcggag

SEQ ID NO: 26003 - RNA, 21 nt, Artificial Sequence
  Synthetic
guugggguuguugaagcggag

SEQ ID NO: 26004 - RNA, 22 nt, Artificial Sequence
  Synthetic
gguugggguuguugaagcggag

SEQ ID NO: 26005 - RNA, 23 nt, Artificial Sequence
  Synthetic
ggguugggguuguugaagcggag

SEQ ID NO: 26006 - RNA, 24 nt, Artificial Sequence
  Synthetic
gggguugggguuguugaagcggag

SEQ ID NO: 26007 - RNA, 18 nt, Artificial Sequence
  Synthetic
acggcccccgcgucggag

SEQ ID NO: 26008 - RNA, 19 nt, Artificial Sequence
  Synthetic
gacggcccccgcgucggag

SEQ ID NO: 26009 - RNA, 20 nt, Artificial Sequence
  Synthetic
cgacggcccccgcgucggag

SEQ ID NO: 26010 - RNA, 21 nt, Artificial Sequence
  Synthetic
ccgacggcccccgcgucggag

SEQ ID NO: 26011 - RNA, 22 nt, Artificial Sequence
  Synthetic
cccgacggcccccgcgucggag

SEQ ID NO: 26012 - RNA, 23 nt, Artificial Sequence
  Synthetic
acccgacggcccccgcgucggag

SEQ ID NO: 26013 - RNA, 24 nt, Artificial Sequence
  Synthetic
uacccgacggcccccgcgucggag

SEQ ID NO: 26014 - RNA, 18 nt, Artificial Sequence
  Synthetic
cacccgugguccggggag

SEQ ID NO: 26015 - RNA, 19 nt, Artificial Sequence
  Synthetic
gcacccgugguccggggag

SEQ ID NO: 26016 - RNA, 20 nt, Artificial Sequence
  Synthetic
ggcacccgugguccggggag

SEQ ID NO: 26017 - RNA, 21 nt, Artificial Sequence
  Synthetic
cggcacccgugguccggggag

SEQ ID NO: 26018 - RNA, 22 nt, Artificial Sequence
  Synthetic
ucggcacccgugguccggggag

SEQ ID NO: 26019 - RNA, 23 nt, Artificial Sequence
  Synthetic
cucggcacccgugguccggggag

SEQ ID NO: 26020 - RNA, 24 nt, Artificial Sequence
  Synthetic
ucucggcacccgugguccggggag

SEQ ID NO: 26021 - RNA, 18 nt, Artificial Sequence
  Synthetic
cccauccuggacauggag

SEQ ID NO: 26022 - RNA, 19 nt, Artificial Sequence
  Synthetic
gcccauccuggacauggag

SEQ ID NO: 26023 - RNA, 20 nt, Artificial Sequence
  Synthetic
ugcccauccuggacauggag

SEQ ID NO: 26024 - RNA, 21 nt, Artificial Sequence
  Synthetic
cugcccauccuggacauggag

SEQ ID NO: 26025 - RNA, 22 nt, Artificial Sequence
  Synthetic
ccugcccauccuggacauggag

SEQ ID NO: 26026 - RNA, 23 nt, Artificial Sequence
  Synthetic
gccugcccauccuggacauggag

SEQ ID NO: 26027 - RNA, 24 nt, Artificial Sequence
  Synthetic
ugccugcccauccuggacauggag

SEQ ID NO: 26028 - RNA, 18 nt, Artificial Sequence
  Synthetic
acccugggggggcacacg

SEQ ID NO: 26029 - RNA, 19 nt, Artificial Sequence
  Synthetic
gacccugggggggcacacg

SEQ ID NO: 26030 - RNA, 20 nt, Artificial Sequence
  Synthetic
ugacccugggggggcacacg

SEQ ID NO: 26031 - RNA, 21 nt, Artificial Sequence
  Synthetic
cugacccugggggggcacacg

SEQ ID NO: 26032 - RNA, 22 nt, Artificial Sequence
  Synthetic
ccugacccugggggggcacacg

SEQ ID NO: 26033 - RNA, 23 nt, Artificial Sequence
  Synthetic
accugacccugggggggcacacg

SEQ ID NO: 26034 - RNA, 24 nt, Artificial Sequence
  Synthetic
uaccugacccugggggggcacacg

SEQ ID NO: 26035 - RNA, 18 nt, Artificial Sequence
  Synthetic
gccccgcgcccccccacg

SEQ ID NO: 26036 - RNA, 19 nt, Artificial Sequence
  Synthetic
cgccccgcgcccccccacg

SEQ ID NO: 26037 - RNA, 20 nt, Artificial Sequence
  Synthetic
acgccccgcgcccccccacg

SEQ ID NO: 26038 - RNA, 21 nt, Artificial Sequence
  Synthetic
gacgccccgcgcccccccacg

SEQ ID NO: 26039 - RNA, 22 nt, Artificial Sequence
  Synthetic
ggacgccccgcgcccccccacg

SEQ ID NO: 26040 - RNA, 23 nt, Artificial Sequence
  Synthetic
cggacgccccgcgcccccccacg

SEQ ID NO: 26041 - RNA, 24 nt, Artificial Sequence
  Synthetic
ccggacgccccgcgcccccccacg

SEQ ID NO: 26042 - RNA, 18 nt, Artificial Sequence
  Synthetic
cccggaagacgcgccacg

SEQ ID NO: 26043 - RNA, 19 nt, Artificial Sequence
  Synthetic
gcccggaagacgcgccacg

SEQ ID NO: 26044 - RNA, 20 nt, Artificial Sequence
  Synthetic
ugcccggaagacgcgccacg

SEQ ID NO: 26045 - RNA, 21 nt, Artificial Sequence
  Synthetic
gugcccggaagacgcgccacg

SEQ ID NO: 26046 - RNA, 22 nt, Artificial Sequence
  Synthetic
ugugcccggaagacgcgccacg

SEQ ID NO: 26047 - RNA, 23 nt, Artificial Sequence
  Synthetic
gugugcccggaagacgcgccacg

SEQ ID NO: 26048 - RNA, 24 nt, Artificial Sequence
  Synthetic
agugugcccggaagacgcgccacg

SEQ ID NO: 26049 - RNA, 18 nt, Artificial Sequence
  Synthetic
gugaacaagacuaucacg

SEQ ID NO: 26050 - RNA, 19 nt, Artificial Sequence
  Synthetic
cgugaacaagacuaucacg

SEQ ID NO: 26051 - RNA, 20 nt, Artificial Sequence
  Synthetic
acgugaacaagacuaucacg

SEQ ID NO: 26052 - RNA, 21 nt, Artificial Sequence
  Synthetic
uacgugaacaagacuaucacg

SEQ ID NO: 26053 - RNA, 22 nt, Artificial Sequence
  Synthetic
uuacgugaacaagacuaucacg

SEQ ID NO: 26054 - RNA, 23 nt, Artificial Sequence
  Synthetic
cuuacgugaacaagacuaucacg

SEQ ID NO: 26055 - RNA, 24 nt, Artificial Sequence
  Synthetic
ccuuacgugaacaagacuaucacg

SEQ ID NO: 26056 - RNA, 18 nt, Artificial Sequence
  Synthetic
auccuggacauggagacg

SEQ ID NO: 26057 - RNA, 19 nt, Artificial Sequence
  Synthetic
cauccuggacauggagacg

SEQ ID NO: 26058 - RNA, 20 nt, Artificial Sequence
  Synthetic
ccauccuggacauggagacg

SEQ ID NO: 26059 - RNA, 21 nt, Artificial Sequence
  Synthetic
cccauccuggacauggagacg

SEQ ID NO: 26060 - RNA, 22 nt, Artificial Sequence
  Synthetic
gcccauccuggacauggagacg

SEQ ID NO: 26061 - RNA, 23 nt, Artificial Sequence
  Synthetic
ugcccauccuggacauggagacg

SEQ ID NO: 26062 - RNA, 24 nt, Artificial Sequence
  Synthetic
cugcccauccuggacauggagacg

SEQ ID NO: 26063 - RNA, 18 nt, Artificial Sequence
  Synthetic
gggcgucgacccgggacg

SEQ ID NO: 26064 - RNA, 19 nt, Artificial Sequence
  Synthetic
ggggcgucgacccgggacg

SEQ ID NO: 26065 - RNA, 20 nt, Artificial Sequence
  Synthetic
gggggcgucgacccgggacg

SEQ ID NO: 26066 - RNA, 21 nt, Artificial Sequence
  Synthetic
agggggcgucgacccgggacg

SEQ ID NO: 26067 - RNA, 22 nt, Artificial Sequence
  Synthetic
cagggggcgucgacccgggacg

SEQ ID NO: 26068 - RNA, 23 nt, Artificial Sequence
  Synthetic
gcagggggcgucgacccgggacg

SEQ ID NO: 26069 - RNA, 24 nt, Artificial Sequence
  Synthetic
agcagggggcgucgacccgggacg

SEQ ID NO: 26070 - RNA, 18 nt, Artificial Sequence
  Synthetic
ccucggccccgacccccg

SEQ ID NO: 26071 - RNA, 19 nt, Artificial Sequence
  Synthetic
uccucggccccgacccccg

SEQ ID NO: 26072 - RNA, 20 nt, Artificial Sequence
  Synthetic
cuccucggccccgacccccg

SEQ ID NO: 26073 - RNA, 21 nt, Artificial Sequence
  Synthetic
ccuccucggccccgacccccg

SEQ ID NO: 26074 - RNA, 22 nt, Artificial Sequence
  Synthetic
uccuccucggccccgacccccg

SEQ ID NO: 26075 - RNA, 23 nt, Artificial Sequence
  Synthetic
uuccuccucggccccgacccccg

SEQ ID NO: 26076 - RNA, 24 nt, Artificial Sequence
  Synthetic
cuuccuccucggccccgacccccg

SEQ ID NO: 26077 - RNA, 18 nt, Artificial Sequence
  Synthetic
gccucuggaugacccccg

SEQ ID NO: 26078 - RNA, 19 nt, Artificial Sequence
  Synthetic
agccucuggaugacccccg

SEQ ID NO: 26079 - RNA, 20 nt, Artificial Sequence
  Synthetic
cagccucuggaugacccccg

SEQ ID NO: 26080 - RNA, 21 nt, Artificial Sequence
  Synthetic
acagccucuggaugacccccg

SEQ ID NO: 26081 - RNA, 22 nt, Artificial Sequence
  Synthetic
aacagccucuggaugacccccg

SEQ ID NO: 26082 - RNA, 23 nt, Artificial Sequence
  Synthetic
gaacagccucuggaugacccccg

SEQ ID NO: 26083 - RNA, 24 nt, Artificial Sequence
  Synthetic
ggaacagccucuggaugacccccg

SEQ ID NO: 26084 - RNA, 18 nt, Artificial Sequence
  Synthetic
cguaccgcccgccccccg

SEQ ID NO: 26085 - RNA, 19 nt, Artificial Sequence
  Synthetic
acguaccgcccgccccccg

SEQ ID NO: 26086 - RNA, 20 nt, Artificial Sequence
  Synthetic
uacguaccgcccgccccccg

SEQ ID NO: 26087 - RNA, 21 nt, Artificial Sequence
  Synthetic
cuacguaccgcccgccccccg

SEQ ID NO: 26088 - RNA, 22 nt, Artificial Sequence
  Synthetic
acuacguaccgcccgccccccg

SEQ ID NO: 26089 - RNA, 23 nt, Artificial Sequence
  Synthetic
gacuacguaccgcccgccccccg

SEQ ID NO: 26090 - RNA, 24 nt, Artificial Sequence
  Synthetic
agacuacguaccgcccgccccccg

SEQ ID NO: 26091 - RNA, 18 nt, Artificial Sequence
  Synthetic
gggccgccucuuccgccg

SEQ ID NO: 26092 - RNA, 19 nt, Artificial Sequence
  Synthetic
ggggccgccucuuccgccg

SEQ ID NO: 26093 - RNA, 20 nt, Artificial Sequence
  Synthetic
gggggccgccucuuccgccg

SEQ ID NO: 26094 - RNA, 21 nt, Artificial Sequence
  Synthetic
cgggggccgccucuuccgccg

SEQ ID NO: 26095 - RNA, 22 nt, Artificial Sequence
  Synthetic
gcgggggccgccucuuccgccg

SEQ ID NO: 26096 - RNA, 23 nt, Artificial Sequence
  Synthetic
cgcgggggccgccucuuccgccg

SEQ ID NO: 26097 - RNA, 24 nt, Artificial Sequence
  Synthetic
ccgcgggggccgccucuuccgccg

SEQ ID NO: 26098 - RNA, 18 nt, Artificial Sequence
  Synthetic
ucgcgagccgcggcgccg

SEQ ID NO: 26099 - RNA, 19 nt, Artificial Sequence
  Synthetic
gucgcgagccgcggcgccg

SEQ ID NO: 26100 - RNA, 20 nt, Artificial Sequence
  Synthetic
agucgcgagccgcggcgccg

SEQ ID NO: 26101 - RNA, 21 nt, Artificial Sequence
  Synthetic
cagucgcgagccgcggcgccg

SEQ ID NO: 26102 - RNA, 22 nt, Artificial Sequence
  Synthetic
ccagucgcgagccgcggcgccg

SEQ ID NO: 26103 - RNA, 23 nt, Artificial Sequence
  Synthetic
gccagucgcgagccgcggcgccg

SEQ ID NO: 26104 - RNA, 24 nt, Artificial Sequence
  Synthetic
cgccagucgcgagccgcggcgccg

SEQ ID NO: 26105 - RNA, 18 nt, Artificial Sequence
  Synthetic
agacccgcauggaggccg

SEQ ID NO: 26106 - RNA, 19 nt, Artificial Sequence
  Synthetic
cagacccgcauggaggccg

SEQ ID NO: 26107 - RNA, 20 nt, Artificial Sequence
  Synthetic
ccagacccgcauggaggccg

SEQ ID NO: 26108 - RNA, 21 nt, Artificial Sequence
  Synthetic
cccagacccgcauggaggccg

SEQ ID NO: 26109 - RNA, 22 nt, Artificial Sequence
  Synthetic
ccccagacccgcauggaggccg

SEQ ID NO: 26110 - RNA, 23 nt, Artificial Sequence
  Synthetic
cccccagacccgcauggaggccg

SEQ ID NO: 26111 - RNA, 24 nt, Artificial Sequence
  Synthetic
acccccagacccgcauggaggccg

SEQ ID NO: 26112 - RNA, 18 nt, Artificial Sequence
  Synthetic
gcggaggcggggcggccg

SEQ ID NO: 26113 - RNA, 19 nt, Artificial Sequence
  Synthetic
agcggaggcggggcggccg

SEQ ID NO: 26114 - RNA, 20 nt, Artificial Sequence
  Synthetic
aagcggaggcggggcggccg

SEQ ID NO: 26115 - RNA, 21 nt, Artificial Sequence
  Synthetic
gaagcggaggcggggcggccg

SEQ ID NO: 26116 - RNA, 22 nt, Artificial Sequence
  Synthetic
ugaagcggaggcggggcggccg

SEQ ID NO: 26117 - RNA, 23 nt, Artificial Sequence
  Synthetic
uugaagcggaggcggggcggccg

SEQ ID NO: 26118 - RNA, 24 nt, Artificial Sequence
  Synthetic
guugaagcggaggcggggcggccg

SEQ ID NO: 26119 - RNA, 18 nt, Artificial Sequence
  Synthetic
cccuccgacucagggccg

SEQ ID NO: 26120 - RNA, 19 nt, Artificial Sequence
  Synthetic
ccccuccgacucagggccg

SEQ ID NO: 26121 - RNA, 20 nt, Artificial Sequence
  Synthetic
cccccuccgacucagggccg

SEQ ID NO: 26122 - RNA, 21 nt, Artificial Sequence
  Synthetic
ccccccuccgacucagggccg

SEQ ID NO: 26123 - RNA, 22 nt, Artificial Sequence
  Synthetic
cccccccuccgacucagggccg

SEQ ID NO: 26124 - RNA, 23 nt, Artificial Sequence
  Synthetic
acccccccuccgacucagggccg

SEQ ID NO: 26125 - RNA, 24 nt, Artificial Sequence
  Synthetic
cacccccccuccgacucagggccg

SEQ ID NO: 26126 - RNA, 18 nt, Artificial Sequence
  Synthetic
ucugggccgcgggggccg

SEQ ID NO: 26127 - RNA, 19 nt, Artificial Sequence
  Synthetic
uucugggccgcgggggccg

SEQ ID NO: 26128 - RNA, 20 nt, Artificial Sequence
  Synthetic
cuucugggccgcgggggccg

SEQ ID NO: 26129 - RNA, 21 nt, Artificial Sequence
  Synthetic
gcuucugggccgcgggggccg

SEQ ID NO: 26130 - RNA, 22 nt, Artificial Sequence
  Synthetic
ugcuucugggccgcgggggccg

SEQ ID NO: 26131 - RNA, 23 nt, Artificial Sequence
  Synthetic
cugcuucugggccgcgggggccg

SEQ ID NO: 26132 - RNA, 24 nt, Artificial Sequence
  Synthetic
gcugcuucugggccgcgggggccg

SEQ ID NO: 26133 - RNA, 18 nt, Artificial Sequence
  Synthetic
cgcgcugcuucugggccg

SEQ ID NO: 26134 - RNA, 19 nt, Artificial Sequence
  Synthetic
ccgcgcugcuucugggccg

SEQ ID NO: 26135 - RNA, 20 nt, Artificial Sequence
  Synthetic
cccgcgcugcuucugggccg

SEQ ID NO: 26136 - RNA, 21 nt, Artificial Sequence
  Synthetic
ccccgcgcugcuucugggccg

SEQ ID NO: 26137 - RNA, 22 nt, Artificial Sequence
  Synthetic
cccccgcgcugcuucugggccg

SEQ ID NO: 26138 - RNA, 23 nt, Artificial Sequence
  Synthetic
gcccccgcgcugcuucugggccg

SEQ ID NO: 26139 - RNA, 24 nt, Artificial Sequence
  Synthetic
ggcccccgcgcugcuucugggccg

SEQ ID NO: 26140 - RNA, 18 nt, Artificial Sequence
  Synthetic
gggcgucuggccccuccg

SEQ ID NO: 26141 - RNA, 19 nt, Artificial Sequence
  Synthetic
ggggcgucuggccccuccg

SEQ ID NO: 26142 - RNA, 20 nt, Artificial Sequence
  Synthetic
gggggcgucuggccccuccg

SEQ ID NO: 26143 - RNA, 21 nt, Artificial Sequence
  Synthetic
ggggggcgucuggccccuccg

SEQ ID NO: 26144 - RNA, 22 nt, Artificial Sequence
  Synthetic
cggggggcgucuggccccuccg

SEQ ID NO: 26145 - RNA, 23 nt, Artificial Sequence
  Synthetic
gcggggggcgucuggccccuccg

SEQ ID NO: 26146 - RNA, 24 nt, Artificial Sequence
  Synthetic
cgcggggggcgucuggccccuccg

SEQ ID NO: 26147 - RNA, 18 nt, Artificial Sequence
  Synthetic
gaggcggcggugcguccg

SEQ ID NO: 26148 - RNA, 19 nt, Artificial Sequence
  Synthetic
ggaggcggcggugcguccg

SEQ ID NO: 26149 - RNA, 20 nt, Artificial Sequence
  Synthetic
aggaggcggcggugcguccg

SEQ ID NO: 26150 - RNA, 21 nt, Artificial Sequence
  Synthetic
caggaggcggcggugcguccg

SEQ ID NO: 26151 - RNA, 22 nt, Artificial Sequence
  Synthetic
gcaggaggcggcggugcguccg

SEQ ID NO: 26152 - RNA, 23 nt, Artificial Sequence
  Synthetic
agcaggaggcggcggugcguccg

SEQ ID NO: 26153 - RNA, 24 nt, Artificial Sequence
  Synthetic
gagcaggaggcggcggugcguccg

SEQ ID NO: 26154 - RNA, 18 nt, Artificial Sequence
  Synthetic
cucggcacccgugguccg

SEQ ID NO: 26155 - RNA, 19 nt, Artificial Sequence
  Synthetic
ucucggcacccgugguccg

SEQ ID NO: 26156 - RNA, 20 nt, Artificial Sequence
  Synthetic
gucucggcacccgugguccg

SEQ ID NO: 26157 - RNA, 21 nt, Artificial Sequence
  Synthetic
ggucucggcacccgugguccg

SEQ ID NO: 26158 - RNA, 22 nt, Artificial Sequence
  Synthetic
cggucucggcacccgugguccg

SEQ ID NO: 26159 - RNA, 23 nt, Artificial Sequence
  Synthetic
gcggucucggcacccgugguccg

SEQ ID NO: 26160 - RNA, 24 nt, Artificial Sequence
  Synthetic
ugcggucucggcacccgugguccg

SEQ ID NO: 26161 - RNA, 18 nt, Artificial Sequence
  Synthetic
uacccgacggcccccgcg

SEQ ID NO: 26162 - RNA, 19 nt, Artificial Sequence
  Synthetic
guacccgacggcccccgcg

SEQ ID NO: 26163 - RNA, 20 nt, Artificial Sequence
  Synthetic
aguacccgacggcccccgcg

SEQ ID NO: 26164 - RNA, 21 nt, Artificial Sequence
  Synthetic
gaguacccgacggcccccgcg

SEQ ID NO: 26165 - RNA, 22 nt, Artificial Sequence
  Synthetic
cgaguacccgacggcccccgcg

SEQ ID NO: 26166 - RNA, 23 nt, Artificial Sequence
  Synthetic
ccgaguacccgacggcccccgcg

SEQ ID NO: 26167 - RNA, 24 nt, Artificial Sequence
  Synthetic
cccgaguacccgacggcccccgcg

SEQ ID NO: 26168 - RNA, 18 nt, Artificial Sequence
  Synthetic
gcgagccgcggcgccgcg

SEQ ID NO: 26169 - RNA, 19 nt, Artificial Sequence
  Synthetic
cgcgagccgcggcgccgcg

SEQ ID NO: 26170 - RNA, 20 nt, Artificial Sequence
  Synthetic
ucgcgagccgcggcgccgcg

SEQ ID NO: 26171 - RNA, 21 nt, Artificial Sequence
  Synthetic
gucgcgagccgcggcgccgcg

SEQ ID NO: 26172 - RNA, 22 nt, Artificial Sequence
  Synthetic
agucgcgagccgcggcgccgcg

SEQ ID NO: 26173 - RNA, 23 nt, Artificial Sequence
  Synthetic
cagucgcgagccgcggcgccgcg

SEQ ID NO: 26174 - RNA, 24 nt, Artificial Sequence
  Synthetic
ccagucgcgagccgcggcgccgcg

SEQ ID NO: 26175 - RNA, 18 nt, Artificial Sequence
  Synthetic
cccgcguccgcggccgcg

SEQ ID NO: 26176 - RNA, 19 nt, Artificial Sequence
  Synthetic
ccccgcguccgcggccgcg

SEQ ID NO: 26177 - RNA, 20 nt, Artificial Sequence
  Synthetic
cccccgcguccgcggccgcg

SEQ ID NO: 26178 - RNA, 21 nt, Artificial Sequence
  Synthetic
ccccccgcguccgcggccgcg

SEQ ID NO: 26179 - RNA, 22 nt, Artificial Sequence
  Synthetic
gccccccgcguccgcggccgcg

SEQ ID NO: 26180 - RNA, 23 nt, Artificial Sequence
  Synthetic
ggccccccgcguccgcggccgcg

SEQ ID NO: 26181 - RNA, 24 nt, Artificial Sequence
  Synthetic
gggccccccgcguccgcggccgcg

SEQ ID NO: 26182 - RNA, 18 nt, Artificial Sequence
  Synthetic
gcucgggggggccgggcg

SEQ ID NO: 26183 - RNA, 19 nt, Artificial Sequence
  Synthetic
ggcucgggggggccgggcg

SEQ ID NO: 26184 - RNA, 20 nt, Artificial Sequence
  Synthetic
cggcucgggggggccgggcg

SEQ ID NO: 26185 - RNA, 21 nt, Artificial Sequence
  Synthetic
gcggcucgggggggccgggcg

SEQ ID NO: 26186 - RNA, 22 nt, Artificial Sequence
  Synthetic
cgcggcucgggggggccgggcg

SEQ ID NO: 26187 - RNA, 23 nt, Artificial Sequence
  Synthetic
gcgcggcucgggggggccgggcg

SEQ ID NO: 26188 - RNA, 24 nt, Artificial Sequence
  Synthetic
cgcgcggcucgggggggccgggcg

SEQ ID NO: 26189 - RNA, 18 nt, Artificial Sequence
  Synthetic
acgguggcgcgcggcucg

SEQ ID NO: 26190 - RNA, 19 nt, Artificial Sequence
  Synthetic
gacgguggcgcgcggcucg

SEQ ID NO: 26191 - RNA, 20 nt, Artificial Sequence
  Synthetic
cgacgguggcgcgcggcucg

SEQ ID NO: 26192 - RNA, 21 nt, Artificial Sequence
  Synthetic
gcgacgguggcgcgcggcucg

SEQ ID NO: 26193 - RNA, 22 nt, Artificial Sequence
  Synthetic
ugcgacgguggcgcgcggcucg

SEQ ID NO: 26194 - RNA, 23 nt, Artificial Sequence
  Synthetic
gugcgacgguggcgcgcggcucg

SEQ ID NO: 26195 - RNA, 24 nt, Artificial Sequence
  Synthetic
cgugcgacgguggcgcgcggcucg

SEQ ID NO: 26196 - RNA, 18 nt, Artificial Sequence
  Synthetic
cgggggggcgcggccagg

SEQ ID NO: 26197 - RNA, 19 nt, Artificial Sequence
  Synthetic
ccgggggggcgcggccagg

SEQ ID NO: 26198 - RNA, 20 nt, Artificial Sequence
  Synthetic
gccgggggggcgcggccagg

SEQ ID NO: 26199 - RNA, 21 nt, Artificial Sequence
  Synthetic
ggccgggggggcgcggccagg

SEQ ID NO: 26200 - RNA, 22 nt, Artificial Sequence
  Synthetic
gggccgggggggcgcggccagg

SEQ ID NO: 26201 - RNA, 23 nt, Artificial Sequence
  Synthetic
agggccgggggggcgcggccagg

SEQ ID NO: 26202 - RNA, 24 nt, Artificial Sequence
  Synthetic
cagggccgggggggcgcggccagg

SEQ ID NO: 26203 - RNA, 18 nt, Artificial Sequence
  Synthetic
gccgaggaggccgucagg

SEQ ID NO: 26204 - RNA, 19 nt, Artificial Sequence
  Synthetic
ggccgaggaggccgucagg

SEQ ID NO: 26205 - RNA, 20 nt, Artificial Sequence
  Synthetic
aggccgaggaggccgucagg

SEQ ID NO: 26206 - RNA, 21 nt, Artificial Sequence
  Synthetic
gaggccgaggaggccgucagg

SEQ ID NO: 26207 - RNA, 22 nt, Artificial Sequence
  Synthetic
ggaggccgaggaggccgucagg

SEQ ID NO: 26208 - RNA, 23 nt, Artificial Sequence
  Synthetic
uggaggccgaggaggccgucagg

SEQ ID NO: 26209 - RNA, 24 nt, Artificial Sequence
  Synthetic
auggaggccgaggaggccgucagg

SEQ ID NO: 26210 - RNA, 18 nt, Artificial Sequence
  Synthetic
gcggcggugcguccgagg

SEQ ID NO: 26211 - RNA, 19 nt, Artificial Sequence
  Synthetic
ggcggcggugcguccgagg

SEQ ID NO: 26212 - RNA, 20 nt, Artificial Sequence
  Synthetic
aggcggcggugcguccgagg

SEQ ID NO: 26213 - RNA, 21 nt, Artificial Sequence
  Synthetic
gaggcggcggugcguccgagg

SEQ ID NO: 26214 - RNA, 22 nt, Artificial Sequence
  Synthetic
ggaggcggcggugcguccgagg

SEQ ID NO: 26215 - RNA, 23 nt, Artificial Sequence
  Synthetic
aggaggcggcggugcguccgagg

SEQ ID NO: 26216 - RNA, 24 nt, Artificial Sequence
  Synthetic
caggaggcggcggugcguccgagg

SEQ ID NO: 26217 - RNA, 18 nt, Artificial Sequence
  Synthetic
ggguuguugaagcggagg

SEQ ID NO: 26218 - RNA, 19 nt, Artificial Sequence
  Synthetic
gggguuguugaagcggagg

SEQ ID NO: 26219 - RNA, 20 nt, Artificial Sequence
  Synthetic
ugggguuguugaagcggagg

SEQ ID NO: 26220 - RNA, 21 nt, Artificial Sequence
  Synthetic
uugggguuguugaagcggagg

SEQ ID NO: 26221 - RNA, 22 nt, Artificial Sequence
  Synthetic
guugggguuguugaagcggagg

SEQ ID NO: 26222 - RNA, 23 nt, Artificial Sequence
  Synthetic
gguugggguuguugaagcggagg

SEQ ID NO: 26223 - RNA, 24 nt, Artificial Sequence
  Synthetic
ggguugggguuguugaagcggagg

SEQ ID NO: 26224 - RNA, 18 nt, Artificial Sequence
  Synthetic
cccagacccgcauggagg

SEQ ID NO: 26225 - RNA, 19 nt, Artificial Sequence
  Synthetic
ccccagacccgcauggagg

SEQ ID NO: 26226 - RNA, 20 nt, Artificial Sequence
  Synthetic
cccccagacccgcauggagg

SEQ ID NO: 26227 - RNA, 21 nt, Artificial Sequence
  Synthetic
acccccagacccgcauggagg

SEQ ID NO: 26228 - RNA, 22 nt, Artificial Sequence
  Synthetic
gacccccagacccgcauggagg

SEQ ID NO: 26229 - RNA, 23 nt, Artificial Sequence
  Synthetic
cgacccccagacccgcauggagg

SEQ ID NO: 26230 - RNA, 24 nt, Artificial Sequence
  Synthetic
acgacccccagacccgcauggagg

SEQ ID NO: 26231 - RNA, 18 nt, Artificial Sequence
  Synthetic
gggggccgggcguggagg

SEQ ID NO: 26232 - RNA, 19 nt, Artificial Sequence
  Synthetic
ggggggccgggcguggagg

SEQ ID NO: 26233 - RNA, 20 nt, Artificial Sequence
  Synthetic
gggggggccgggcguggagg

SEQ ID NO: 26234 - RNA, 21 nt, Artificial Sequence
  Synthetic
cgggggggccgggcguggagg

SEQ ID NO: 26235 - RNA, 22 nt, Artificial Sequence
  Synthetic
ucgggggggccgggcguggagg

SEQ ID NO: 26236 - RNA, 23 nt, Artificial Sequence
  Synthetic
cucgggggggccgggcguggagg

SEQ ID NO: 26237 - RNA, 24 nt, Artificial Sequence
  Synthetic
gcucgggggggccgggcguggagg

SEQ ID NO: 26238 - RNA, 18 nt, Artificial Sequence
  Synthetic
acccggagcccaccacgg

SEQ ID NO: 26239 - RNA, 19 nt, Artificial Sequence
  Synthetic
cacccggagcccaccacgg

SEQ ID NO: 26240 - RNA, 20 nt, Artificial Sequence
  Synthetic
ccacccggagcccaccacgg

SEQ ID NO: 26241 - RNA, 21 nt, Artificial Sequence
  Synthetic
cccacccggagcccaccacgg

SEQ ID NO: 26242 - RNA, 22 nt, Artificial Sequence
  Synthetic
acccacccggagcccaccacgg

SEQ ID NO: 26243 - RNA, 23 nt, Artificial Sequence
  Synthetic
cacccacccggagcccaccacgg

SEQ ID NO: 26244 - RNA, 24 nt, Artificial Sequence
  Synthetic
ccacccacccggagcccaccacgg

SEQ ID NO: 26245 - RNA, 18 nt, Artificial Sequence
  Synthetic
ccgcgccccccgugacgg

SEQ ID NO: 26246 - RNA, 19 nt, Artificial Sequence
  Synthetic
gccgcgccccccgugacgg

SEQ ID NO: 26247 - RNA, 20 nt, Artificial Sequence
  Synthetic
cgccgcgccccccgugacgg

SEQ ID NO: 26248 - RNA, 21 nt, Artificial Sequence
  Synthetic
ccgccgcgccccccgugacgg

SEQ ID NO: 26249 - RNA, 22 nt, Artificial Sequence
  Synthetic
gccgccgcgccccccgugacgg

SEQ ID NO: 26250 - RNA, 23 nt, Artificial Sequence
  Synthetic
cgccgccgcgccccccgugacgg

SEQ ID NO: 26251 - RNA, 24 nt, Artificial Sequence
  Synthetic
gcgccgccgcgccccccgugacgg

SEQ ID NO: 26252 - RNA, 18 nt, Artificial Sequence
  Synthetic
gcgggccgcgguccccgg

SEQ ID NO: 26253 - RNA, 19 nt, Artificial Sequence
  Synthetic
ugcgggccgcgguccccgg

SEQ ID NO: 26254 - RNA, 20 nt, Artificial Sequence
  Synthetic
cugcgggccgcgguccccgg

SEQ ID NO: 26255 - RNA, 21 nt, Artificial Sequence
  Synthetic
gcugcgggccgcgguccccgg

SEQ ID NO: 26256 - RNA, 22 nt, Artificial Sequence
  Synthetic
ggcugcgggccgcgguccccgg

SEQ ID NO: 26257 - RNA, 23 nt, Artificial Sequence
  Synthetic
cggcugcgggccgcgguccccgg

SEQ ID NO: 26258 - RNA, 24 nt, Artificial Sequence
  Synthetic
ccggcugcgggccgcgguccccgg

SEQ ID NO: 26259 - RNA, 18 nt, Artificial Sequence
  Synthetic
gucccccccucgcgccgg

SEQ ID NO: 26260 - RNA, 19 nt, Artificial Sequence
  Synthetic
cgucccccccucgcgccgg

SEQ ID NO: 26261 - RNA, 20 nt, Artificial Sequence
  Synthetic
gcgucccccccucgcgccgg

SEQ ID NO: 26262 - RNA, 21 nt, Artificial Sequence
  Synthetic
cgcgucccccccucgcgccgg

SEQ ID NO: 26263 - RNA, 22 nt, Artificial Sequence
  Synthetic
acgcgucccccccucgcgccgg

SEQ ID NO: 26264 - RNA, 23 nt, Artificial Sequence
  Synthetic
cacgcgucccccccucgcgccgg

SEQ ID NO: 26265 - RNA, 24 nt, Artificial Sequence
  Synthetic
ccacgcgucccccccucgcgccgg

SEQ ID NO: 26266 - RNA, 18 nt, Artificial Sequence
  Synthetic
ccuccgacucagggccgg

SEQ ID NO: 26267 - RNA, 19 nt, Artificial Sequence
  Synthetic
cccuccgacucagggccgg

SEQ ID NO: 26268 - RNA, 20 nt, Artificial Sequence
  Synthetic
ccccuccgacucagggccgg

SEQ ID NO: 26269 - RNA, 21 nt, Artificial Sequence
  Synthetic
cccccuccgacucagggccgg

SEQ ID NO: 26270 - RNA, 22 nt, Artificial Sequence
  Synthetic
ccccccuccgacucagggccgg

SEQ ID NO: 26271 - RNA, 23 nt, Artificial Sequence
  Synthetic
cccccccuccgacucagggccgg

SEQ ID NO: 26272 - RNA, 24 nt, Artificial Sequence
  Synthetic
acccccccuccgacucagggccgg

SEQ ID NO: 26273 - RNA, 18 nt, Artificial Sequence
  Synthetic
gggcggccgaggggccgg

SEQ ID NO: 26274 - RNA, 19 nt, Artificial Sequence
  Synthetic
ggggcggccgaggggccgg

SEQ ID NO: 26275 - RNA, 20 nt, Artificial Sequence
  Synthetic
cggggcggccgaggggccgg

SEQ ID NO: 26276 - RNA, 21 nt, Artificial Sequence
  Synthetic
gcggggcggccgaggggccgg

SEQ ID NO: 26277 - RNA, 22 nt, Artificial Sequence
  Synthetic
ggcggggcggccgaggggccgg

SEQ ID NO: 26278 - RNA, 23 nt, Artificial Sequence
  Synthetic
aggcggggcggccgaggggccgg

SEQ ID NO: 26279 - RNA, 24 nt, Artificial Sequence
  Synthetic
gaggcggggcggccgaggggccgg

SEQ ID NO: 26280 - RNA, 18 nt, Artificial Sequence
  Synthetic
gaagcggaggcggggcgg

SEQ ID NO: 26281 - RNA, 19 nt, Artificial Sequence
  Synthetic
ugaagcggaggcggggcgg

SEQ ID NO: 26282 - RNA, 20 nt, Artificial Sequence
  Synthetic
uugaagcggaggcggggcgg

SEQ ID NO: 26283 - RNA, 21 nt, Artificial Sequence
  Synthetic
guugaagcggaggcggggcgg

SEQ ID NO: 26284 - RNA, 22 nt, Artificial Sequence
  Synthetic
uguugaagcggaggcggggcgg

SEQ ID NO: 26285 - RNA, 23 nt, Artificial Sequence
  Synthetic
uuguugaagcggaggcggggcgg

SEQ ID NO: 26286 - RNA, 24 nt, Artificial Sequence
  Synthetic
guuguugaagcggaggcggggcgg

SEQ ID NO: 26287 - RNA, 18 nt, Artificial Sequence
  Synthetic
ccgcuuccgccuccucgg

SEQ ID NO: 26288 - RNA, 19 nt, Artificial Sequence
  Synthetic
uccgcuuccgccuccucgg

SEQ ID NO: 26289 - RNA, 20 nt, Artificial Sequence
  Synthetic
cuccgcuuccgccuccucgg

SEQ ID NO: 26290 - RNA, 21 nt, Artificial Sequence
  Synthetic
ccuccgcuuccgccuccucgg

SEQ ID NO: 26291 - RNA, 22 nt, Artificial Sequence
  Synthetic
uccuccgcuuccgccuccucgg

SEQ ID NO: 26292 - RNA, 23 nt, Artificial Sequence
  Synthetic
cuccuccgcuuccgccuccucgg

SEQ ID NO: 26293 - RNA, 24 nt, Artificial Sequence
  Synthetic
ccuccuccgcuuccgccuccucgg

SEQ ID NO: 26294 - RNA, 18 nt, Artificial Sequence
  Synthetic
cgguggcgcgcggcucgg

SEQ ID NO: 26295 - RNA, 19 nt, Artificial Sequence
  Synthetic
acgguggcgcgcggcucgg

SEQ ID NO: 26296 - RNA, 20 nt, Artificial Sequence
  Synthetic
gacgguggcgcgcggcucgg

SEQ ID NO: 26297 - RNA, 21 nt, Artificial Sequence
  Synthetic
cgacgguggcgcgcggcucgg

SEQ ID NO: 26298 - RNA, 22 nt, Artificial Sequence
  Synthetic
gcgacgguggcgcgcggcucgg

SEQ ID NO: 26299 - RNA, 23 nt, Artificial Sequence
  Synthetic
ugcgacgguggcgcgcggcucgg

SEQ ID NO: 26300 - RNA, 24 nt, Artificial Sequence
  Synthetic
gugcgacgguggcgcgcggcucgg

SEQ ID NO: 26301 - RNA, 18 nt, Artificial Sequence
  Synthetic
ccccccuccgacucaggg

SEQ ID NO: 26302 - RNA, 19 nt, Artificial Sequence
  Synthetic
cccccccuccgacucaggg

SEQ ID NO: 26303 - RNA, 20 nt, Artificial Sequence
  Synthetic
acccccccuccgacucaggg

SEQ ID NO: 26304 - RNA, 21 nt, Artificial Sequence
  Synthetic
cacccccccuccgacucaggg

SEQ ID NO: 26305 - RNA, 22 nt, Artificial Sequence
  Synthetic
gcacccccccuccgacucaggg

SEQ ID NO: 26306 - RNA, 23 nt, Artificial Sequence
  Synthetic
cgcacccccccuccgacucaggg

SEQ ID NO: 26307 - RNA, 24 nt, Artificial Sequence
  Synthetic
acgcacccccccuccgacucaggg

SEQ ID NO: 26308 - RNA, 18 nt, Artificial Sequence
  Synthetic
cgcgccccccgugacggg

SEQ ID NO: 26309 - RNA, 19 nt, Artificial Sequence
  Synthetic
ccgcgccccccgugacggg

SEQ ID NO: 26310 - RNA, 20 nt, Artificial Sequence
  Synthetic
gccgcgccccccgugacggg

SEQ ID NO: 26311 - RNA, 21 nt, Artificial Sequence
  Synthetic
cgccgcgccccccgugacggg

SEQ ID NO: 26312 - RNA, 22 nt, Artificial Sequence
  Synthetic
ccgccgcgccccccgugacggg

SEQ ID NO: 26313 - RNA, 23 nt, Artificial Sequence
  Synthetic
gccgccgcgccccccgugacggg

SEQ ID NO: 26314 - RNA, 24 nt, Artificial Sequence
  Synthetic
cgccgccgcgccccccgugacggg

SEQ ID NO: 26315 - RNA, 18 nt, Artificial Sequence
  Synthetic
agggggcgucgacccggg

SEQ ID NO: 26316 - RNA, 19 nt, Artificial Sequence
  Synthetic
cagggggcgucgacccggg

SEQ ID NO: 26317 - RNA, 20 nt, Artificial Sequence
  Synthetic
gcagggggcgucgacccggg

SEQ ID NO: 26318 - RNA, 21 nt, Artificial Sequence
  Synthetic
agcagggggcgucgacccggg

SEQ ID NO: 26319 - RNA, 22 nt, Artificial Sequence
  Synthetic
gagcagggggcgucgacccggg

SEQ ID NO: 26320 - RNA, 23 nt, Artificial Sequence
  Synthetic
ggagcagggggcgucgacccggg

SEQ ID NO: 26321 - RNA, 24 nt, Artificial Sequence
  Synthetic
gggagcagggggcgucgacccggg

SEQ ID NO: 26322 - RNA, 18 nt, Artificial Sequence
  Synthetic
cgcgccccggcccccggg

SEQ ID NO: 26323 - RNA, 19 nt, Artificial Sequence
  Synthetic
ccgcgccccggcccccggg

SEQ ID NO: 26324 - RNA, 20 nt, Artificial Sequence
  Synthetic
cccgcgccccggcccccggg

SEQ ID NO: 26325 - RNA, 21 nt, Artificial Sequence
  Synthetic
ccccgcgccccggcccccggg

SEQ ID NO: 26326 - RNA, 22 nt, Artificial Sequence
  Synthetic
cccccgcgccccggcccccggg

SEQ ID NO: 26327 - RNA, 23 nt, Artificial Sequence
  Synthetic
gcccccgcgccccggcccccggg

SEQ ID NO: 26328 - RNA, 24 nt, Artificial Sequence
  Synthetic
ggcccccgcgccccggcccccggg

SEQ ID NO: 26329 - RNA, 18 nt, Artificial Sequence
  Synthetic
ccgaggaagaggcgcggg

SEQ ID NO: 26330 - RNA, 19 nt, Artificial Sequence
  Synthetic
uccgaggaagaggcgcggg

SEQ ID NO: 26331 - RNA, 20 nt, Artificial Sequence
  Synthetic
guccgaggaagaggcgcggg

SEQ ID NO: 26332 - RNA, 21 nt, Artificial Sequence
  Synthetic
cguccgaggaagaggcgcggg

SEQ ID NO: 26333 - RNA, 22 nt, Artificial Sequence
  Synthetic
gcguccgaggaagaggcgcggg

SEQ ID NO: 26334 - RNA, 23 nt, Artificial Sequence
  Synthetic
ugcguccgaggaagaggcgcggg

SEQ ID NO: 26335 - RNA, 24 nt, Artificial Sequence
  Synthetic
gugcguccgaggaagaggcgcggg

SEQ ID NO: 26336 - RNA, 18 nt, Artificial Sequence
  Synthetic
cgcuuccgccuccucggg

SEQ ID NO: 26337 - RNA, 19 nt, Artificial Sequence
  Synthetic
ccgcuuccgccuccucggg

SEQ ID NO: 26338 - RNA, 20 nt, Artificial Sequence
  Synthetic
uccgcuuccgccuccucggg

SEQ ID NO: 26339 - RNA, 21 nt, Artificial Sequence
  Synthetic
cuccgcuuccgccuccucggg

SEQ ID NO: 26340 - RNA, 22 nt, Artificial Sequence
  Synthetic
ccuccgcuuccgccuccucggg

SEQ ID NO: 26341 - RNA, 23 nt, Artificial Sequence
  Synthetic
uccuccgcuuccgccuccucggg

SEQ ID NO: 26342 - RNA, 24 nt, Artificial Sequence
  Synthetic
cuccuccgcuuccgccuccucggg

SEQ ID NO: 26343 - RNA, 18 nt, Artificial Sequence
  Synthetic
ggcggggcggccgagggg

SEQ ID NO: 26344 - RNA, 19 nt, Artificial Sequence
  Synthetic
aggcggggcggccgagggg

SEQ ID NO: 26345 - RNA, 20 nt, Artificial Sequence
  Synthetic
gaggcggggcggccgagggg

SEQ ID NO: 26346 - RNA, 21 nt, Artificial Sequence
  Synthetic
ggaggcggggcggccgagggg

SEQ ID NO: 26347 - RNA, 22 nt, Artificial Sequence
  Synthetic
cggaggcggggcggccgagggg

SEQ ID NO: 26348 - RNA, 23 nt, Artificial Sequence
  Synthetic
gcggaggcggggcggccgagggg

SEQ ID NO: 26349 - RNA, 24 nt, Artificial Sequence
  Synthetic
agcggaggcggggcggccgagggg

SEQ ID NO: 26350 - RNA, 18 nt, Artificial Sequence
  Synthetic
gcgccccggcccccgggg

SEQ ID NO: 26351 - RNA, 19 nt, Artificial Sequence
  Synthetic
cgcgccccggcccccgggg

SEQ ID NO: 26352 - RNA, 20 nt, Artificial Sequence
  Synthetic
ccgcgccccggcccccgggg

SEQ ID NO: 26353 - RNA, 21 nt, Artificial Sequence
  Synthetic
cccgcgccccggcccccgggg

SEQ ID NO: 26354 - RNA, 22 nt, Artificial Sequence
  Synthetic
ccccgcgccccggcccccgggg

SEQ ID NO: 26355 - RNA, 23 nt, Artificial Sequence
  Synthetic
cccccgcgccccggcccccgggg

SEQ ID NO: 26356 - RNA, 24 nt, Artificial Sequence
  Synthetic
gcccccgcgccccggcccccgggg

SEQ ID NO: 26357 - RNA, 18 nt, Artificial Sequence
  Synthetic
gcuucugggccgcggggg

SEQ ID NO: 26358 - RNA, 19 nt, Artificial Sequence
  Synthetic
ugcuucugggccgcggggg

SEQ ID NO: 26359 - RNA, 20 nt, Artificial Sequence
  Synthetic
cugcuucugggccgcggggg

SEQ ID NO: 26360 - RNA, 21 nt, Artificial Sequence
  Synthetic
gcugcuucugggccgcggggg

SEQ ID NO: 26361 - RNA, 22 nt, Artificial Sequence
  Synthetic
cgcugcuucugggccgcggggg

SEQ ID NO: 26362 - RNA, 23 nt, Artificial Sequence
  Synthetic
gcgcugcuucugggccgcggggg

SEQ ID NO: 26363 - RNA, 24 nt, Artificial Sequence
  Synthetic
cgcgcugcuucugggccgcggggg

SEQ ID NO: 26364 - RNA, 18 nt, Artificial Sequence
  Synthetic
cuggccccuccggggggg

SEQ ID NO: 26365 - RNA, 19 nt, Artificial Sequence
  Synthetic
ucuggccccuccggggggg

SEQ ID NO: 26366 - RNA, 20 nt, Artificial Sequence
  Synthetic
gucuggccccuccggggggg

SEQ ID NO: 26367 - RNA, 21 nt, Artificial Sequence
  Synthetic
cgucuggccccuccggggggg

SEQ ID NO: 26368 - RNA, 22 nt, Artificial Sequence
  Synthetic
gcgucuggccccuccggggggg

SEQ ID NO: 26369 - RNA, 23 nt, Artificial Sequence
  Synthetic
ggcgucuggccccuccggggggg

SEQ ID NO: 26370 - RNA, 24 nt, Artificial Sequence
  Synthetic
gggcgucuggccccuccggggggg

SEQ ID NO: 26371 - RNA, 18 nt, Artificial Sequence
  Synthetic
gcgcgcggcucggggggg

SEQ ID NO: 26372 - RNA, 19 nt, Artificial Sequence
  Synthetic
ggcgcgcggcucggggggg

SEQ ID NO: 26373 - RNA, 20 nt, Artificial Sequence
  Synthetic
uggcgcgcggcucggggggg

SEQ ID NO: 26374 - RNA, 21 nt, Artificial Sequence
  Synthetic
guggcgcgcggcucggggggg

SEQ ID NO: 26375 - RNA, 22 nt, Artificial Sequence
  Synthetic
gguggcgcgcggcucggggggg

SEQ ID NO: 26376 - RNA, 23 nt, Artificial Sequence
  Synthetic
cgguggcgcgcggcucggggggg

SEQ ID NO: 26377 - RNA, 24 nt, Artificial Sequence
  Synthetic
acgguggcgcgcggcucggggggg

SEQ ID NO: 26378 - RNA, 18 nt, Artificial Sequence
  Synthetic
ccuccggggggguugggg

SEQ ID NO: 26379 - RNA, 19 nt, Artificial Sequence
  Synthetic
cccuccggggggguugggg

SEQ ID NO: 26380 - RNA, 20 nt, Artificial Sequence
  Synthetic
ccccuccggggggguugggg

SEQ ID NO: 26381 - RNA, 21 nt, Artificial Sequence
  Synthetic
gccccuccggggggguugggg

SEQ ID NO: 26382 - RNA, 22 nt, Artificial Sequence
  Synthetic
ggccccuccggggggguugggg

SEQ ID NO: 26383 - RNA, 23 nt, Artificial Sequence
  Synthetic
uggccccuccggggggguugggg

SEQ ID NO: 26384 - RNA, 24 nt, Artificial Sequence
  Synthetic
cuggccccuccggggggguugggg

SEQ ID NO: 26385 - RNA, 18 nt, Artificial Sequence
  Synthetic
gggggguugggguugggg

SEQ ID NO: 26386 - RNA, 19 nt, Artificial Sequence
  Synthetic
ggggggguugggguugggg

SEQ ID NO: 26387 - RNA, 20 nt, Artificial Sequence
  Synthetic
cggggggguugggguugggg

SEQ ID NO: 26388 - RNA, 21 nt, Artificial Sequence
  Synthetic
ccggggggguugggguugggg

SEQ ID NO: 26389 - RNA, 22 nt, Artificial Sequence
  Synthetic
uccggggggguugggguugggg

SEQ ID NO: 26390 - RNA, 23 nt, Artificial Sequence
  Synthetic
cuccggggggguugggguugggg

SEQ ID NO: 26391 - RNA, 24 nt, Artificial Sequence
  Synthetic
ccuccggggggguugggguugggg

SEQ ID NO: 26392 - RNA, 18 nt, Artificial Sequence
  Synthetic
ggccgucggugcccuggg

SEQ ID NO: 26393 - RNA, 19 nt, Artificial Sequence
  Synthetic
gggccgucggugcccuggg

SEQ ID NO: 26394 - RNA, 20 nt, Artificial Sequence
  Synthetic
ggggccgucggugcccuggg

SEQ ID NO: 26395 - RNA, 21 nt, Artificial Sequence
  Synthetic
cggggccgucggugcccuggg

SEQ ID NO: 26396 - RNA, 22 nt, Artificial Sequence
  Synthetic
gcggggccgucggugcccuggg

SEQ ID NO: 26397 - RNA, 23 nt, Artificial Sequence
  Synthetic
ggcggggccgucggugcccuggg

SEQ ID NO: 26398 - RNA, 24 nt, Artificial Sequence
  Synthetic
gggcggggccgucggugcccuggg

SEQ ID NO: 26399 - RNA, 18 nt, Artificial Sequence
  Synthetic
cgcgguaccugacccugg

SEQ ID NO: 26400 - RNA, 19 nt, Artificial Sequence
  Synthetic
ccgcgguaccugacccugg

SEQ ID NO: 26401 - RNA, 20 nt, Artificial Sequence
  Synthetic
cccgcgguaccugacccugg

SEQ ID NO: 26402 - RNA, 21 nt, Artificial Sequence
  Synthetic
ccccgcgguaccugacccugg

SEQ ID NO: 26403 - RNA, 22 nt, Artificial Sequence
  Synthetic
gccccgcgguaccugacccugg

SEQ ID NO: 26404 - RNA, 23 nt, Artificial Sequence
  Synthetic
cgccccgcgguaccugacccugg

SEQ ID NO: 26405 - RNA, 24 nt, Artificial Sequence
  Synthetic
ucgccccgcgguaccugacccugg

SEQ ID NO: 26406 - RNA, 18 nt, Artificial Sequence
  Synthetic
gggccgucggugcccugg

SEQ ID NO: 26407 - RNA, 19 nt, Artificial Sequence
  Synthetic
ggggccgucggugcccugg

SEQ ID NO: 26408 - RNA, 20 nt, Artificial Sequence
  Synthetic
cggggccgucggugcccugg

SEQ ID NO: 26409 - RNA, 21 nt, Artificial Sequence
  Synthetic
gcggggccgucggugcccugg

SEQ ID NO: 26410 - RNA, 22 nt, Artificial Sequence
  Synthetic
ggcggggccgucggugcccugg

SEQ ID NO: 26411 - RNA, 23 nt, Artificial Sequence
  Synthetic
gggcggggccgucggugcccugg

SEQ ID NO: 26412 - RNA, 24 nt, Artificial Sequence
  Synthetic
cgggcggggccgucggugcccugg

SEQ ID NO: 26413 - RNA, 18 nt, Artificial Sequence
  Synthetic
gccguggacuuuaucugg

SEQ ID NO: 26414 - RNA, 19 nt, Artificial Sequence
  Synthetic
ggccguggacuuuaucugg

SEQ ID NO: 26415 - RNA, 20 nt, Artificial Sequence
  Synthetic
cggccguggacuuuaucugg

SEQ ID NO: 26416 - RNA, 21 nt, Artificial Sequence
  Synthetic
acggccguggacuuuaucugg

SEQ ID NO: 26417 - RNA, 22 nt, Artificial Sequence
  Synthetic
cacggccguggacuuuaucugg

SEQ ID NO: 26418 - RNA, 23 nt, Artificial Sequence
  Synthetic
gcacggccguggacuuuaucugg

SEQ ID NO: 26419 - RNA, 24 nt, Artificial Sequence
  Synthetic
ggcacggccguggacuuuaucugg

SEQ ID NO: 26420 - RNA, 18 nt, Artificial Sequence
  Synthetic
ccgcgguaccugacccug

SEQ ID NO: 26421 - RNA, 19 nt, Artificial Sequence
  Synthetic
cccgcgguaccugacccug

SEQ ID NO: 26422 - RNA, 20 nt, Artificial Sequence
  Synthetic
ccccgcgguaccugacccug

SEQ ID NO: 26423 - RNA, 21 nt, Artificial Sequence
  Synthetic
gccccgcgguaccugacccug

SEQ ID NO: 26424 - RNA, 22 nt, Artificial Sequence
  Synthetic
cgccccgcgguaccugacccug

SEQ ID NO: 26425 - RNA, 23 nt, Artificial Sequence
  Synthetic
ucgccccgcgguaccugacccug

SEQ ID NO: 26426 - RNA, 24 nt, Artificial Sequence
  Synthetic
uucgccccgcgguaccugacccug

SEQ ID NO: 26427 - RNA, 18 nt, Artificial Sequence
  Synthetic
ggggcguacgugguccug

SEQ ID NO: 26428 - RNA, 19 nt, Artificial Sequence
  Synthetic
cggggcguacgugguccug

SEQ ID NO: 26429 - RNA, 20 nt, Artificial Sequence
  Synthetic
ucggggcguacgugguccug

SEQ ID NO: 26430 - RNA, 21 nt, Artificial Sequence
  Synthetic
aucggggcguacgugguccug

SEQ ID NO: 26431 - RNA, 22 nt, Artificial Sequence
  Synthetic
caucggggcguacgugguccug

SEQ ID NO: 26432 - RNA, 23 nt, Artificial Sequence
  Synthetic
acaucggggcguacgugguccug

SEQ ID NO: 26433 - RNA, 24 nt, Artificial Sequence
  Synthetic
aacaucggggcguacgugguccug

SEQ ID NO: 26434 - RNA, 18 nt, Artificial Sequence
  Synthetic
uccccuccgccgccucug

SEQ ID NO: 26435 - RNA, 19 nt, Artificial Sequence
  Synthetic
cuccccuccgccgccucug

SEQ ID NO: 26436 - RNA, 20 nt, Artificial Sequence
  Synthetic
gcuccccuccgccgccucug

SEQ ID NO: 26437 - RNA, 21 nt, Artificial Sequence
  Synthetic
cgcuccccuccgccgccucug

SEQ ID NO: 26438 - RNA, 22 nt, Artificial Sequence
  Synthetic
ccgcuccccuccgccgccucug

SEQ ID NO: 26439 - RNA, 23 nt, Artificial Sequence
  Synthetic
cccgcuccccuccgccgccucug

SEQ ID NO: 26440 - RNA, 24 nt, Artificial Sequence
  Synthetic
ccccgcuccccuccgccgccucug

SEQ ID NO: 26441 - RNA, 18 nt, Artificial Sequence
  Synthetic
cucuggaugacccccgug

SEQ ID NO: 26442 - RNA, 19 nt, Artificial Sequence
  Synthetic
ccucuggaugacccccgug

SEQ ID NO: 26443 - RNA, 20 nt, Artificial Sequence
  Synthetic
gccucuggaugacccccgug

SEQ ID NO: 26444 - RNA, 21 nt, Artificial Sequence
  Synthetic
agccucuggaugacccccgug

SEQ ID NO: 26445 - RNA, 22 nt, Artificial Sequence
  Synthetic
cagccucuggaugacccccgug

SEQ ID NO: 26446 - RNA, 23 nt, Artificial Sequence
  Synthetic
acagccucuggaugacccccgug

SEQ ID NO: 26447 - RNA, 24 nt, Artificial Sequence
  Synthetic
aacagccucuggaugacccccgug

SEQ ID NO: 26448 - RNA, 18 nt, Artificial Sequence
  Synthetic
gccgccgcgccccccgug

SEQ ID NO: 26449 - RNA, 19 nt, Artificial Sequence
  Synthetic
cgccgccgcgccccccgug

SEQ ID NO: 26450 - RNA, 20 nt, Artificial Sequence
  Synthetic
gcgccgccgcgccccccgug

SEQ ID NO: 26451 - RNA, 21 nt, Artificial Sequence
  Synthetic
ggcgccgccgcgccccccgug

SEQ ID NO: 26452 - RNA, 22 nt, Artificial Sequence
  Synthetic
aggcgccgccgcgccccccgug

SEQ ID NO: 26453 - RNA, 23 nt, Artificial Sequence
  Synthetic
gaggcgccgccgcgccccccgug

SEQ ID NO: 26454 - RNA, 24 nt, Artificial Sequence
  Synthetic
agaggcgccgccgcgccccccgug

SEQ ID NO: 26455 - RNA, 18 nt, Artificial Sequence
  Synthetic
ccaagaacagagucugug

SEQ ID NO: 26456 - RNA, 19 nt, Artificial Sequence
  Synthetic
accaagaacagagucugug

SEQ ID NO: 26457 - RNA, 20 nt, Artificial Sequence
  Synthetic
aaccaagaacagagucugug

SEQ ID NO: 26458 - RNA, 21 nt, Artificial Sequence
  Synthetic
gaaccaagaacagagucugug

SEQ ID NO: 26459 - RNA, 22 nt, Artificial Sequence
  Synthetic
cgaaccaagaacagagucugug

SEQ ID NO: 26460 - RNA, 23 nt, Artificial Sequence
  Synthetic
gcgaaccaagaacagagucugug

SEQ ID NO: 26461 - RNA, 24 nt, Artificial Sequence
  Synthetic
cgcgaaccaagaacagagucugug

SEQ ID NO: 26462 - RNA, 18 nt, Artificial Sequence
  Synthetic
ggguugggguugggguug

SEQ ID NO: 26463 - RNA, 19 nt, Artificial Sequence
  Synthetic
gggguugggguugggguug

SEQ ID NO: 26464 - RNA, 20 nt, Artificial Sequence
  Synthetic
ugggguugggguugggguug

SEQ ID NO: 26465 - RNA, 21 nt, Artificial Sequence
  Synthetic
uugggguugggguugggguug

SEQ ID NO: 26466 - RNA, 22 nt, Artificial Sequence
  Synthetic
guugggguugggguugggguug

SEQ ID NO: 26467 - RNA, 23 nt, Artificial Sequence
  Synthetic
gguugggguugggguugggguug

SEQ ID NO: 26468 - RNA, 24 nt, Artificial Sequence
  Synthetic
ggguugggguugggguugggguug

SEQ ID NO: 26469 - RNA, 18 nt, Artificial Sequence
  Synthetic
cauggagacggggaacau

SEQ ID NO: 26470 - RNA, 19 nt, Artificial Sequence
  Synthetic
acauggagacggggaacau

SEQ ID NO: 26471 - RNA, 20 nt, Artificial Sequence
  Synthetic
gacauggagacggggaacau

SEQ ID NO: 26472 - RNA, 21 nt, Artificial Sequence
  Synthetic
ggacauggagacggggaacau

SEQ ID NO: 26473 - RNA, 22 nt, Artificial Sequence
  Synthetic
uggacauggagacggggaacau

SEQ ID NO: 26474 - RNA, 23 nt, Artificial Sequence
  Synthetic
cuggacauggagacggggaacau

SEQ ID NO: 26475 - RNA, 24 nt, Artificial Sequence
  Synthetic
ccuggacauggagacggggaacau

SEQ ID NO: 26476 - RNA, 18 nt, Artificial Sequence
  Synthetic
cacggccguggacuuuau

SEQ ID NO: 26477 - RNA, 19 nt, Artificial Sequence
  Synthetic
gcacggccguggacuuuau

SEQ ID NO: 26478 - RNA, 20 nt, Artificial Sequence
  Synthetic
ggcacggccguggacuuuau

SEQ ID NO: 26479 - RNA, 21 nt, Artificial Sequence
  Synthetic
gggcacggccguggacuuuau

SEQ ID NO: 26480 - RNA, 22 nt, Artificial Sequence
  Synthetic
cgggcacggccguggacuuuau

SEQ ID NO: 26481 - RNA, 23 nt, Artificial Sequence
  Synthetic
gcgggcacggccguggacuuuau

SEQ ID NO: 26482 - RNA, 24 nt, Artificial Sequence
  Synthetic
ggcgggcacggccguggacuuuau

SEQ ID NO: 26483 - RNA, 18 nt, Artificial Sequence
  Synthetic
cgcacccccccuccgacu

SEQ ID NO: 26484 - RNA, 19 nt, Artificial Sequence
  Synthetic
acgcacccccccuccgacu

SEQ ID NO: 26485 - RNA, 20 nt, Artificial Sequence
  Synthetic
gacgcacccccccuccgacu

SEQ ID NO: 26486 - RNA, 21 nt, Artificial Sequence
  Synthetic
cgacgcacccccccuccgacu

SEQ ID NO: 26487 - RNA, 22 nt, Artificial Sequence
  Synthetic
gcgacgcacccccccuccgacu

SEQ ID NO: 26488 - RNA, 23 nt, Artificial Sequence
  Synthetic
ggcgacgcacccccccuccgacu

SEQ ID NO: 26489 - RNA, 24 nt, Artificial Sequence
  Synthetic
cggcgacgcacccccccuccgacu

SEQ ID NO: 26490 - RNA, 18 nt, Artificial Sequence
  Synthetic
cccgcgguaccugacccu

SEQ ID NO: 26491 - RNA, 19 nt, Artificial Sequence
  Synthetic
ccccgcgguaccugacccu

SEQ ID NO: 26492 - RNA, 20 nt, Artificial Sequence
  Synthetic
gccccgcgguaccugacccu

SEQ ID NO: 26493 - RNA, 21 nt, Artificial Sequence
  Synthetic
cgccccgcgguaccugacccu

SEQ ID NO: 26494 - RNA, 22 nt, Artificial Sequence
  Synthetic
ucgccccgcgguaccugacccu

SEQ ID NO: 26495 - RNA, 23 nt, Artificial Sequence
  Synthetic
uucgccccgcgguaccugacccu

SEQ ID NO: 26496 - RNA, 24 nt, Artificial Sequence
  Synthetic
guucgccccgcgguaccugacccu

SEQ ID NO: 26497 - RNA, 18 nt, Artificial Sequence
  Synthetic
ggggggcgucuggccccu

SEQ ID NO: 26498 - RNA, 19 nt, Artificial Sequence
  Synthetic
cggggggcgucuggccccu

SEQ ID NO: 26499 - RNA, 20 nt, Artificial Sequence
  Synthetic
gcggggggcgucuggccccu

SEQ ID NO: 26500 - RNA, 21 nt, Artificial Sequence
  Synthetic
cgcggggggcgucuggccccu

SEQ ID NO: 26501 - RNA, 22 nt, Artificial Sequence
  Synthetic
ccgcggggggcgucuggccccu

SEQ ID NO: 26502 - RNA, 23 nt, Artificial Sequence
  Synthetic
gccgcggggggcgucuggccccu

SEQ ID NO: 26503 - RNA, 24 nt, Artificial Sequence
  Synthetic
cgccgcggggggcgucuggccccu

SEQ ID NO: 26504 - RNA, 18 nt, Artificial Sequence
  Synthetic
cggggccgucggugcccu

SEQ ID NO: 26505 - RNA, 19 nt, Artificial Sequence
  Synthetic
gcggggccgucggugcccu

SEQ ID NO: 26506 - RNA, 20 nt, Artificial Sequence
  Synthetic
ggcggggccgucggugcccu

SEQ ID NO: 26507 - RNA, 21 nt, Artificial Sequence
  Synthetic
gggcggggccgucggugcccu

SEQ ID NO: 26508 - RNA, 22 nt, Artificial Sequence
  Synthetic
cgggcggggccgucggugcccu

SEQ ID NO: 26509 - RNA, 23 nt, Artificial Sequence
  Synthetic
ucgggcggggccgucggugcccu

SEQ ID NO: 26510 - RNA, 24 nt, Artificial Sequence
  Synthetic
cucgggcggggccgucggugcccu

SEQ ID NO: 26511 - RNA, 18 nt, Artificial Sequence
  Synthetic
ugcgugcgagcgccgccu

SEQ ID NO: 26512 - RNA, 19 nt, Artificial Sequence
  Synthetic
gugcgugcgagcgccgccu

SEQ ID NO: 26513 - RNA, 20 nt, Artificial Sequence
  Synthetic
cgugcgugcgagcgccgccu

SEQ ID NO: 26514 - RNA, 21 nt, Artificial Sequence
  Synthetic
ccgugcgugcgagcgccgccu

SEQ ID NO: 26515 - RNA, 22 nt, Artificial Sequence
  Synthetic
cccgugcgugcgagcgccgccu

SEQ ID NO: 26516 - RNA, 23 nt, Artificial Sequence
  Synthetic
ccccgugcgugcgagcgccgccu

SEQ ID NO: 26517 - RNA, 24 nt, Artificial Sequence
  Synthetic
gccccgugcgugcgagcgccgccu

SEQ ID NO: 26518 - RNA, 18 nt, Artificial Sequence
  Synthetic
aaacauggcgacccggcu

SEQ ID NO: 26519 - RNA, 19 nt, Artificial Sequence
  Synthetic
gaaacauggcgacccggcu

SEQ ID NO: 26520 - RNA, 20 nt, Artificial Sequence
  Synthetic
ggaaacauggcgacccggcu

SEQ ID NO: 26521 - RNA, 21 nt, Artificial Sequence
  Synthetic
gggaaacauggcgacccggcu

SEQ ID NO: 26522 - RNA, 22 nt, Artificial Sequence
  Synthetic
cgggaaacauggcgacccggcu

SEQ ID NO: 26523 - RNA, 23 nt, Artificial Sequence
  Synthetic
acgggaaacauggcgacccggcu

SEQ ID NO: 26524 - RNA, 24 nt, Artificial Sequence
  Synthetic
gacgggaaacauggcgacccggcu

SEQ ID NO: 26525 - RNA, 18 nt, Artificial Sequence
  Synthetic
cgacgguggcgcgcggcu

SEQ ID NO: 26526 - RNA, 19 nt, Artificial Sequence
  Synthetic
gcgacgguggcgcgcggcu

SEQ ID NO: 26527 - RNA, 20 nt, Artificial Sequence
  Synthetic
ugcgacgguggcgcgcggcu

SEQ ID NO: 26528 - RNA, 21 nt, Artificial Sequence
  Synthetic
gugcgacgguggcgcgcggcu

SEQ ID NO: 26529 - RNA, 22 nt, Artificial Sequence
  Synthetic
cgugcgacgguggcgcgcggcu

SEQ ID NO: 26530 - RNA, 23 nt, Artificial Sequence
  Synthetic
gcgugcgacgguggcgcgcggcu

SEQ ID NO: 26531 - RNA, 24 nt, Artificial Sequence
  Synthetic
cgcgugcgacgguggcgcgcggcu

SEQ ID NO: 26532 - RNA, 18 nt, Artificial Sequence
  Synthetic
cgcgcuaccugcccaucu

SEQ ID NO: 26533 - RNA, 19 nt, Artificial Sequence
  Synthetic
acgcgcuaccugcccaucu

SEQ ID NO: 26534 - RNA, 20 nt, Artificial Sequence
  Synthetic
cacgcgcuaccugcccaucu

SEQ ID NO: 26535 - RNA, 21 nt, Artificial Sequence
  Synthetic
ucacgcgcuaccugcccaucu

SEQ ID NO: 26536 - RNA, 22 nt, Artificial Sequence
  Synthetic
cucacgcgcuaccugcccaucu

SEQ ID NO: 26537 - RNA, 23 nt, Artificial Sequence
  Synthetic
ccucacgcgcuaccugcccaucu

SEQ ID NO: 26538 - RNA, 24 nt, Artificial Sequence
  Synthetic
gccucacgcgcuaccugcccaucu

SEQ ID NO: 26539 - RNA, 18 nt, Artificial Sequence
  Synthetic
ccucuggaugacccccgu

SEQ ID NO: 26540 - RNA, 19 nt, Artificial Sequence
  Synthetic
gccucuggaugacccccgu

SEQ ID NO: 26541 - RNA, 20 nt, Artificial Sequence
  Synthetic
agccucuggaugacccccgu

SEQ ID NO: 26542 - RNA, 21 nt, Artificial Sequence
  Synthetic
cagccucuggaugacccccgu

SEQ ID NO: 26543 - RNA, 22 nt, Artificial Sequence
  Synthetic
acagccucuggaugacccccgu

SEQ ID NO: 26544 - RNA, 23 nt, Artificial Sequence
  Synthetic
aacagccucuggaugacccccgu

SEQ ID NO: 26545 - RNA, 24 nt, Artificial Sequence
  Synthetic
gaacagccucuggaugacccccgu

SEQ ID NO: 26546 - RNA, 18 nt, Artificial Sequence
  Synthetic
ggaggccgaggaggccgu

SEQ ID NO: 26547 - RNA, 19 nt, Artificial Sequence
  Synthetic
uggaggccgaggaggccgu

SEQ ID NO: 26548 - RNA, 20 nt, Artificial Sequence
  Synthetic
auggaggccgaggaggccgu

SEQ ID NO: 26549 - RNA, 21 nt, Artificial Sequence
  Synthetic
cauggaggccgaggaggccgu

SEQ ID NO: 26550 - RNA, 22 nt, Artificial Sequence
  Synthetic
gcauggaggccgaggaggccgu

SEQ ID NO: 26551 - RNA, 23 nt, Artificial Sequence
  Synthetic
cgcauggaggccgaggaggccgu

SEQ ID NO: 26552 - RNA, 24 nt, Artificial Sequence
  Synthetic
ccgcauggaggccgaggaggccgu

SEQ ID NO: 26553 - RNA, 18 nt, Artificial Sequence
  Synthetic
ccgcguccgcggccgcgu

SEQ ID NO: 26554 - RNA, 19 nt, Artificial Sequence
  Synthetic
cccgcguccgcggccgcgu

SEQ ID NO: 26555 - RNA, 20 nt, Artificial Sequence
  Synthetic
ccccgcguccgcggccgcgu

SEQ ID NO: 26556 - RNA, 21 nt, Artificial Sequence
  Synthetic
cccccgcguccgcggccgcgu

SEQ ID NO: 26557 - RNA, 22 nt, Artificial Sequence
  Synthetic
ccccccgcguccgcggccgcgu

SEQ ID NO: 26558 - RNA, 23 nt, Artificial Sequence
  Synthetic
gccccccgcguccgcggccgcgu

SEQ ID NO: 26559 - RNA, 24 nt, Artificial Sequence
  Synthetic
ggccccccgcguccgcggccgcgu

SEQ ID NO: 26560 - RNA, 18 nt, Artificial Sequence
  Synthetic
ggccguggccccgugcgu

SEQ ID NO: 26561 - RNA, 19 nt, Artificial Sequence
  Synthetic
cggccguggccccgugcgu

SEQ ID NO: 26562 - RNA, 20 nt, Artificial Sequence
  Synthetic
gcggccguggccccgugcgu

SEQ ID NO: 26563 - RNA, 21 nt, Artificial Sequence
  Synthetic
cgcggccguggccccgugcgu

SEQ ID NO: 26564 - RNA, 22 nt, Artificial Sequence
  Synthetic
gcgcggccguggccccgugcgu

SEQ ID NO: 26565 - RNA, 23 nt, Artificial Sequence
  Synthetic
cgcgcggccguggccccgugcgu

SEQ ID NO: 26566 - RNA, 24 nt, Artificial Sequence
  Synthetic
ccgcgcggccguggccccgugcgu

SEQ ID NO: 26567 - RNA, 18 nt, Artificial Sequence
  Synthetic
caggaggcggcggugcgu

SEQ ID NO: 26568 - RNA, 19 nt, Artificial Sequence
  Synthetic
gcaggaggcggcggugcgu

SEQ ID NO: 26569 - RNA, 20 nt, Artificial Sequence
  Synthetic
agcaggaggcggcggugcgu

SEQ ID NO: 26570 - RNA, 21 nt, Artificial Sequence
  Synthetic
gagcaggaggcggcggugcgu

SEQ ID NO: 26571 - RNA, 22 nt, Artificial Sequence
  Synthetic
cgagcaggaggcggcggugcgu

SEQ ID NO: 26572 - RNA, 23 nt, Artificial Sequence
  Synthetic
ucgagcaggaggcggcggugcgu

SEQ ID NO: 26573 - RNA, 24 nt, Artificial Sequence
  Synthetic
gucgagcaggaggcggcggugcgu

SEQ ID NO: 26574 - RNA, 18 nt, Artificial Sequence
  Synthetic
ccugggggggcacacggu

SEQ ID NO: 26575 - RNA, 19 nt, Artificial Sequence
  Synthetic
cccugggggggcacacggu

SEQ ID NO: 26576 - RNA, 20 nt, Artificial Sequence
  Synthetic
acccugggggggcacacggu

SEQ ID NO: 26577 - RNA, 21 nt, Artificial Sequence
  Synthetic
gacccugggggggcacacggu

SEQ ID NO: 26578 - RNA, 22 nt, Artificial Sequence
  Synthetic
ugacccugggggggcacacggu

SEQ ID NO: 26579 - RNA, 23 nt, Artificial Sequence
  Synthetic
cugacccugggggggcacacggu

SEQ ID NO: 26580 - RNA, 24 nt, Artificial Sequence
  Synthetic
ccugacccugggggggcacacggu

SEQ ID NO: 26581 - RNA, 18 nt, Artificial Sequence
  Synthetic
ggucucggcacccguggu

SEQ ID NO: 26582 - RNA, 19 nt, Artificial Sequence
  Synthetic
cggucucggcacccguggu

SEQ ID NO: 26583 - RNA, 20 nt, Artificial Sequence
  Synthetic
gcggucucggcacccguggu

SEQ ID NO: 26584 - RNA, 21 nt, Artificial Sequence
  Synthetic
ugcggucucggcacccguggu

SEQ ID NO: 26585 - RNA, 22 nt, Artificial Sequence
  Synthetic
cugcggucucggcacccguggu

SEQ ID NO: 26586 - RNA, 23 nt, Artificial Sequence
  Synthetic
ccugcggucucggcacccguggu

SEQ ID NO: 26587 - RNA, 24 nt, Artificial Sequence
  Synthetic
gccugcggucucggcacccguggu

SEQ ID NO: 26588 - RNA, 18 nt, Artificial Sequence
  Synthetic
cgcgccacgcggagacuu

SEQ ID NO: 26589 - RNA, 19 nt, Artificial Sequence
  Synthetic
acgcgccacgcggagacuu

SEQ ID NO: 26590 - RNA, 20 nt, Artificial Sequence
  Synthetic
gacgcgccacgcggagacuu

SEQ ID NO: 26591 - RNA, 21 nt, Artificial Sequence
  Synthetic
agacgcgccacgcggagacuu

SEQ ID NO: 26592 - RNA, 22 nt, Artificial Sequence
  Synthetic
aagacgcgccacgcggagacuu

SEQ ID NO: 26593 - RNA, 23 nt, Artificial Sequence
  Synthetic
gaagacgcgccacgcggagacuu

SEQ ID NO: 26594 - RNA, 24 nt, Artificial Sequence
  Synthetic
ggaagacgcgccacgcggagacuu

SEQ ID NO: 26595 - RNA, 18 nt, Artificial Sequence
  Synthetic
ucggcccccgcgcugcuu

SEQ ID NO: 26596 - RNA, 19 nt, Artificial Sequence
  Synthetic
cucggcccccgcgcugcuu

SEQ ID NO: 26597 - RNA, 20 nt, Artificial Sequence
  Synthetic
ccucggcccccgcgcugcuu

SEQ ID NO: 26598 - RNA, 21 nt, Artificial Sequence
  Synthetic
cccucggcccccgcgcugcuu

SEQ ID NO: 26599 - RNA, 22 nt, Artificial Sequence
  Synthetic
ucccucggcccccgcgcugcuu

SEQ ID NO: 26600 - RNA, 23 nt, Artificial Sequence
  Synthetic
cucccucggcccccgcgcugcuu

SEQ ID NO: 26601 - RNA, 24 nt, Artificial Sequence
  Synthetic
ccucccucggcccccgcgcugcuu

SEQ ID NO: 26602 - RNA, 20 nt, Artificial Sequence
  Synthetic
gcgacaccuucccgugcaug

SEQ ID NO: 26603 - RNA, 17 nt, Artificial Sequence
  Synthetic
acaccuucccgugcaug

SEQ ID NO: 26604 - RNA, 17 nt, Artificial Sequence
  Synthetic
cgcccacuaucagguac

SEQ ID NO: 26605 - RNA, 17 nt, Artificial Sequence
  Synthetic
gguaccgcggggcgaac

SEQ ID NO: 26606 - RNA, 17 nt, Artificial Sequence
  Synthetic
ccccucggccgccccgc

SEQ ID NO: 26607 - RNA, 17 nt, Artificial Sequence
  Synthetic
gccggggccgcguccuc

SEQ ID NO: 26608 - RNA, 17 nt, Artificial Sequence
  Synthetic
accucccucggcccccg

SEQ ID NO: 26609 - RNA, 20 nt, Artificial Sequence
  Synthetic
ucagguaccgcggggcgaac

SEQ ID NO: 26610 - RNA, 20 nt, Artificial Sequence
  Synthetic
cggccccucggccgccccgc

SEQ ID NO: 26611 - RNA, 20 nt, Artificial Sequence
  Synthetic
gccgccggggccgcguccuc

SEQ ID NO: 26612 - RNA, 20 nt, Artificial Sequence
  Synthetic
gaaaccucccucggcccccg

SEQ ID NO: 26613 - RNA, 17 nt, Artificial Sequence
  Synthetic
ggacacguguugcgcaa

SEQ ID NO: 26614 - RNA, 17 nt, Artificial Sequence
  Synthetic
gaucucguccgugcaca

SEQ ID NO: 26615 - RNA, 17 nt, Artificial Sequence
  Synthetic
gucguugagcauccccc

SEQ ID NO: 26616 - RNA, 17 nt, Artificial Sequence
  Synthetic
ggcccggcacgagcucc

SEQ ID NO: 26617 - RNA, 17 nt, Artificial Sequence
  Synthetic
gaucccugcgcgucggc

SEQ ID NO: 26618 - RNA, 17 nt, Artificial Sequence
  Synthetic
gggagcucgugccgggc

SEQ ID NO: 26619 - RNA, 17 nt, Artificial Sequence
  Synthetic
gcaucccccaggcgugc

SEQ ID NO: 26620 - RNA, 17 nt, Artificial Sequence
  Synthetic
gcguggccgcguccauc

SEQ ID NO: 26621 - RNA, 17 nt, Artificial Sequence
  Synthetic
ggcgggccugauggacg

SEQ ID NO: 26622 - RNA, 17 nt, Artificial Sequence
  Synthetic
gagcucgugccgggccg

SEQ ID NO: 26623 - RNA, 17 nt, Artificial Sequence
  Synthetic
ggaucccugcgcgucgg

SEQ ID NO: 26624 - RNA, 17 nt, Artificial Sequence
  Synthetic
gacgcgcagggauccug

SEQ ID NO: 26625 - RNA, 20 nt, Artificial Sequence
  Synthetic
ggcgaucucguccgugcaca

SEQ ID NO: 26626 - RNA, 20 nt, Artificial Sequence
  Synthetic
gaauccaggucuucaugcac

SEQ ID NO: 26627 - RNA, 20 nt, Artificial Sequence
  Synthetic
gcaucccgugcaugaagacc

SEQ ID NO: 26628 - RNA, 20 nt, Artificial Sequence
  Synthetic
gauggacgcggccacgcccc

SEQ ID NO: 26629 - RNA, 20 nt, Artificial Sequence
  Synthetic
guccgcccgggagcucgugc

SEQ ID NO: 26630 - RNA, 20 nt, Artificial Sequence
  Synthetic
gucugccgcggcggccgcuc

SEQ ID NO: 26631 - RNA, 20 nt, Artificial Sequence
  Synthetic
gggcggaccccggccccgag

SEQ ID NO: 26632 - RNA, 20 nt, Artificial Sequence
  Synthetic
gcugcccuggcgcucggccg

SEQ ID NO: 26633 - RNA, 20 nt, Artificial Sequence
  Synthetic
gugccgggggucugccgcgg

SEQ ID NO: 26634 - RNA, 20 nt, Artificial Sequence
  Synthetic
gcucgccagcagcgacucgg

SEQ ID NO: 26635 - RNA, 20 nt, Artificial Sequence
  Synthetic
guccgugcugcccgccucgg

SEQ ID NO: 26636 - RNA, 20 nt, Artificial Sequence
  Synthetic
gacgcgcagggauccugugg

SEQ ID NO: 26637 - RNA, 20 nt, Artificial Sequence
  Synthetic
gccgacgcgcagggauccug

SEQ ID NO: 26638 - RNA, 20 nt, Artificial Sequence
  Synthetic
gucgucagagauucccaccu

SEQ ID NO: 26639 - RNA, 17 nt, Artificial Sequence
  Synthetic
acgcccgccgacgcgca

SEQ ID NO: 26640 - RNA, 17 nt, Artificial Sequence
  Synthetic
ccgccgcggcagacccc

SEQ ID NO: 26641 - RNA, 17 nt, Artificial Sequence
  Synthetic
cacgcccgccgacgcgc

SEQ ID NO: 26642 - RNA, 17 nt, Artificial Sequence
  Synthetic
acggagauguucgaggc

SEQ ID NO: 26643 - RNA, 17 nt, Artificial Sequence
  Synthetic
cgacuccaccuccgagg

SEQ ID NO: 26644 - RNA, 17 nt, Artificial Sequence
  Synthetic
cacggagauguucgagg

SEQ ID NO: 26645 - RNA, 17 nt, Artificial Sequence
  Synthetic
cgugcugcccgccucgg

SEQ ID NO: 26646 - RNA, 17 nt, Artificial Sequence
  Synthetic
cgcgcagggauccugug

SEQ ID NO: 26647 - RNA, 17 nt, Artificial Sequence
  Synthetic
acaggaucccugcgcgu

SEQ ID NO: 26648 - RNA, 17 nt, Artificial Sequence
  Synthetic
acgcgcagggauccugu

SEQ ID NO: 26649 - RNA, 20 nt, Artificial Sequence
  Synthetic
aggggacacguguugcgcaa

SEQ ID NO: 26650 - RNA, 20 nt, Artificial Sequence
  Synthetic
cgacgugugugccgugugca

SEQ ID NO: 26651 - RNA, 20 nt, Artificial Sequence
  Synthetic
cuucaugcacgggaugcaga

SEQ ID NO: 26652 - RNA, 20 nt, Artificial Sequence
  Synthetic
caugucguugagcauccccc

SEQ ID NO: 26653 - RNA, 20 nt, Artificial Sequence
  Synthetic
cucggggccgggguccgccc

SEQ ID NO: 26654 - RNA, 20 nt, Artificial Sequence
  Synthetic
ccggcccggcacgagcuccc

SEQ ID NO: 26655 - RNA, 20 nt, Artificial Sequence
  Synthetic
cgcgacuccaccuccgaggc

SEQ ID NO: 26656 - RNA, 20 nt, Artificial Sequence
  Synthetic
caggaucccugcgcgucggc

SEQ ID NO: 26657 - RNA, 20 nt, Artificial Sequence
  Synthetic
cccgggagcucgugccgggc

SEQ ID NO: 26658 - RNA, 20 nt, Artificial Sequence
  Synthetic
aacucuggcagcgcaggggc

SEQ ID NO: 26659 - RNA, 20 nt, Artificial Sequence
  Synthetic
ugagcaucccccaggcgugc

SEQ ID NO: 26660 - RNA, 20 nt, Artificial Sequence
  Synthetic
ucaugcacgggaugcagaag

SEQ ID NO: 26661 - RNA, 20 nt, Artificial Sequence
  Synthetic
cgggagcucgugccgggccg

SEQ ID NO: 26662 - RNA, 20 nt, Artificial Sequence
  Synthetic
acucuggcagcgcaggggcg

SEQ ID NO: 26663 - RNA, 20 nt, Artificial Sequence
  Synthetic
ccgccucggagguggagucg

SEQ ID NO: 26664 - RNA, 20 nt, Artificial Sequence
  Synthetic
cacggacacggagauguucg

SEQ ID NO: 26665 - RNA, 20 nt, Artificial Sequence
  Synthetic
ccgcgacuccaccuccgagg

SEQ ID NO: 26666 - RNA, 20 nt, Artificial Sequence
  Synthetic
cgccagcagcgacucggagg

SEQ ID NO: 26667 - RNA, 20 nt, Artificial Sequence
  Synthetic
caucccccaggcgugcgggg

SEQ ID NO: 26668 - RNA, 20 nt, Artificial Sequence
  Synthetic
cgacgcgcagggauccugug

SEQ ID NO: 26669 - RNA, 20 nt, Artificial Sequence
  Synthetic
cccacaggaucccugcgcgu

SEQ ID NO: 26670 - RNA, 20 nt, Artificial Sequence
  Synthetic
ccgacgcgcagggauccugu

SEQ ID NO: 26671 - RNA, 17 nt, Artificial Sequence
  Synthetic
ggcgggcagcacggaca

SEQ ID NO: 26672 - RNA, 17 nt, Artificial Sequence
  Synthetic
guucgaggcgggccuga

SEQ ID NO: 26673 - RNA, 17 nt, Artificial Sequence
  Synthetic
gcuuccuccucacccac

SEQ ID NO: 26674 - RNA, 17 nt, Artificial Sequence
  Synthetic
ggacgcggccacgcccc

SEQ ID NO: 26675 - RNA, 17 nt, Artificial Sequence
  Synthetic
gcccccggcccggcccc

SEQ ID NO: 26676 - RNA, 17 nt, Artificial Sequence
  Synthetic
ggggccgggguccgccc

SEQ ID NO: 26677 - RNA, 17 nt, Artificial Sequence
  Synthetic
gcccggcacgagcuccc

SEQ ID NO: 26678 - RNA, 17 nt, Artificial Sequence
  Synthetic
gcccccggccgagcgcc

SEQ ID NO: 26679 - RNA, 17 nt, Artificial Sequence
  Synthetic
ggagcucgugccgggcc

SEQ ID NO: 26680 - RNA, 17 nt, Artificial Sequence
  Synthetic
ggcggccgcucggggcc

SEQ ID NO: 26681 - RNA, 17 nt, Artificial Sequence
  Synthetic
gcgcucggccgggggcc

SEQ ID NO: 26682 - RNA, 17 nt, Artificial Sequence
  Synthetic
gcccgggagcucgugcc

SEQ ID NO: 26683 - RNA, 17 nt, Artificial Sequence
  Synthetic
guugcgcaacggaaucc

SEQ ID NO: 26684 - RNA, 17 nt, Artificial Sequence
  Synthetic
gaggaggaagcggaagc

SEQ ID NO: 26685 - RNA, 17 nt, Artificial Sequence
  Synthetic
gaaaacucuggcagcgc

SEQ ID NO: 26686 - RNA, 17 nt, Artificial Sequence
  Synthetic
gcagaaggggugcaggc

SEQ ID NO: 26687 - RNA, 17 nt, Artificial Sequence
  Synthetic
gacuccaccuccgaggc

SEQ ID NO: 26688 - RNA, 17 nt, Artificial Sequence
  Synthetic
ggcgcucggccgggggc

SEQ ID NO: 26689 - RNA, 17 nt, Artificial Sequence
  Synthetic
ggaugcagaaggggugc

SEQ ID NO: 26690 - RNA, 17 nt, Artificial Sequence
  Synthetic
gcaggcagggaaaacuc

SEQ ID NO: 26691 - RNA, 17 nt, Artificial Sequence
  Synthetic
ggaagcggaagcgggag

SEQ ID NO: 26692 - RNA, 17 nt, Artificial Sequence
  Synthetic
gccccgagcggccgccg

SEQ ID NO: 26693 - RNA, 17 nt, Artificial Sequence
  Synthetic
gcccuggcgcucggccg

SEQ ID NO: 26694 - RNA, 17 nt, Artificial Sequence
  Synthetic
ggccgggggccgggccg

SEQ ID NO: 26695 - RNA, 17 nt, Artificial Sequence
  Synthetic
gcggccgcucggggccg

SEQ ID NO: 26696 - RNA, 17 nt, Artificial Sequence
  Synthetic
gugccgggggucugccg

SEQ ID NO: 26697 - RNA, 17 nt, Artificial Sequence
  Synthetic
gggccgggccgggggcg

SEQ ID NO: 26698 - RNA, 17 nt, Artificial Sequence
  Synthetic
gccgcggcggccgcucg

SEQ ID NO: 26699 - RNA, 17 nt, Artificial Sequence
  Synthetic
ggacacggagauguucg

SEQ ID NO: 26700 - RNA, 17 nt, Artificial Sequence
  Synthetic
ggaggaggagaccgagg

SEQ ID NO: 26701 - RNA, 17 nt, Artificial Sequence
  Synthetic
gcugcccgccucggagg

SEQ ID NO: 26702 - RNA, 17 nt, Artificial Sequence
  Synthetic
gaagcggaagcgggagg

SEQ ID NO: 26703 - RNA, 17 nt, Artificial Sequence
  Synthetic
gccgggggccgggccgg

SEQ ID NO: 26704 - RNA, 17 nt, Artificial Sequence
  Synthetic
gaggaagcggaagcggg

SEQ ID NO: 26705 - RNA, 17 nt, Artificial Sequence
  Synthetic
gcggaagcgggaggggg

SEQ ID NO: 26706 - RNA, 17 nt, Artificial Sequence
  Synthetic
gcgcagggauccugugg

SEQ ID NO: 26707 - RNA, 17 nt, Artificial Sequence
  Synthetic
gccgccccgcacgccug

SEQ ID NO: 26708 - RNA, 17 nt, Artificial Sequence
  Synthetic
gcgcgucggcgggcgug

SEQ ID NO: 26709 - RNA, 17 nt, Artificial Sequence
  Synthetic
gggugggcccgugggug

SEQ ID NO: 26710 - RNA, 17 nt, Artificial Sequence
  Synthetic
gcucgccagcagcgacu

SEQ ID NO: 26711 - RNA, 17 nt, Artificial Sequence
  Synthetic
gucagagauucccaccu

SEQ ID NO: 26712 - RNA, 17 nt, Artificial Sequence
  Synthetic
guccgugcugcccgccu

SEQ ID NO: 26713 - RNA, 17 nt, Artificial Sequence
  Synthetic
ggggcugcccuggcgcu

SEQ ID NO: 26714 - RNA, 17 nt, Artificial Sequence
  Synthetic
gaggaggagaccgaggu

SEQ ID NO: 26715 - RNA, 20 nt, Artificial Sequence
  Synthetic
gggaaaacucuggcagcgca

SEQ ID NO: 26716 - RNA, 20 nt, Artificial Sequence
  Synthetic
ggaauccaggucuucaugca

SEQ ID NO: 26717 - RNA, 20 nt, Artificial Sequence
  Synthetic
gauguucgaggcgggccuga

SEQ ID NO: 26718 - RNA, 20 nt, Artificial Sequence
  Synthetic
gcucggggccgggguccgcc

SEQ ID NO: 26719 - RNA, 20 nt, Artificial Sequence
  Synthetic
ggcugcccuggcgcucggcc

SEQ ID NO: 26720 - RNA, 20 nt, Artificial Sequence
  Synthetic
gcucggccgggggccgggcc

SEQ ID NO: 26721 - RNA, 20 nt, Artificial Sequence
  Synthetic
ggugaggaggaagcggaagc

SEQ ID NO: 26722 - RNA, 20 nt, Artificial Sequence
  Synthetic
gaugcagaaggggugcaggc

SEQ ID NO: 26723 - RNA, 20 nt, Artificial Sequence
  Synthetic
gacacggagauguucgaggc

SEQ ID NO: 26724 - RNA, 20 nt, Artificial Sequence
  Synthetic
gggcugcccuggcgcucggc

SEQ ID NO: 26725 - RNA, 20 nt, Artificial Sequence
  Synthetic
ggggcguggccgcguccauc

SEQ ID NO: 26726 - RNA, 20 nt, Artificial Sequence
  Synthetic
ggugcaggcagggaaaacuc

SEQ ID NO: 26727 - RNA, 20 nt, Artificial Sequence
  Synthetic
gcccgugggugaggaggaag

SEQ ID NO: 26728 - RNA, 20 nt, Artificial Sequence
  Synthetic
gggugaggaggaagcggaag

SEQ ID NO: 26729 - RNA, 20 nt, Artificial Sequence
  Synthetic
ggaaaacucuggcagcgcag

SEQ ID NO: 26730 - RNA, 20 nt, Artificial Sequence
  Synthetic
ggaugcucaacgacaugcag

SEQ ID NO: 26731 - RNA, 20 nt, Artificial Sequence
  Synthetic
ggaggaagcggaagcgggag

SEQ ID NO: 26732 - RNA, 20 nt, Artificial Sequence
  Synthetic
gcggcggccgcucggggccg

SEQ ID NO: 26733 - RNA, 20 nt, Artificial Sequence
  Synthetic
gagcaucccccaggcgugcg

SEQ ID NO: 26734 - RNA, 20 nt, Artificial Sequence
  Synthetic
ggacacggagauguucgagg

SEQ ID NO: 26735 - RNA, 20 nt, Artificial Sequence
  Synthetic
gaggaagcggaagcgggagg

SEQ ID NO: 26736 - RNA, 20 nt, Artificial Sequence
  Synthetic
gggugggcccgugggugagg

SEQ ID NO: 26737 - RNA, 20 nt, Artificial Sequence
  Synthetic
gcccggcacgagcucccggg

SEQ ID NO: 26738 - RNA, 20 nt, Artificial Sequence
  Synthetic
gaggaggaagcggaagcggg

SEQ ID NO: 26739 - RNA, 20 nt, Artificial Sequence
  Synthetic
ggaagcggaagcgggagggg

SEQ ID NO: 26740 - RNA, 20 nt, Artificial Sequence
  Synthetic
gaagcggaagcgggaggggg

SEQ ID NO: 26741 - RNA, 20 nt, Artificial Sequence
  Synthetic
gcgcagggauccuguggggg

SEQ ID NO: 26742 - RNA, 20 nt, Artificial Sequence
  Synthetic
guggcucgccagcagcgacu

SEQ ID NO: 26743 - RNA, 20 nt, Artificial Sequence
  Synthetic
ggucugccgcggcggccgcu

SEQ ID NO: 26744 - RNA, 17 nt, Artificial Sequence
  Synthetic
augcacgggaugcagaa

SEQ ID NO: 26745 - RNA, 17 nt, Artificial Sequence
  Synthetic
cgcuuccuccucaccca

SEQ ID NO: 26746 - RNA, 17 nt, Artificial Sequence
  Synthetic
cccccggccgagcgcca

SEQ ID NO: 26747 - RNA, 17 nt, Artificial Sequence
  Synthetic
cuccgaggcgggcagca

SEQ ID NO: 26748 - RNA, 17 nt, Artificial Sequence
  Synthetic
aaaacucuggcagcgca

SEQ ID NO: 26749 - RNA, 17 nt, Artificial Sequence
  Synthetic
cagaaggggugcaggca

SEQ ID NO: 26750 - RNA, 17 nt, Artificial Sequence
  Synthetic
auccaggucuucaugca

SEQ ID NO: 26751 - RNA, 17 nt, Artificial Sequence
  Synthetic
cgugugugccgugugca

SEQ ID NO: 26752 - RNA, 17 nt, Artificial Sequence
  Synthetic
caugcacgggaugcaga

SEQ ID NO: 26753 - RNA, 17 nt, Artificial Sequence
  Synthetic
aggaagcggaagcggga

SEQ ID NO: 26754 - RNA, 17 nt, Artificial Sequence
  Synthetic
agguggagucgcgguga

SEQ ID NO: 26755 - RNA, 17 nt, Artificial Sequence
  Synthetic
cacgggcccacccccac

SEQ ID NO: 26756 - RNA, 17 nt, Artificial Sequence
  Synthetic
uccaggucuucaugcac

SEQ ID NO: 26757 - RNA, 17 nt, Artificial Sequence
  Synthetic
ucccgugcaugaagacc

SEQ ID NO: 26758 - RNA, 17 nt, Artificial Sequence
  Synthetic
agcucccgggcggaccc

SEQ ID NO: 26759 - RNA, 17 nt, Artificial Sequence
  Synthetic
cgggcguggggcugccc

SEQ ID NO: 26760 - RNA, 17 nt, Artificial Sequence
  Synthetic
ccgccgccccgcacgcc

SEQ ID NO: 26761 - RNA, 17 nt, Artificial Sequence
  Synthetic
cggggccgggguccgcc

SEQ ID NO: 26762 - RNA, 17 nt, Artificial Sequence
  Synthetic
cggccacgcccccggcc

SEQ ID NO: 26763 - RNA, 17 nt, Artificial Sequence
  Synthetic
ugcccuggcgcucggcc

SEQ ID NO: 26764 - RNA, 17 nt, Artificial Sequence
  Synthetic
cggccgggggccgggcc

SEQ ID NO: 26765 - RNA, 17 nt, Artificial Sequence
  Synthetic
caggcgugcggggcggc

SEQ ID NO: 26766 - RNA, 17 nt, Artificial Sequence
  Synthetic
cugcccuggcgcucggc

SEQ ID NO: 26767 - RNA, 17 nt, Artificial Sequence
  Synthetic
ucggccgggggccgggc

SEQ ID NO: 26768 - RNA, 17 nt, Artificial Sequence
  Synthetic
ucuggcagcgcaggggc

SEQ ID NO: 26769 - RNA, 17 nt, Artificial Sequence
  Synthetic
cggcggccgcucggggc

SEQ ID NO: 26770 - RNA, 17 nt, Artificial Sequence
  Synthetic
cuccuccgagucgcugc

SEQ ID NO: 26771 - RNA, 17 nt, Artificial Sequence
  Synthetic
cgcccgggagcucgugc

SEQ ID NO: 26772 - RNA, 17 nt, Artificial Sequence
  Synthetic
ugccgcggcggccgcuc

SEQ ID NO: 26773 - RNA, 17 nt, Artificial Sequence
  Synthetic
ugcacgggaugcagaag

SEQ ID NO: 26774 - RNA, 17 nt, Artificial Sequence
  Synthetic
cgugggugaggaggaag

SEQ ID NO: 26775 - RNA, 17 nt, Artificial Sequence
  Synthetic
ugaggaggaagcggaag

SEQ ID NO: 26776 - RNA, 17 nt, Artificial Sequence
  Synthetic
aaacucuggcagcgcag

SEQ ID NO: 26777 - RNA, 17 nt, Artificial Sequence
  Synthetic
ugcucaacgacaugcag

SEQ ID NO: 26778 - RNA, 17 nt, Artificial Sequence
  Synthetic
cggaccccggccccgag

SEQ ID NO: 26779 - RNA, 17 nt, Artificial Sequence
  Synthetic
cucggaggaggagaccg

SEQ ID NO: 26780 - RNA, 17 nt, Artificial Sequence
  Synthetic
cugugggggugggcccg

SEQ ID NO: 26781 - RNA, 17 nt, Artificial Sequence
  Synthetic
ccgcgacuccaccuccg

SEQ ID NO: 26782 - RNA, 17 nt, Artificial Sequence
  Synthetic
cugcgcgucggcgggcg

SEQ ID NO: 26783 - RNA, 17 nt, Artificial Sequence
  Synthetic
cuggcagcgcaggggcg

SEQ ID NO: 26784 - RNA, 17 nt, Artificial Sequence
  Synthetic
caucccccaggcgugcg

SEQ ID NO: 26785 - RNA, 17 nt, Artificial Sequence
  Synthetic
ccucggagguggagucg

SEQ ID NO: 26786 - RNA, 17 nt, Artificial Sequence
  Synthetic
cagcagcgacucggagg

SEQ ID NO: 26787 - RNA, 17 nt, Artificial Sequence
  Synthetic
ugggcccgugggugagg

SEQ ID NO: 26788 - RNA, 17 nt, Artificial Sequence
  Synthetic
cccuggcgcucggccgg

SEQ ID NO: 26789 - RNA, 17 nt, Artificial Sequence
  Synthetic
ccgggggucugccgcgg

SEQ ID NO: 26790 - RNA, 17 nt, Artificial Sequence
  Synthetic
ccaggcgugcggggcgg

SEQ ID NO: 26791 - RNA, 17 nt, Artificial Sequence
  Synthetic
cgccagcagcgacucgg

SEQ ID NO: 26792 - RNA, 17 nt, Artificial Sequence
  Synthetic
aagcggaagcgggaggg

SEQ ID NO: 26793 - RNA, 17 nt, Artificial Sequence
  Synthetic
cggcacgagcucccggg

SEQ ID NO: 26794 - RNA, 17 nt, Artificial Sequence
  Synthetic
cucuggcagcgcagggg

SEQ ID NO: 26795 - RNA, 17 nt, Artificial Sequence
  Synthetic
agcggaagcgggagggg

SEQ ID NO: 26796 - RNA, 17 nt, Artificial Sequence
  Synthetic
cccccaggcgugcgggg

SEQ ID NO: 26797 - RNA, 17 nt, Artificial Sequence
  Synthetic
cagggauccuguggggg

SEQ ID NO: 26798 - RNA, 17 nt, Artificial Sequence
  Synthetic
ccgccccgcacgccugg

SEQ ID NO: 26799 - RNA, 17 nt, Artificial Sequence
  Synthetic
agcaucccccaggcgug

SEQ ID NO: 26800 - RNA, 17 nt, Artificial Sequence
  Synthetic
cgccgccccgcacgccu

SEQ ID NO: 26801 - RNA, 17 nt, Artificial Sequence
  Synthetic
cugccgcggcggccgcu

SEQ ID NO: 26802 - RNA, 17 nt, Artificial Sequence
  Synthetic
ugugggggugggcccgu

SEQ ID NO: 26803 - RNA, 17 nt, Artificial Sequence
  Synthetic
ugcgcgucggcgggcgu

SEQ ID NO: 26804 - RNA, 17 nt, Artificial Sequence
  Synthetic
agggauccugugggggu

SEQ ID NO: 26805 - RNA, 20 nt, Artificial Sequence
  Synthetic
uucaugcacgggaugcagaa

SEQ ID NO: 26806 - RNA, 20 nt, Artificial Sequence
  Synthetic
cgaggcgggcagcacggaca

SEQ ID NO: 26807 - RNA, 20 nt, Artificial Sequence
  Synthetic
uuccgcuuccuccucaccca

SEQ ID NO: 26808 - RNA, 20 nt, Artificial Sequence
  Synthetic
cggcccccggccgagcgcca

SEQ ID NO: 26809 - RNA, 20 nt, Artificial Sequence
  Synthetic
caccuccgaggcgggcagca

SEQ ID NO: 26810 - RNA, 20 nt, Artificial Sequence
  Synthetic
cccacgcccgccgacgcgca

SEQ ID NO: 26811 - RNA, 20 nt, Artificial Sequence
  Synthetic
augcagaaggggugcaggca

SEQ ID NO: 26812 - RNA, 20 nt, Artificial Sequence
  Synthetic
aggaggaagcggaagcggga

SEQ ID NO: 26813 - RNA, 20 nt, Artificial Sequence
  Synthetic
cggagguggagucgcgguga

SEQ ID NO: 26814 - RNA, 20 nt, Artificial Sequence
  Synthetic
uccgcuuccuccucacccac

SEQ ID NO: 26815 - RNA, 20 nt, Artificial Sequence
  Synthetic
acccacgggcccacccccac

SEQ ID NO: 26816 - RNA, 20 nt, Artificial Sequence
  Synthetic
acgagcucccgggcggaccc

SEQ ID NO: 26817 - RNA, 20 nt, Artificial Sequence
  Synthetic
cggccgccgcggcagacccc

SEQ ID NO: 26818 - RNA, 20 nt, Artificial Sequence
  Synthetic
cacgcccccggcccggcccc

SEQ ID NO: 26819 - RNA, 20 nt, Artificial Sequence
  Synthetic
cggcgggcguggggcugccc

SEQ ID NO: 26820 - RNA, 20 nt, Artificial Sequence
  Synthetic
ccggcccccggccgagcgcc

SEQ ID NO: 26821 - RNA, 20 nt, Artificial Sequence
  Synthetic
acgcggccacgcccccggcc

SEQ ID NO: 26822 - RNA, 20 nt, Artificial Sequence
  Synthetic
ccgggagcucgugccgggcc

SEQ ID NO: 26823 - RNA, 20 nt, Artificial Sequence
  Synthetic
cgcggcggccgcucggggcc

SEQ ID NO: 26824 - RNA, 20 nt, Artificial Sequence
  Synthetic
cuggcgcucggccgggggcc

SEQ ID NO: 26825 - RNA, 20 nt, Artificial Sequence
  Synthetic
uccgcccgggagcucgugcc

SEQ ID NO: 26826 - RNA, 20 nt, Artificial Sequence
  Synthetic
cguguugcgcaacggaaucc

SEQ ID NO: 26827 - RNA, 20 nt, Artificial Sequence
  Synthetic
cccggcccggcacgagcucc

SEQ ID NO: 26828 - RNA, 20 nt, Artificial Sequence
  Synthetic
agggaaaacucuggcagcgc

SEQ ID NO: 26829 - RNA, 20 nt, Artificial Sequence
  Synthetic
ccccacgcccgccgacgcgc

SEQ ID NO: 26830 - RNA, 20 nt, Artificial Sequence
  Synthetic
ccccaggcgugcggggcggc

SEQ ID NO: 26831 - RNA, 20 nt, Artificial Sequence
  Synthetic
cgcucggccgggggccgggc

SEQ ID NO: 26832 - RNA, 20 nt, Artificial Sequence
  Synthetic
ccgcggcggccgcucggggc

SEQ ID NO: 26833 - RNA, 20 nt, Artificial Sequence
  Synthetic
ccuggcgcucggccgggggc

SEQ ID NO: 26834 - RNA, 20 nt, Artificial Sequence
  Synthetic
cuccuccuccgagucgcugc

SEQ ID NO: 26835 - RNA, 20 nt, Artificial Sequence
  Synthetic
acgggaugcagaaggggugc

SEQ ID NO: 26836 - RNA, 20 nt, Artificial Sequence
  Synthetic
cgaggcgggccugauggacg

SEQ ID NO: 26837 - RNA, 20 nt, Artificial Sequence
  Synthetic
cgacucggaggaggagaccg

SEQ ID NO: 26838 - RNA, 20 nt, Artificial Sequence
  Synthetic
auccugugggggugggcccg

SEQ ID NO: 26839 - RNA, 20 nt, Artificial Sequence
  Synthetic
ccggccccgagcggccgccg

SEQ ID NO: 26840 - RNA, 20 nt, Artificial Sequence
  Synthetic
cucggccgggggccgggccg

SEQ ID NO: 26841 - RNA, 20 nt, Artificial Sequence
  Synthetic
ucaccgcgacuccaccuccg

SEQ ID NO: 26842 - RNA, 20 nt, Artificial Sequence
  Synthetic
ucccugcgcgucggcgggcg

SEQ ID NO: 26843 - RNA, 20 nt, Artificial Sequence
  Synthetic
cgggggccgggccgggggcg

SEQ ID NO: 26844 - RNA, 20 nt, Artificial Sequence
  Synthetic
ucugccgcggcggccgcucg

SEQ ID NO: 26845 - RNA, 20 nt, Artificial Sequence
  Synthetic
cucggaggaggagaccgagg

SEQ ID NO: 26846 - RNA, 20 nt, Artificial Sequence
  Synthetic
cgugcugcccgccucggagg

SEQ ID NO: 26847 - RNA, 20 nt, Artificial Sequence
  Synthetic
cugcccuggcgcucggccgg

SEQ ID NO: 26848 - RNA, 20 nt, Artificial Sequence
  Synthetic
ucggccgggggccgggccgg

SEQ ID NO: 26849 - RNA, 20 nt, Artificial Sequence
  Synthetic
cccccaggcgugcggggcgg

SEQ ID NO: 26850 - RNA, 20 nt, Artificial Sequence
  Synthetic
acaggaucccugcgcgucgg

SEQ ID NO: 26851 - RNA, 20 nt, Artificial Sequence
  Synthetic
aggaagcggaagcgggaggg

SEQ ID NO: 26852 - RNA, 20 nt, Artificial Sequence
  Synthetic
aaacucuggcagcgcagggg

SEQ ID NO: 26853 - RNA, 20 nt, Artificial Sequence
  Synthetic
ccgccgccccgcacgccugg

SEQ ID NO: 26854 - RNA, 20 nt, Artificial Sequence
  Synthetic
cccgccgccccgcacgccug

SEQ ID NO: 26855 - RNA, 20 nt, Artificial Sequence
  Synthetic
uugagcaucccccaggcgug

SEQ ID NO: 26856 - RNA, 20 nt, Artificial Sequence
  Synthetic
ccugcgcgucggcgggcgug

SEQ ID NO: 26857 - RNA, 20 nt, Artificial Sequence
  Synthetic
ugggggugggcccgugggug

SEQ ID NO: 26858 - RNA, 20 nt, Artificial Sequence
  Synthetic
cguguccgugcugcccgccu

SEQ ID NO: 26859 - RNA, 20 nt, Artificial Sequence
  Synthetic
cguggggcugcccuggcgcu

SEQ ID NO: 26860 - RNA, 20 nt, Artificial Sequence
  Synthetic
uccugugggggugggcccgu

SEQ ID NO: 26861 - RNA, 20 nt, Artificial Sequence
  Synthetic
cccugcgcgucggcgggcgu

SEQ ID NO: 26862 - RNA, 20 nt, Artificial Sequence
  Synthetic
ucggaggaggagaccgaggu

SEQ ID NO: 26863 - RNA, 20 nt, Artificial Sequence
  Synthetic
cgcagggauccugugggggu

SEQ ID NO: 26864 - RNA, 17 nt, Artificial Sequence
  Synthetic
ggaggaggaggagacaa

SEQ ID NO: 26865 - RNA, 17 nt, Artificial Sequence
  Synthetic
cccacccccgcccgcaa

SEQ ID NO: 26866 - RNA, 17 nt, Artificial Sequence
  Synthetic
gucgcuggggggacaca

SEQ ID NO: 26867 - RNA, 17 nt, Artificial Sequence
  Synthetic
guguccccccagcgaca

SEQ ID NO: 26868 - RNA, 17 nt, Artificial Sequence
  Synthetic
cgggggggugggcgaca

SEQ ID NO: 26869 - RNA, 17 nt, Artificial Sequence
  Synthetic
ccugcccguccuggaca

SEQ ID NO: 26870 - RNA, 17 nt, Artificial Sequence
  Synthetic
cgcgcucgcagacacca

SEQ ID NO: 26871 - RNA, 17 nt, Artificial Sequence
  Synthetic
guccagcgcgcccacca

SEQ ID NO: 26872 - RNA, 17 nt, Artificial Sequence
  Synthetic
cccugcucccgagacca

SEQ ID NO: 26873 - RNA, 17 nt, Artificial Sequence
  Synthetic
aacaugcucuuugacca

SEQ ID NO: 26874 - RNA, 17 nt, Artificial Sequence
  Synthetic
ucgccccucgcccccca

SEQ ID NO: 26875 - RNA, 17 nt, Artificial Sequence
  Synthetic
guucacguaaggcgcca

SEQ ID NO: 26876 - RNA, 17 nt, Artificial Sequence
  Synthetic
ugcuccgcggggcgcca

SEQ ID NO: 26877 - RNA, 17 nt, Artificial Sequence
  Synthetic
ucgggcgaccgcggcca

SEQ ID NO: 26878 - RNA, 17 nt, Artificial Sequence
  Synthetic
ucguccgugccgggcca

SEQ ID NO: 26879 - RNA, 17 nt, Artificial Sequence
  Synthetic
gacgcccccgcgggcca

SEQ ID NO: 26880 - RNA, 17 nt, Artificial Sequence
  Synthetic
cguccagauaaagucca

SEQ ID NO: 26881 - RNA, 17 nt, Artificial Sequence
  Synthetic
ggcgcgcuggacuucca

SEQ ID NO: 26882 - RNA, 17 nt, Artificial Sequence
  Synthetic
ccguggucucgggagca

SEQ ID NO: 26883 - RNA, 17 nt, Artificial Sequence
  Synthetic
cgcgugcucggggagca

SEQ ID NO: 26884 - RNA, 17 nt, Artificial Sequence
  Synthetic
ggccgugccggcccgca

SEQ ID NO: 26885 - RNA, 17 nt, Artificial Sequence
  Synthetic
gccccccgccggccgca

SEQ ID NO: 26886 - RNA, 17 nt, Artificial Sequence
  Synthetic
cgacggccgcgacggca

SEQ ID NO: 26887 - RNA, 17 nt, Artificial Sequence
  Synthetic
gugcgcguccaccggca

SEQ ID NO: 26888 - RNA, 17 nt, Artificial Sequence
  Synthetic
ccccccguggcccggca

SEQ ID NO: 26889 - RNA, 17 nt, Artificial Sequence
  Synthetic
ggccgugcgggccggca

SEQ ID NO: 26890 - RNA, 17 nt, Artificial Sequence
  Synthetic
cgugaacaagacgguca

SEQ ID NO: 26891 - RNA, 17 nt, Artificial Sequence
  Synthetic
gccuuacgugaacaaga

SEQ ID NO: 26892 - RNA, 17 nt, Artificial Sequence
  Synthetic
gggggugggggccaaga

SEQ ID NO: 26893 - RNA, 17 nt, Artificial Sequence
  Synthetic
gguccucguggaccaga

SEQ ID NO: 26894 - RNA, 17 nt, Artificial Sequence
  Synthetic
gcggggcggcgcggaga

SEQ ID NO: 26895 - RNA, 17 nt, Artificial Sequence
  Synthetic
cguccuggacauggaga

SEQ ID NO: 26896 - RNA, 17 nt, Artificial Sequence
  Synthetic
ggccacucucggcacga

SEQ ID NO: 26897 - RNA, 17 nt, Artificial Sequence
  Synthetic
accgcggccugggacga

SEQ ID NO: 26898 - RNA, 17 nt, Artificial Sequence
  Synthetic
gacgacggagacgccga

SEQ ID NO: 26899 - RNA, 17 nt, Artificial Sequence
  Synthetic
agcagcgcgggggccga

SEQ ID NO: 26900 - RNA, 17 nt, Artificial Sequence
  Synthetic
gcucgagacccccgcga

SEQ ID NO: 26901 - RNA, 17 nt, Artificial Sequence
  Synthetic
cggcacgacggccgcga

SEQ ID NO: 26902 - RNA, 17 nt, Artificial Sequence
  Synthetic
ccggacgcgcggggcga

SEQ ID NO: 26903 - RNA, 17 nt, Artificial Sequence
  Synthetic
cacccccuggggggcga

SEQ ID NO: 26904 - RNA, 17 nt, Artificial Sequence
  Synthetic
cgucuccauguccagga

SEQ ID NO: 26905 - RNA, 17 nt, Artificial Sequence
  Synthetic
aagacgcgccacgcgga

SEQ ID NO: 26906 - RNA, 17 nt, Artificial Sequence
  Synthetic
gacgggcaacccgcgga

SEQ ID NO: 26907 - RNA, 17 nt, Artificial Sequence
  Synthetic
gccccccacgccgcgga

SEQ ID NO: 26908 - RNA, 17 nt, Artificial Sequence
  Synthetic
ggagggccgggcgcgga

SEQ ID NO: 26909 - RNA, 17 nt, Artificial Sequence
  Synthetic
gacgccgcggcggcgga

SEQ ID NO: 26910 - RNA, 17 nt, Artificial Sequence
  Synthetic
gucguucacuaucggga

SEQ ID NO: 26911 - RNA, 17 nt, Artificial Sequence
  Synthetic
acgcgcgcgggucggga

SEQ ID NO: 26912 - RNA, 17 nt, Artificial Sequence
  Synthetic
cguggacuuuaucugga

SEQ ID NO: 26913 - RNA, 17 nt, Artificial Sequence
  Synthetic
uggagacgggccacaua

SEQ ID NO: 26914 - RNA, 17 nt, Artificial Sequence
  Synthetic
agagucgcugaugacua

SEQ ID NO: 26915 - RNA, 17 nt, Artificial Sequence
  Synthetic
accgucuuguucacgua

SEQ ID NO: 26916 - RNA, 17 nt, Artificial Sequence
  Synthetic
ccacccccgcccgcaac

SEQ ID NO: 26917 - RNA, 17 nt, Artificial Sequence
  Synthetic
gcgcucgcagacaccac

SEQ ID NO: 26918 - RNA, 17 nt, Artificial Sequence
  Synthetic
ccugcucccgagaccac

SEQ ID NO: 26919 - RNA, 17 nt, Artificial Sequence
  Synthetic
aagagcauguugcccac

SEQ ID NO: 26920 - RNA, 17 nt, Artificial Sequence
  Synthetic
acuaucagguacgccac

SEQ ID NO: 26921 - RNA, 17 nt, Artificial Sequence
  Synthetic
cgggcgaccgcggccac

SEQ ID NO: 26922 - RNA, 17 nt, Artificial Sequence
  Synthetic
cguccgugccgggccac

SEQ ID NO: 26923 - RNA, 17 nt, Artificial Sequence
  Synthetic
acgcccccgcgggccac

SEQ ID NO: 26924 - RNA, 17 nt, Artificial Sequence
  Synthetic
gcgcggugcgcguccac

SEQ ID NO: 26925 - RNA, 17 nt, Artificial Sequence
  Synthetic
cuccuccuccuccgcac

SEQ ID NO: 26926 - RNA, 17 nt, Artificial Sequence
  Synthetic
ggcguggggggcggcac

SEQ ID NO: 26927 - RNA, 17 nt, Artificial Sequence
  Synthetic
gugaacaagacggucac

SEQ ID NO: 26928 - RNA, 17 nt, Artificial Sequence
  Synthetic
guccucguggaccagac

SEQ ID NO: 26929 - RNA, 17 nt, Artificial Sequence
  Synthetic
guccuggacauggagac

SEQ ID NO: 26930 - RNA, 17 nt, Artificial Sequence
  Synthetic
gcccgccgcgacccgac

SEQ ID NO: 26931 - RNA, 17 nt, Artificial Sequence
  Synthetic
acgacggagacgccgac

SEQ ID NO: 26932 - RNA, 17 nt, Artificial Sequence
  Synthetic
uguguccccccagcgac

SEQ ID NO: 26933 - RNA, 17 nt, Artificial Sequence
  Synthetic
accacggguggcgcgac

SEQ ID NO: 26934 - RNA, 17 nt, Artificial Sequence
  Synthetic
ccugggucaugcgcgac

SEQ ID NO: 26935 - RNA, 17 nt, Artificial Sequence
  Synthetic
acgggggggugggcgac

SEQ ID NO: 26936 - RNA, 17 nt, Artificial Sequence
  Synthetic
gucuccauguccaggac

SEQ ID NO: 26937 - RNA, 17 nt, Artificial Sequence
  Synthetic
guggacuuuaucuggac

SEQ ID NO: 26938 - RNA, 17 nt, Artificial Sequence
  Synthetic
aguccagcgcgcccacc

SEQ ID NO: 26939 - RNA, 17 nt, Artificial Sequence
  Synthetic
agagcauguugcccacc

SEQ ID NO: 26940 - RNA, 17 nt, Artificial Sequence
  Synthetic
cuaucagguacgccacc

SEQ ID NO: 26941 - RNA, 17 nt, Artificial Sequence
  Synthetic
gcguggggggcggcacc

SEQ ID NO: 26942 - RNA, 17 nt, Artificial Sequence
  Synthetic
gcccggggcccgcgacc

SEQ ID NO: 26943 - RNA, 17 nt, Artificial Sequence
  Synthetic
cugggucaugcgcgacc

SEQ ID NO: 26944 - RNA, 17 nt, Artificial Sequence
  Synthetic
ggcgcggagggaggacc

SEQ ID NO: 26945 - RNA, 17 nt, Artificial Sequence
  Synthetic
cgacgaggacgaugacc

SEQ ID NO: 26946 - RNA, 17 nt, Artificial Sequence
  Synthetic
caacaugcucuuugacc

SEQ ID NO: 26947 - RNA, 17 nt, Artificial Sequence
  Synthetic
cuuugaccagggcaccc

SEQ ID NO: 26948 - RNA, 17 nt, Artificial Sequence
  Synthetic
gcgcggagggaggaccc

SEQ ID NO: 26949 - RNA, 17 nt, Artificial Sequence
  Synthetic
ggugccgcgggggaccc

SEQ ID NO: 26950 - RNA, 17 nt, Artificial Sequence
  Synthetic
ccggucgcgcaugaccc

SEQ ID NO: 26951 - RNA, 17 nt, Artificial Sequence
  Synthetic
cagccucuggaugaccc

SEQ ID NO: 26952 - RNA, 17 nt, Artificial Sequence
  Synthetic
cgcggcaccaacacccc

SEQ ID NO: 26953 - RNA, 17 nt, Artificial Sequence
  Synthetic
cgauagugaacgacccc

SEQ ID NO: 26954 - RNA, 17 nt, Artificial Sequence
  Synthetic
gugccgcgggggacccc

SEQ ID NO: 26955 - RNA, 17 nt, Artificial Sequence
  Synthetic
ucuuggcccccaccccc

SEQ ID NO: 26956 - RNA, 17 nt, Artificial Sequence
  Synthetic
ggcagaccucccccccc

SEQ ID NO: 26957 - RNA, 17 nt, Artificial Sequence
  Synthetic
uggcagaccuccccccc

SEQ ID NO: 26958 - RNA, 17 nt, Artificial Sequence
  Synthetic
cucgccccucgcccccc

SEQ ID NO: 26959 - RNA, 17 nt, Artificial Sequence
  Synthetic
acccgaccggcgccccc

SEQ ID NO: 26960 - RNA, 17 nt, Artificial Sequence
  Synthetic
gggcggcggcccgcccc

SEQ ID NO: 26961 - RNA, 17 nt, Artificial Sequence
  Synthetic
gccgccccgcgggcccc

SEQ ID NO: 26962 - RNA, 17 nt, Artificial Sequence
  Synthetic
gccgggucgcgggcccc

SEQ ID NO: 26963 - RNA, 17 nt, Artificial Sequence
  Synthetic
agguguccucgggcccc

SEQ ID NO: 26964 - RNA, 17 nt, Artificial Sequence
  Synthetic
agggcggccccgagccc

SEQ ID NO: 26965 - RNA, 17 nt, Artificial Sequence
  Synthetic
ccccccgaagagcgccc

SEQ ID NO: 26966 - RNA, 17 nt, Artificial Sequence
  Synthetic
acgcgcaccgcgcgccc

SEQ ID NO: 26967 - RNA, 17 nt, Artificial Sequence
  Synthetic
ccacgggccgcucgccc

SEQ ID NO: 26968 - RNA, 17 nt, Artificial Sequence
  Synthetic
acaaaggagagcggccc

SEQ ID NO: 26969 - RNA, 17 nt, Artificial Sequence
  Synthetic
acagccccgcgcggccc

SEQ ID NO: 26970 - RNA, 17 nt, Artificial Sequence
  Synthetic
ggcgccgcgccgggccc

SEQ ID NO: 26971 - RNA, 17 nt, Artificial Sequence
  Synthetic
cgccgccccgcgggccc

SEQ ID NO: 26972 - RNA, 17 nt, Artificial Sequence
  Synthetic
cgccgggucgcgggccc

SEQ ID NO: 26973 - RNA, 17 nt, Artificial Sequence
  Synthetic
cagguguccucgggccc

SEQ ID NO: 26974 - RNA, 17 nt, Artificial Sequence
  Synthetic
cucgagcgucguggccc

SEQ ID NO: 26975 - RNA, 17 nt, Artificial Sequence
  Synthetic
cgcccaccagggugccc

SEQ ID NO: 26976 - RNA, 17 nt, Artificial Sequence
  Synthetic
ggcgucuccgucguccc

SEQ ID NO: 26977 - RNA, 17 nt, Artificial Sequence
  Synthetic
gagggcggccccgagcc

SEQ ID NO: 26978 - RNA, 17 nt, Artificial Sequence
  Synthetic
gggugucggucugagcc

SEQ ID NO: 26979 - RNA, 17 nt, Artificial Sequence
  Synthetic
cggcgcccgcggacgcc

SEQ ID NO: 26980 - RNA, 17 nt, Artificial Sequence
  Synthetic
accgccgcccccgcgcc

SEQ ID NO: 26981 - RNA, 17 nt, Artificial Sequence
  Synthetic
gagggcggcgccgcgcc

SEQ ID NO: 26982 - RNA, 17 nt, Artificial Sequence
  Synthetic
gguccucccuccgcgcc

SEQ ID NO: 26983 - RNA, 17 nt, Artificial Sequence
  Synthetic
uguucacguaaggcgcc

SEQ ID NO: 26984 - RNA, 17 nt, Artificial Sequence
  Synthetic
gcccgcgacccggcgcc

SEQ ID NO: 26985 - RNA, 17 nt, Artificial Sequence
  Synthetic
gcgugaggccgggcgcc

SEQ ID NO: 26986 - RNA, 17 nt, Artificial Sequence
  Synthetic
cugcuccgcggggcgcc

SEQ ID NO: 26987 - RNA, 17 nt, Artificial Sequence
  Synthetic
agguagcgcgugaggcc

SEQ ID NO: 26988 - RNA, 17 nt, Artificial Sequence
  Synthetic
gacaaaggagagcggcc

SEQ ID NO: 26989 - RNA, 17 nt, Artificial Sequence
  Synthetic
cgagcgcggacgcggcc

SEQ ID NO: 26990 - RNA, 17 nt, Artificial Sequence
  Synthetic
cggcggcgaccgcggcc

SEQ ID NO: 26991 - RNA, 17 nt, Artificial Sequence
  Synthetic
cgcgggucgggagggcc

SEQ ID NO: 26992 - RNA, 17 nt, Artificial Sequence
  Synthetic
ggcgggcggcgcgggcc

SEQ ID NO: 26993 - RNA, 17 nt, Artificial Sequence
  Synthetic
aguccgaguccggggcc

SEQ ID NO: 26994 - RNA, 17 nt, Artificial Sequence
  Synthetic
agcacagagucugggcc

SEQ ID NO: 26995 - RNA, 17 nt, Artificial Sequence
  Synthetic
cccacccccccguggcc

SEQ ID NO: 26996 - RNA, 17 nt, Artificial Sequence
  Synthetic
cgucggucgcgccugcc

SEQ ID NO: 26997 - RNA, 17 nt, Artificial Sequence
  Synthetic
uccucgucguccgugcc

SEQ ID NO: 26998 - RNA, 17 nt, Artificial Sequence
  Synthetic
ggccgaggaagugugcc

SEQ ID NO: 26999 - RNA, 17 nt, Artificial Sequence
  Synthetic
ugacuauggggggcucc

SEQ ID NO: 27000 - RNA, 17 nt, Artificial Sequence
  Synthetic
cgcccgaguccgagucc

SEQ ID NO: 27001 - RNA, 17 nt, Artificial Sequence
  Synthetic
ggacugccugcccgucc

SEQ ID NO: 27002 - RNA, 17 nt, Artificial Sequence
  Synthetic
ggccuccacgcgggucc

SEQ ID NO: 27003 - RNA, 17 nt, Artificial Sequence
  Synthetic
ggcccgucuccaugucc

SEQ ID NO: 27004 - RNA, 17 nt, Artificial Sequence
  Synthetic
cgacccgcgccucuucc

SEQ ID NO: 27005 - RNA, 17 nt, Artificial Sequence
  Synthetic
cgcguggcgcgucuucc

SEQ ID NO: 27006 - RNA, 17 nt, Artificial Sequence
  Synthetic
ugggcgugaccgccagc

SEQ ID NO: 27007 - RNA, 17 nt, Artificial Sequence
  Synthetic
gggccgcggcccgcagc

SEQ ID NO: 27008 - RNA, 17 nt, Artificial Sequence
  Synthetic
cccguggucucgggagc

SEQ ID NO: 27009 - RNA, 17 nt, Artificial Sequence
  Synthetic
gcgcgugcucggggagc

SEQ ID NO: 27010 - RNA, 17 nt, Artificial Sequence
  Synthetic
cgccucggccuccacgc

SEQ ID NO: 27011 - RNA, 17 nt, Artificial Sequence
  Synthetic
gugcggcggcuccacgc

SEQ ID NO: 27012 - RNA, 17 nt, Artificial Sequence
  Synthetic
cuguuccacuccgacgc

SEQ ID NO: 27013 - RNA, 17 nt, Artificial Sequence
  Synthetic
gcggcgcccgcggacgc

SEQ ID NO: 27014 - RNA, 17 nt, Artificial Sequence
  Synthetic
ggugcugaacgacccgc

SEQ ID NO: 27015 - RNA, 17 nt, Artificial Sequence
  Synthetic
cugcgcgcgccccccgc

SEQ ID NO: 27016 - RNA, 17 nt, Artificial Sequence
  Synthetic
gccggcgacgcccccgc

SEQ ID NO: 27017 - RNA, 17 nt, Artificial Sequence
  Synthetic
ucuccgcgccgccccgc

SEQ ID NO: 27018 - RNA, 17 nt, Artificial Sequence
  Synthetic
agcggcccggggcccgc

SEQ ID NO: 27019 - RNA, 17 nt, Artificial Sequence
  Synthetic
uacuccccguggcccgc

SEQ ID NO: 27020 - RNA, 17 nt, Artificial Sequence
  Synthetic
ccgcgcugcugcgccgc

SEQ ID NO: 27021 - RNA, 17 nt, Artificial Sequence
  Synthetic
gcggaggacgaggccgc

SEQ ID NO: 27022 - RNA, 17 nt, Artificial Sequence
  Synthetic
cgccccccgccggccgc

SEQ ID NO: 27023 - RNA, 17 nt, Artificial Sequence
  Synthetic
ggggguguuggugccgc

SEQ ID NO: 27024 - RNA, 17 nt, Artificial Sequence
  Synthetic
cgcugcugcugcuccgc

SEQ ID NO: 27025 - RNA, 17 nt, Artificial Sequence
  Synthetic
agcgcggggccguccgc

SEQ ID NO: 27026 - RNA, 17 nt, Artificial Sequence
  Synthetic
cucgccccggcguccgc

SEQ ID NO: 27027 - RNA, 17 nt, Artificial Sequence
  Synthetic
gggcugggagguuccgc

SEQ ID NO: 27028 - RNA, 17 nt, Artificial Sequence
  Synthetic
ucgucucuccccagcgc

SEQ ID NO: 27029 - RNA, 17 nt, Artificial Sequence
  Synthetic
ccgcggcgcagcagcgc

SEQ ID NO: 27030 - RNA, 17 nt, Artificial Sequence
  Synthetic
gggcgaggggcgagcgc

SEQ ID NO: 27031 - RNA, 17 nt, Artificial Sequence
  Synthetic
ccagcgacagggagcgc

SEQ ID NO: 27032 - RNA, 17 nt, Artificial Sequence
  Synthetic
gcggacuccggacgcgc

SEQ ID NO: 27033 - RNA, 17 nt, Artificial Sequence
  Synthetic
caccgccgcccccgcgc

SEQ ID NO: 27034 - RNA, 17 nt, Artificial Sequence
  Synthetic
gcagggcgcgcccgcgc

SEQ ID NO: 27035 - RNA, 17 nt, Artificial Sequence
  Synthetic
agagggcggcgccgcgc

SEQ ID NO: 27036 - RNA, 17 nt, Artificial Sequence
  Synthetic
cggggcgacggccgcgc

SEQ ID NO: 27037 - RNA, 17 nt, Artificial Sequence
  Synthetic
gggcuccugggccgcgc

SEQ ID NO: 27038 - RNA, 17 nt, Artificial Sequence
  Synthetic
gcgcgaccgacgcgcgc

SEQ ID NO: 27039 - RNA, 17 nt, Artificial Sequence
  Synthetic
cggcggggggcgcgcgc

SEQ ID NO: 27040 - RNA, 17 nt, Artificial Sequence
  Synthetic
cacccuggugggcgcgc

SEQ ID NO: 27041 - RNA, 17 nt, Artificial Sequence
  Synthetic
gcccccggaagaggcgc

SEQ ID NO: 27042 - RNA, 17 nt, Artificial Sequence
  Synthetic
gaagagcgccccggcgc

SEQ ID NO: 27043 - RNA, 17 nt, Artificial Sequence
  Synthetic
gcgucgccggccggcgc

SEQ ID NO: 27044 - RNA, 17 nt, Artificial Sequence
  Synthetic
gcguccgcguccggcgc

SEQ ID NO: 27045 - RNA, 17 nt, Artificial Sequence
  Synthetic
gggggcggcggcggcgc

SEQ ID NO: 27046 - RNA, 17 nt, Artificial Sequence
  Synthetic
ggcacggcgggcggcgc

SEQ ID NO: 27047 - RNA, 17 nt, Artificial Sequence
  Synthetic
cgcgugaggccgggcgc

SEQ ID NO: 27048 - RNA, 17 nt, Artificial Sequence
  Synthetic
ggggcgccagggggcgc

SEQ ID NO: 27049 - RNA, 17 nt, Artificial Sequence
  Synthetic
cgcuaccugcccaucgc

SEQ ID NO: 27050 - RNA, 17 nt, Artificial Sequence
  Synthetic
gcgcggggcugucucgc

SEQ ID NO: 27051 - RNA, 17 nt, Artificial Sequence
  Synthetic
gcccgcgggggcgucgc

SEQ ID NO: 27052 - RNA, 17 nt, Artificial Sequence
  Synthetic
gccgggcgccgggucgc

SEQ ID NO: 27053 - RNA, 17 nt, Artificial Sequence
  Synthetic
cccgcgcucccugucgc

SEQ ID NO: 27054 - RNA, 17 nt, Artificial Sequence
  Synthetic
cagguagcgcgugaggc

SEQ ID NO: 27055 - RNA, 17 nt, Artificial Sequence
  Synthetic
gcguccaccggcacggc

SEQ ID NO: 27056 - RNA, 17 nt, Artificial Sequence
  Synthetic
ggcggcgcggagacggc

SEQ ID NO: 27057 - RNA, 17 nt, Artificial Sequence
  Synthetic
acgacggccgcgacggc

SEQ ID NO: 27058 - RNA, 17 nt, Artificial Sequence
  Synthetic
ggcgcgcccgcgccggc

SEQ ID NO: 27059 - RNA, 17 nt, Artificial Sequence
  Synthetic
gcgggggcgucgccggc

SEQ ID NO: 27060 - RNA, 17 nt, Artificial Sequence
  Synthetic
uucccccugcggccggc

SEQ ID NO: 27061 - RNA, 17 nt, Artificial Sequence
  Synthetic
gcgagcgcggacgcggc

SEQ ID NO: 27062 - RNA, 17 nt, Artificial Sequence
  Synthetic
gcgcgcgcaggcgcggc

SEQ ID NO: 27063 - RNA, 17 nt, Artificial Sequence
  Synthetic
gccggucgggucgcggc

SEQ ID NO: 27064 - RNA, 17 nt, Artificial Sequence
  Synthetic
ucucuucccccugcggc

SEQ ID NO: 27065 - RNA, 17 nt, Artificial Sequence
  Synthetic
ccgcggcggcggagggc

SEQ ID NO: 27066 - RNA, 17 nt, Artificial Sequence
  Synthetic
gcgcgggucgggagggc

SEQ ID NO: 27067 - RNA, 17 nt, Artificial Sequence
  Synthetic
ccauguccaggacgggc

SEQ ID NO: 27068 - RNA, 17 nt, Artificial Sequence
  Synthetic
cagagucugggccgggc

SEQ ID NO: 27069 - RNA, 17 nt, Artificial Sequence
  Synthetic
gucgggucgcggcgggc

SEQ ID NO: 27070 - RNA, 17 nt, Artificial Sequence
  Synthetic
cucuucggggggcgggc

SEQ ID NO: 27071 - RNA, 17 nt, Artificial Sequence
  Synthetic
ccucuuccucugcgggc

SEQ ID NO: 27072 - RNA, 17 nt, Artificial Sequence
  Synthetic
gaggcggccgugcgggc

SEQ ID NO: 27073 - RNA, 17 nt, Artificial Sequence
  Synthetic
ggcgccccguugcgggc

SEQ ID NO: 27074 - RNA, 17 nt, Artificial Sequence
  Synthetic
uccucugcgggcggggc

SEQ ID NO: 27075 - RNA, 17 nt, Artificial Sequence
  Synthetic
gcgccucuuccgggggc

SEQ ID NO: 27076 - RNA, 17 nt, Artificial Sequence
  Synthetic
ggcgcucuucggggggc

SEQ ID NO: 27077 - RNA, 17 nt, Artificial Sequence
  Synthetic
agacccccgcgaugggc

SEQ ID NO: 27078 - RNA, 17 nt, Artificial Sequence
  Synthetic
aagcacagagucugggc

SEQ ID NO: 27079 - RNA, 17 nt, Artificial Sequence
  Synthetic
cguggcggaccugcugc

SEQ ID NO: 27080 - RNA, 17 nt, Artificial Sequence
  Synthetic
uccgccucuuccucugc

SEQ ID NO: 27081 - RNA, 17 nt, Artificial Sequence
  Synthetic
cgcgccgcccgccgugc

SEQ ID NO: 27082 - RNA, 17 nt, Artificial Sequence
  Synthetic
aaaguccacggccgugc

SEQ ID NO: 27083 - RNA, 17 nt, Artificial Sequence
  Synthetic
ggccgaggcggccgugc

SEQ ID NO: 27084 - RNA, 17 nt, Artificial Sequence
  Synthetic
guccucgucguccgugc

SEQ ID NO: 27085 - RNA, 17 nt, Artificial Sequence
  Synthetic
cgcgggggcggcggugc

SEQ ID NO: 27086 - RNA, 17 nt, Artificial Sequence
  Synthetic
cggcggcgccccguugc

SEQ ID NO: 27087 - RNA, 17 nt, Artificial Sequence
  Synthetic
cgggcgggggugggauc

SEQ ID NO: 27088 - RNA, 17 nt, Artificial Sequence
  Synthetic
cggucacgcccacuauc

SEQ ID NO: 27089 - RNA, 17 nt, Artificial Sequence
  Synthetic
gggggucguucacuauc

SEQ ID NO: 27090 - RNA, 17 nt, Artificial Sequence
  Synthetic
cggccguggacuuuauc

SEQ ID NO: 27091 - RNA, 17 nt, Artificial Sequence
  Synthetic
cggcgcggggcggacuc

SEQ ID NO: 27092 - RNA, 17 nt, Artificial Sequence
  Synthetic
gccccggacucggacuc

SEQ ID NO: 27093 - RNA, 17 nt, Artificial Sequence
  Synthetic
aggcgcgggucggacuc

SEQ ID NO: 27094 - RNA, 17 nt, Artificial Sequence
  Synthetic
cggaguggaacagccuc

SEQ ID NO: 27095 - RNA, 17 nt, Artificial Sequence
  Synthetic
uggacuuccacggccuc

SEQ ID NO: 27096 - RNA, 17 nt, Artificial Sequence
  Synthetic
uccgcacagguguccuc

SEQ ID NO: 27097 - RNA, 17 nt, Artificial Sequence
  Synthetic
ucgcgggccccgggcuc

SEQ ID NO: 27098 - RNA, 17 nt, Artificial Sequence
  Synthetic
caguugcgcgcgugcuc

SEQ ID NO: 27099 - RNA, 17 nt, Artificial Sequence
  Synthetic
gcgccacccguggucuc

SEQ ID NO: 27100 - RNA, 17 nt, Artificial Sequence
  Synthetic
cacccaagcacagaguc

SEQ ID NO: 27101 - RNA, 17 nt, Artificial Sequence
  Synthetic
ucgcccgaguccgaguc

SEQ ID NO: 27102 - RNA, 17 nt, Artificial Sequence
  Synthetic
gggggcgucggguaguc

SEQ ID NO: 27103 - RNA, 17 nt, Artificial Sequence
  Synthetic
ccgccacguuccccguc

SEQ ID NO: 27104 - RNA, 17 nt, Artificial Sequence
  Synthetic
agcgucgcguccgcguc

SEQ ID NO: 27105 - RNA, 17 nt, Artificial Sequence
  Synthetic
ccgucgccccgcgcguc

SEQ ID NO: 27106 - RNA, 17 nt, Artificial Sequence
  Synthetic
ccgacgcggggggcguc

SEQ ID NO: 27107 - RNA, 17 nt, Artificial Sequence
  Synthetic
ggucugccacagucguc

SEQ ID NO: 27108 - RNA, 17 nt, Artificial Sequence
  Synthetic
gccagggggcgccgguc

SEQ ID NO: 27109 - RNA, 17 nt, Artificial Sequence
  Synthetic
cggccuccacgcggguc

SEQ ID NO: 27110 - RNA, 17 nt, Artificial Sequence
  Synthetic
accgacgcgcgcggguc

SEQ ID NO: 27111 - RNA, 17 nt, Artificial Sequence
  Synthetic
ggggugggaucuggguc

SEQ ID NO: 27112 - RNA, 17 nt, Artificial Sequence
  Synthetic
ccgacccgcgccucuuc

SEQ ID NO: 27113 - RNA, 17 nt, Artificial Sequence
  Synthetic
gcgccggggcgcucuuc

SEQ ID NO: 27114 - RNA, 17 nt, Artificial Sequence
  Synthetic
agggggugggggccaag

SEQ ID NO: 27115 - RNA, 17 nt, Artificial Sequence
  Synthetic
cccgcccgcagaggaag

SEQ ID NO: 27116 - RNA, 17 nt, Artificial Sequence
  Synthetic
cggggcggcggaggaag

SEQ ID NO: 27117 - RNA, 17 nt, Artificial Sequence
  Synthetic
cggcccgcccccggaag

SEQ ID NO: 27118 - RNA, 17 nt, Artificial Sequence
  Synthetic
cgccccucgccccccag

SEQ ID NO: 27119 - RNA, 17 nt, Artificial Sequence
  Synthetic
gugggcgugaccgccag

SEQ ID NO: 27120 - RNA, 17 nt, Artificial Sequence
  Synthetic
gcuccgcggggcgccag

SEQ ID NO: 27121 - RNA, 17 nt, Artificial Sequence
  Synthetic
ccaccggggucauccag

SEQ ID NO: 27122 - RNA, 17 nt, Artificial Sequence
  Synthetic
ccgcggagcagcagcag

SEQ ID NO: 27123 - RNA, 17 nt, Artificial Sequence
  Synthetic
accagccccgcccgcag

SEQ ID NO: 27124 - RNA, 17 nt, Artificial Sequence
  Synthetic
ccccccgccggccgcag

SEQ ID NO: 27125 - RNA, 17 nt, Artificial Sequence
  Synthetic
ggccgcagggggaagag

SEQ ID NO: 27126 - RNA, 17 nt, Artificial Sequence
  Synthetic
ggccgucgugccgagag

SEQ ID NO: 27127 - RNA, 17 nt, Artificial Sequence
  Synthetic
gaggagacaaaggagag

SEQ ID NO: 27128 - RNA, 17 nt, Artificial Sequence
  Synthetic
gcggacgccggggcgag

SEQ ID NO: 27129 - RNA, 17 nt, Artificial Sequence
  Synthetic
acccccuggggggcgag

SEQ ID NO: 27130 - RNA, 17 nt, Artificial Sequence
  Synthetic
ccccccacgccgcggag

SEQ ID NO: 27131 - RNA, 17 nt, Artificial Sequence
  Synthetic
cgccccccgcgucggag

SEQ ID NO: 27132 - RNA, 17 nt, Artificial Sequence
  Synthetic
ggagacgggccacauag

SEQ ID NO: 27133 - RNA, 17 nt, Artificial Sequence
  Synthetic
gguggcguaccugauag

SEQ ID NO: 27134 - RNA, 17 nt, Artificial Sequence
  Synthetic
cacccccgcccgcaacg

SEQ ID NO: 27135 - RNA, 17 nt, Artificial Sequence
  Synthetic
ggaccagacggggaacg

SEQ ID NO: 27136 - RNA, 17 nt, Artificial Sequence
  Synthetic
cgcucgcagacaccacg

SEQ ID NO: 27137 - RNA, 17 nt, Artificial Sequence
  Synthetic
caggaagacgcgccacg

SEQ ID NO: 27138 - RNA, 17 nt, Artificial Sequence
  Synthetic
guccgugccgggccacg

SEQ ID NO: 27139 - RNA, 17 nt, Artificial Sequence
  Synthetic
cgcccccgcgggccacg

SEQ ID NO: 27140 - RNA, 17 nt, Artificial Sequence
  Synthetic
ccgccucggccuccacg

SEQ ID NO: 27141 - RNA, 17 nt, Artificial Sequence
  Synthetic
ggugcggcggcuccacg

SEQ ID NO: 27142 - RNA, 17 nt, Artificial Sequence
  Synthetic
uccccgucugguccacg

SEQ ID NO: 27143 - RNA, 17 nt, Artificial Sequence
  Synthetic
ugaacaagacggucacg

SEQ ID NO: 27144 - RNA, 17 nt, Artificial Sequence
  Synthetic
uccucguggaccagacg

SEQ ID NO: 27145 - RNA, 17 nt, Artificial Sequence
  Synthetic
gcccggcacggacgacg

SEQ ID NO: 27146 - RNA, 17 nt, Artificial Sequence
  Synthetic
cgacggagacgccgacg

SEQ ID NO: 27147 - RNA, 17 nt, Artificial Sequence
  Synthetic
gcuguuccacuccgacg

SEQ ID NO: 27148 - RNA, 17 nt, Artificial Sequence
  Synthetic
ggaagaggcggaggacg

SEQ ID NO: 27149 - RNA, 17 nt, Artificial Sequence
  Synthetic
cuccccagcgccggacg

SEQ ID NO: 27150 - RNA, 17 nt, Artificial Sequence
  Synthetic
gucugcgagcgcggacg

SEQ ID NO: 27151 - RNA, 17 nt, Artificial Sequence
  Synthetic
ccacauaggggccuacg

SEQ ID NO: 27152 - RNA, 17 nt, Artificial Sequence
  Synthetic
gagcauguugcccaccg

SEQ ID NO: 27153 - RNA, 17 nt, Artificial Sequence
  Synthetic
cguggggggcggcaccg

SEQ ID NO: 27154 - RNA, 17 nt, Artificial Sequence
  Synthetic
ugggucaugcgcgaccg

SEQ ID NO: 27155 - RNA, 17 nt, Artificial Sequence
  Synthetic
ggaggcggcggcgaccg

SEQ ID NO: 27156 - RNA, 17 nt, Artificial Sequence
  Synthetic
ucggacucgggcgaccg

SEQ ID NO: 27157 - RNA, 17 nt, Artificial Sequence
  Synthetic
ucuggacgggcaacccg

SEQ ID NO: 27158 - RNA, 17 nt, Artificial Sequence
  Synthetic
uccggucgcgccacccg

SEQ ID NO: 27159 - RNA, 17 nt, Artificial Sequence
  Synthetic
ggugcgggggcgacccg

SEQ ID NO: 27160 - RNA, 17 nt, Artificial Sequence
  Synthetic
cgcggagggaggacccg

SEQ ID NO: 27161 - RNA, 17 nt, Artificial Sequence
  Synthetic
ugucgcccacccccccg

SEQ ID NO: 27162 - RNA, 17 nt, Artificial Sequence
  Synthetic
gcagaccuccccccccg

SEQ ID NO: 27163 - RNA, 17 nt, Artificial Sequence
  Synthetic
ggccggcgacgcccccg

SEQ ID NO: 27164 - RNA, 17 nt, Artificial Sequence
  Synthetic
cgccgccgccgcccccg

SEQ ID NO: 27165 - RNA, 17 nt, Artificial Sequence
  Synthetic
cacuuccucggcccccg

SEQ ID NO: 27166 - RNA, 17 nt, Artificial Sequence
  Synthetic
ggacccggggucccccg

SEQ ID NO: 27167 - RNA, 17 nt, Artificial Sequence
  Synthetic
gucuccgcgccgccccg

SEQ ID NO: 27168 - RNA, 17 nt, Artificial Sequence
  Synthetic
cgcccccuggcgccccg

SEQ ID NO: 27169 - RNA, 17 nt, Artificial Sequence
  Synthetic
gucggacucgggccccg

SEQ ID NO: 27170 - RNA, 17 nt, Artificial Sequence
  Synthetic
gguguccucgggccccg

SEQ ID NO: 27171 - RNA, 17 nt, Artificial Sequence
  Synthetic
gggcggccccgagcccg

SEQ ID NO: 27172 - RNA, 17 nt, Artificial Sequence
  Synthetic
cgggggcgcggcgcccg

SEQ ID NO: 27173 - RNA, 17 nt, Artificial Sequence
  Synthetic
caaaggagagcggcccg

SEQ ID NO: 27174 - RNA, 17 nt, Artificial Sequence
  Synthetic
ccggggcgagcggcccg

SEQ ID NO: 27175 - RNA, 17 nt, Artificial Sequence
  Synthetic
uccccccccggggcccg

SEQ ID NO: 27176 - RNA, 17 nt, Artificial Sequence
  Synthetic
gagcggcccggggcccg

SEQ ID NO: 27177 - RNA, 17 nt, Artificial Sequence
  Synthetic
cuacuccccguggcccg

SEQ ID NO: 27178 - RNA, 17 nt, Artificial Sequence
  Synthetic
ugccgccccccacgccg

SEQ ID NO: 27179 - RNA, 17 nt, Artificial Sequence
  Synthetic
ggugggcgaagacgccg

SEQ ID NO: 27180 - RNA, 17 nt, Artificial Sequence
  Synthetic
ggcgcccgcggacgccg

SEQ ID NO: 27181 - RNA, 17 nt, Artificial Sequence
  Synthetic
ccugcccuccgccgccg

SEQ ID NO: 27182 - RNA, 17 nt, Artificial Sequence
  Synthetic
ccgccgcccccgcgccg

SEQ ID NO: 27183 - RNA, 17 nt, Artificial Sequence
  Synthetic
cccgcgcugcugcgccg

SEQ ID NO: 27184 - RNA, 17 nt, Artificial Sequence
  Synthetic
uccgucgucccaggccg

SEQ ID NO: 27185 - RNA, 17 nt, Artificial Sequence
  Synthetic
ggcggaggacgaggccg

SEQ ID NO: 27186 - RNA, 17 nt, Artificial Sequence
  Synthetic
ggcgcgaccggaggccg

SEQ ID NO: 27187 - RNA, 17 nt, Artificial Sequence
  Synthetic
gacccgcguggaggccg

SEQ ID NO: 27188 - RNA, 17 nt, Artificial Sequence
  Synthetic
gcgggccggcacggccg

SEQ ID NO: 27189 - RNA, 17 nt, Artificial Sequence
  Synthetic
ggaccugcugcgggccg

SEQ ID NO: 27190 - RNA, 17 nt, Artificial Sequence
  Synthetic
gcuccacgcgggggccg

SEQ ID NO: 27191 - RNA, 17 nt, Artificial Sequence
  Synthetic
cugcgccgcgggggccg

SEQ ID NO: 27192 - RNA, 17 nt, Artificial Sequence
  Synthetic
cagcagcgcgggggccg

SEQ ID NO: 27193 - RNA, 17 nt, Artificial Sequence
  Synthetic
cgagcggcccguggccg

SEQ ID NO: 27194 - RNA, 17 nt, Artificial Sequence
  Synthetic
cggggguguuggugccg

SEQ ID NO: 27195 - RNA, 17 nt, Artificial Sequence
  Synthetic
ggccgccgcccccuccg

SEQ ID NO: 27196 - RNA, 17 nt, Artificial Sequence
  Synthetic
ccgcugcugcugcuccg

SEQ ID NO: 27197 - RNA, 17 nt, Artificial Sequence
  Synthetic
gcccgaguccgaguccg

SEQ ID NO: 27198 - RNA, 17 nt, Artificial Sequence
  Synthetic
gagcgcggggccguccg

SEQ ID NO: 27199 - RNA, 17 nt, Artificial Sequence
  Synthetic
gcucgccccggcguccg

SEQ ID NO: 27200 - RNA, 17 nt, Artificial Sequence
  Synthetic
gccuccacgcggguccg

SEQ ID NO: 27201 - RNA, 17 nt, Artificial Sequence
  Synthetic
gacccgcgccucuuccg

SEQ ID NO: 27202 - RNA, 17 nt, Artificial Sequence
  Synthetic
cgggcugggagguuccg

SEQ ID NO: 27203 - RNA, 17 nt, Artificial Sequence
  Synthetic
cccgcggcgcagcagcg

SEQ ID NO: 27204 - RNA, 17 nt, Artificial Sequence
  Synthetic
ggggcgaggggcgagcg

SEQ ID NO: 27205 - RNA, 17 nt, Artificial Sequence
  Synthetic
cguggugucugcgagcg

SEQ ID NO: 27206 - RNA, 17 nt, Artificial Sequence
  Synthetic
cccagcgacagggagcg

SEQ ID NO: 27207 - RNA, 17 nt, Artificial Sequence
  Synthetic
ugcggcggcuccacgcg

SEQ ID NO: 27208 - RNA, 17 nt, Artificial Sequence
  Synthetic
uguuccacuccgacgcg

SEQ ID NO: 27209 - RNA, 17 nt, Artificial Sequence
  Synthetic
ggcggacuccggacgcg

SEQ ID NO: 27210 - RNA, 17 nt, Artificial Sequence
  Synthetic
cgacccccggacccgcg

SEQ ID NO: 27211 - RNA, 17 nt, Artificial Sequence
  Synthetic
cgccgcgcgcccccgcg

SEQ ID NO: 27212 - RNA, 17 nt, Artificial Sequence
  Synthetic
gggccgcggcccccgcg

SEQ ID NO: 27213 - RNA, 17 nt, Artificial Sequence
  Synthetic
cgcgagacagccccgcg

SEQ ID NO: 27214 - RNA, 17 nt, Artificial Sequence
  Synthetic
gcggcccggggcccgcg

SEQ ID NO: 27215 - RNA, 17 nt, Artificial Sequence
  Synthetic
acuccccguggcccgcg

SEQ ID NO: 27216 - RNA, 17 nt, Artificial Sequence
  Synthetic
cgcgcugcugcgccgcg

SEQ ID NO: 27217 - RNA, 17 nt, Artificial Sequence
  Synthetic
cggaggacgaggccgcg

SEQ ID NO: 27218 - RNA, 17 nt, Artificial Sequence
  Synthetic
gcggggcgacggccgcg

SEQ ID NO: 27219 - RNA, 17 nt, Artificial Sequence
  Synthetic
ggggcuccugggccgcg

SEQ ID NO: 27220 - RNA, 17 nt, Artificial Sequence
  Synthetic
gggguguuggugccgcg

SEQ ID NO: 27221 - RNA, 17 nt, Artificial Sequence
  Synthetic
cggggccgcccuccgcg

SEQ ID NO: 27222 - RNA, 17 nt, Artificial Sequence
  Synthetic
gcugcugcugcuccgcg

SEQ ID NO: 27223 - RNA, 17 nt, Artificial Sequence
  Synthetic
cgcggcgcagcagcgcg

SEQ ID NO: 27224 - RNA, 17 nt, Artificial Sequence
  Synthetic
ggcgaggggcgagcgcg

SEQ ID NO: 27225 - RNA, 17 nt, Artificial Sequence
  Synthetic
cagcgacagggagcgcg

SEQ ID NO: 27226 - RNA, 17 nt, Artificial Sequence
  Synthetic
ggcgcgaccgacgcgcg

SEQ ID NO: 27227 - RNA, 17 nt, Artificial Sequence
  Synthetic
cggacuccggacgcgcg

SEQ ID NO: 27228 - RNA, 17 nt, Artificial Sequence
  Synthetic
ggggcgacggccgcgcg

SEQ ID NO: 27229 - RNA, 17 nt, Artificial Sequence
  Synthetic
ggcuccugggccgcgcg

SEQ ID NO: 27230 - RNA, 17 nt, Artificial Sequence
  Synthetic
aagagcgccccggcgcg

SEQ ID NO: 27231 - RNA, 17 nt, Artificial Sequence
  Synthetic
ggggcggcggcggcgcg

SEQ ID NO: 27232 - RNA, 17 nt, Artificial Sequence
  Synthetic
ugcgcgaccggggcgcg

SEQ ID NO: 27233 - RNA, 17 nt, Artificial Sequence
  Synthetic
ggccgcgcgggggcgcg

SEQ ID NO: 27234 - RNA, 17 nt, Artificial Sequence
  Synthetic
gcuaccugcccaucgcg

SEQ ID NO: 27235 - RNA, 17 nt, Artificial Sequence
  Synthetic
cgcggggcugucucgcg

SEQ ID NO: 27236 - RNA, 17 nt, Artificial Sequence
  Synthetic
gggggcgcgcgcaggcg

SEQ ID NO: 27237 - RNA, 17 nt, Artificial Sequence
  Synthetic
cgcccccggaagaggcg

SEQ ID NO: 27238 - RNA, 17 nt, Artificial Sequence
  Synthetic
gcggcgcggagacggcg

SEQ ID NO: 27239 - RNA, 17 nt, Artificial Sequence
  Synthetic
cgaagagcgccccggcg

SEQ ID NO: 27240 - RNA, 17 nt, Artificial Sequence
  Synthetic
gaguccggggcccggcg

SEQ ID NO: 27241 - RNA, 17 nt, Artificial Sequence
  Synthetic
ggcgucgccggccggcg

SEQ ID NO: 27242 - RNA, 17 nt, Artificial Sequence
  Synthetic
ucccccugcggccggcg

SEQ ID NO: 27243 - RNA, 17 nt, Artificial Sequence
  Synthetic
ccgcccccuccgcggcg

SEQ ID NO: 27244 - RNA, 17 nt, Artificial Sequence
  Synthetic
cgggggcggcggcggcg

SEQ ID NO: 27245 - RNA, 17 nt, Artificial Sequence
  Synthetic
cggcacggcgggcggcg

SEQ ID NO: 27246 - RNA, 17 nt, Artificial Sequence
  Synthetic
gggcccgcggggcggcg

SEQ ID NO: 27247 - RNA, 17 nt, Artificial Sequence
  Synthetic
gggugggcgacagggcg

SEQ ID NO: 27248 - RNA, 17 nt, Artificial Sequence
  Synthetic
gucgggagggccgggcg

SEQ ID NO: 27249 - RNA, 17 nt, Artificial Sequence
  Synthetic
cucuuccucugcgggcg

SEQ ID NO: 27250 - RNA, 17 nt, Artificial Sequence
  Synthetic
gcgccccguugcgggcg

SEQ ID NO: 27251 - RNA, 17 nt, Artificial Sequence
  Synthetic
agacgccgacgggggcg

SEQ ID NO: 27252 - RNA, 17 nt, Artificial Sequence
  Synthetic
ccacccccuggggggcg

SEQ ID NO: 27253 - RNA, 17 nt, Artificial Sequence
  Synthetic
gcgggggcggcggugcg

SEQ ID NO: 27254 - RNA, 17 nt, Artificial Sequence
  Synthetic
gcgcuaccugcccaucg

SEQ ID NO: 27255 - RNA, 17 nt, Artificial Sequence
  Synthetic
ggccuacgugguccucg

SEQ ID NO: 27256 - RNA, 17 nt, Artificial Sequence
  Synthetic
cgcgggccccgggcucg

SEQ ID NO: 27257 - RNA, 17 nt, Artificial Sequence
  Synthetic
aguugcgcgcgugcucg

SEQ ID NO: 27258 - RNA, 17 nt, Artificial Sequence
  Synthetic
cgcgcggggcugucucg

SEQ ID NO: 27259 - RNA, 17 nt, Artificial Sequence
  Synthetic
ggggcgucggguagucg

SEQ ID NO: 27260 - RNA, 17 nt, Artificial Sequence
  Synthetic
gggcggcccugccgucg

SEQ ID NO: 27261 - RNA, 17 nt, Artificial Sequence
  Synthetic
gggggucucgagcgucg

SEQ ID NO: 27262 - RNA, 17 nt, Artificial Sequence
  Synthetic
gucugccacagucgucg

SEQ ID NO: 27263 - RNA, 17 nt, Artificial Sequence
  Synthetic
ggccgggcgccgggucg

SEQ ID NO: 27264 - RNA, 17 nt, Artificial Sequence
  Synthetic
gggcgccggucgggucg

SEQ ID NO: 27265 - RNA, 17 nt, Artificial Sequence
  Synthetic
cgccggggcgcucuucg

SEQ ID NO: 27266 - RNA, 17 nt, Artificial Sequence
  Synthetic
gccccucgccccccagg

SEQ ID NO: 27267 - RNA, 17 nt, Artificial Sequence
  Synthetic
cuccgcggggcgccagg

SEQ ID NO: 27268 - RNA, 17 nt, Artificial Sequence
  Synthetic
cccccgccggccgcagg

SEQ ID NO: 27269 - RNA, 17 nt, Artificial Sequence
  Synthetic
gcccgcagaggaagagg

SEQ ID NO: 27270 - RNA, 17 nt, Artificial Sequence
  Synthetic
ggcggcggaggaagagg

SEQ ID NO: 27271 - RNA, 17 nt, Artificial Sequence
  Synthetic
ccgcguggaggccgagg

SEQ ID NO: 27272 - RNA, 17 nt, Artificial Sequence
  Synthetic
ggcggaggaggaggagg

SEQ ID NO: 27273 - RNA, 17 nt, Artificial Sequence
  Synthetic
agaggcggaggaggagg

SEQ ID NO: 27274 - RNA, 17 nt, Artificial Sequence
  Synthetic
ggaggcggaggaggagg

SEQ ID NO: 27275 - RNA, 17 nt, Artificial Sequence
  Synthetic
ggaagaggcggaggagg

SEQ ID NO: 27276 - RNA, 17 nt, Artificial Sequence
  Synthetic
ggaggaggcggaggagg

SEQ ID NO: 27277 - RNA, 17 nt, Artificial Sequence
  Synthetic
caccugugcggaggagg

SEQ ID NO: 27278 - RNA, 17 nt, Artificial Sequence
  Synthetic
cccccacgccgcggagg

SEQ ID NO: 27279 - RNA, 17 nt, Artificial Sequence
  Synthetic
agaggaagaggcggagg

SEQ ID NO: 27280 - RNA, 17 nt, Artificial Sequence
  Synthetic
ggaggaggaggcggagg

SEQ ID NO: 27281 - RNA, 17 nt, Artificial Sequence
  Synthetic
ggacaccugugcggagg

SEQ ID NO: 27282 - RNA, 17 nt, Artificial Sequence
  Synthetic
gcucgcagacaccacgg

SEQ ID NO: 27283 - RNA, 17 nt, Artificial Sequence
  Synthetic
uccgugccgggccacgg

SEQ ID NO: 27284 - RNA, 17 nt, Artificial Sequence
  Synthetic
cgcguccaccggcacgg

SEQ ID NO: 27285 - RNA, 17 nt, Artificial Sequence
  Synthetic
gaacaagacggucacgg

SEQ ID NO: 27286 - RNA, 17 nt, Artificial Sequence
  Synthetic
gggcggcgcggagacgg

SEQ ID NO: 27287 - RNA, 17 nt, Artificial Sequence
  Synthetic
gacggagacgccgacgg

SEQ ID NO: 27288 - RNA, 17 nt, Artificial Sequence
  Synthetic
guggggggcggcaccgg

SEQ ID NO: 27289 - RNA, 17 nt, Artificial Sequence
  Synthetic
acggguggcgcgaccgg

SEQ ID NO: 27290 - RNA, 17 nt, Artificial Sequence
  Synthetic
ccucuggaugaccccgg

SEQ ID NO: 27291 - RNA, 17 nt, Artificial Sequence
  Synthetic
guguccucgggccccgg

SEQ ID NO: 27292 - RNA, 17 nt, Artificial Sequence
  Synthetic
cuucccccugcggccgg

SEQ ID NO: 27293 - RNA, 17 nt, Artificial Sequence
  Synthetic
gccgcccgccgugccgg

SEQ ID NO: 27294 - RNA, 17 nt, Artificial Sequence
  Synthetic
ccuccacgcggguccgg

SEQ ID NO: 27295 - RNA, 17 nt, Artificial Sequence
  Synthetic
acccgcgccucuuccgg

SEQ ID NO: 27296 - RNA, 17 nt, Artificial Sequence
  Synthetic
cggagcagcagcagcgg

SEQ ID NO: 27297 - RNA, 17 nt, Artificial Sequence
  Synthetic
gaagacgcgccacgcgg

SEQ ID NO: 27298 - RNA, 17 nt, Artificial Sequence
  Synthetic
gcggcggcuccacgcgg

SEQ ID NO: 27299 - RNA, 17 nt, Artificial Sequence
  Synthetic
guuccacuccgacgcgg

SEQ ID NO: 27300 - RNA, 17 nt, Artificial Sequence
  Synthetic
cuccccguggcccgcgg

SEQ ID NO: 27301 - RNA, 17 nt, Artificial Sequence
  Synthetic
cgccccccacgccgcgg

SEQ ID NO: 27302 - RNA, 17 nt, Artificial Sequence
  Synthetic
gggcgaagacgccgcgg

SEQ ID NO: 27303 - RNA, 17 nt, Artificial Sequence
  Synthetic
gcgcugcugcgccgcgg

SEQ ID NO: 27304 - RNA, 17 nt, Artificial Sequence
  Synthetic
ggguguuggugccgcgg

SEQ ID NO: 27305 - RNA, 17 nt, Artificial Sequence
  Synthetic
gcggcgcagcagcgcgg

SEQ ID NO: 27306 - RNA, 17 nt, Artificial Sequence
  Synthetic
gggcgacggccgcgcgg

SEQ ID NO: 27307 - RNA, 17 nt, Artificial Sequence
  Synthetic
ggcgcgcgcaggcgcgg

SEQ ID NO: 27308 - RNA, 17 nt, Artificial Sequence
  Synthetic
agagcgccccggcgcgg

SEQ ID NO: 27309 - RNA, 17 nt, Artificial Sequence
  Synthetic
gggagggccgggcgcgg

SEQ ID NO: 27310 - RNA, 17 nt, Artificial Sequence
  Synthetic
cuaccugcccaucgcgg

SEQ ID NO: 27311 - RNA, 17 nt, Artificial Sequence
  Synthetic
gcggggcugucucgcgg

SEQ ID NO: 27312 - RNA, 17 nt, Artificial Sequence
  Synthetic
cgccggucgggucgcgg

SEQ ID NO: 27313 - RNA, 17 nt, Artificial Sequence
  Synthetic
cgcagaggaagaggcgg

SEQ ID NO: 27314 - RNA, 17 nt, Artificial Sequence
  Synthetic
ggcggaggaagaggcgg

SEQ ID NO: 27315 - RNA, 17 nt, Artificial Sequence
  Synthetic
ggaggaggaggaggcgg

SEQ ID NO: 27316 - RNA, 17 nt, Artificial Sequence
  Synthetic
cggcgcggagacggcgg

SEQ ID NO: 27317 - RNA, 17 nt, Artificial Sequence
  Synthetic
cccccugcggccggcgg

SEQ ID NO: 27318 - RNA, 17 nt, Artificial Sequence
  Synthetic
cgaagacgccgcggcgg

SEQ ID NO: 27319 - RNA, 17 nt, Artificial Sequence
  Synthetic
agacgccgcggcggcgg

SEQ ID NO: 27320 - RNA, 17 nt, Artificial Sequence
  Synthetic
cgagcgcggggcggcgg

SEQ ID NO: 27321 - RNA, 17 nt, Artificial Sequence
  Synthetic
caccacgggggcggcgg

SEQ ID NO: 27322 - RNA, 17 nt, Artificial Sequence
  Synthetic
cgccccguugcgggcgg

SEQ ID NO: 27323 - RNA, 17 nt, Artificial Sequence
  Synthetic
gggcgagcgcggggcgg

SEQ ID NO: 27324 - RNA, 17 nt, Artificial Sequence
  Synthetic
cgccgcggagggggcgg

SEQ ID NO: 27325 - RNA, 17 nt, Artificial Sequence
  Synthetic
agacaccacgggggcgg

SEQ ID NO: 27326 - RNA, 17 nt, Artificial Sequence
  Synthetic
ccccggcgcgggggcgg

SEQ ID NO: 27327 - RNA, 17 nt, Artificial Sequence
  Synthetic
cgggggcggcggugcgg

SEQ ID NO: 27328 - RNA, 17 nt, Artificial Sequence
  Synthetic
cggggagcagggugcgg

SEQ ID NO: 27329 - RNA, 17 nt, Artificial Sequence
  Synthetic
cgaggacaccugugcgg

SEQ ID NO: 27330 - RNA, 17 nt, Artificial Sequence
  Synthetic
gggcgucggguagucgg

SEQ ID NO: 27331 - RNA, 17 nt, Artificial Sequence
  Synthetic
gccggggcgcucuucgg

SEQ ID NO: 27332 - RNA, 17 nt, Artificial Sequence
  Synthetic
ggugggggccaagaggg

SEQ ID NO: 27333 - RNA, 17 nt, Artificial Sequence
  Synthetic
agcgcgggggccgaggg

SEQ ID NO: 27334 - RNA, 17 nt, Artificial Sequence
  Synthetic
acgcgccacgcggaggg

SEQ ID NO: 27335 - RNA, 17 nt, Artificial Sequence
  Synthetic
gggccgggcgcggaggg

SEQ ID NO: 27336 - RNA, 17 nt, Artificial Sequence
  Synthetic
gcucccgagaccacggg

SEQ ID NO: 27337 - RNA, 17 nt, Artificial Sequence
  Synthetic
ccgugccgggccacggg

SEQ ID NO: 27338 - RNA, 17 nt, Artificial Sequence
  Synthetic
uguccucgggccccggg

SEQ ID NO: 27339 - RNA, 17 nt, Artificial Sequence
  Synthetic
uuccacuccgacgcggg

SEQ ID NO: 27340 - RNA, 17 nt, Artificial Sequence
  Synthetic
cggggcugucucgcggg

SEQ ID NO: 27341 - RNA, 17 nt, Artificial Sequence
  Synthetic
uccaccggcacggcggg

SEQ ID NO: 27342 - RNA, 17 nt, Artificial Sequence
  Synthetic
ccccugcggccggcggg

SEQ ID NO: 27343 - RNA, 17 nt, Artificial Sequence
  Synthetic
cgcgcaggcgcggcggg

SEQ ID NO: 27344 - RNA, 17 nt, Artificial Sequence
  Synthetic
gcucuucggggggcggg

SEQ ID NO: 27345 - RNA, 17 nt, Artificial Sequence
  Synthetic
gccucuuccucugcggg

SEQ ID NO: 27346 - RNA, 17 nt, Artificial Sequence
  Synthetic
cggcgccccguugcggg

SEQ ID NO: 27347 - RNA, 17 nt, Artificial Sequence
  Synthetic
ggcgucggguagucggg

SEQ ID NO: 27348 - RNA, 17 nt, Artificial Sequence
  Synthetic
gacgcgcgcgggucggg

SEQ ID NO: 27349 - RNA, 17 nt, Artificial Sequence
  Synthetic
ccggggcgcucuucggg

SEQ ID NO: 27350 - RNA, 17 nt, Artificial Sequence
  Synthetic
cgugccgggccacgggg

SEQ ID NO: 27351 - RNA, 17 nt, Artificial Sequence
  Synthetic
guccucgggccccgggg

SEQ ID NO: 27352 - RNA, 17 nt, Artificial Sequence
  Synthetic
gcccggggcccgcgggg

SEQ ID NO: 27353 - RNA, 17 nt, Artificial Sequence
  Synthetic
gaggggcgagcgcgggg

SEQ ID NO: 27354 - RNA, 17 nt, Artificial Sequence
  Synthetic
gcggcggcggcgcgggg

SEQ ID NO: 27355 - RNA, 17 nt, Artificial Sequence
  Synthetic
ccucgccccccaggggg

SEQ ID NO: 27356 - RNA, 17 nt, Artificial Sequence
  Synthetic
ccacgccgcggaggggg

SEQ ID NO: 27357 - RNA, 17 nt, Artificial Sequence
  Synthetic
cgcagacaccacggggg

SEQ ID NO: 27358 - RNA, 17 nt, Artificial Sequence
  Synthetic
uccucgggccccggggg

SEQ ID NO: 27359 - RNA, 17 nt, Artificial Sequence
  Synthetic
cgcgccucuuccggggg

SEQ ID NO: 27360 - RNA, 17 nt, Artificial Sequence
  Synthetic
gcgccccggcgcggggg

SEQ ID NO: 27361 - RNA, 17 nt, Artificial Sequence
  Synthetic
cccguugcgggcggggg

SEQ ID NO: 27362 - RNA, 17 nt, Artificial Sequence
  Synthetic
gggcgcucuucgggggg

SEQ ID NO: 27363 - RNA, 17 nt, Artificial Sequence
  Synthetic
gccgggccacggggggg

SEQ ID NO: 27364 - RNA, 17 nt, Artificial Sequence
  Synthetic
ucgggccccgggggggg

SEQ ID NO: 27365 - RNA, 17 nt, Artificial Sequence
  Synthetic
cuccgcggcgugggggg

SEQ ID NO: 27366 - RNA, 17 nt, Artificial Sequence
  Synthetic
ggaucugggucuggggg

SEQ ID NO: 27367 - RNA, 17 nt, Artificial Sequence
  Synthetic
ucgcugaugacuauggg

SEQ ID NO: 27368 - RNA, 17 nt, Artificial Sequence
  Synthetic
ggcccccacccccuggg

SEQ ID NO: 27369 - RNA, 17 nt, Artificial Sequence
  Synthetic
cgcucccugucgcuggg

SEQ ID NO: 27370 - RNA, 17 nt, Artificial Sequence
  Synthetic
ggucgcggcgggcuggg

SEQ ID NO: 27371 - RNA, 17 nt, Artificial Sequence
  Synthetic
ccccuccgcggcguggg

SEQ ID NO: 27372 - RNA, 17 nt, Artificial Sequence
  Synthetic
gucgcugaugacuaugg

SEQ ID NO: 27373 - RNA, 17 nt, Artificial Sequence
  Synthetic
ugaccagggcacccugg

SEQ ID NO: 27374 - RNA, 17 nt, Artificial Sequence
  Synthetic
uggcccccacccccugg

SEQ ID NO: 27375 - RNA, 17 nt, Artificial Sequence
  Synthetic
gcugaacgacccgcugg

SEQ ID NO: 27376 - RNA, 17 nt, Artificial Sequence
  Synthetic
gcgcucccugucgcugg

SEQ ID NO: 27377 - RNA, 17 nt, Artificial Sequence
  Synthetic
ucugcgggcggggcugg

SEQ ID NO: 27378 - RNA, 17 nt, Artificial Sequence
  Synthetic
gugggaucugggucugg

SEQ ID NO: 27379 - RNA, 17 nt, Artificial Sequence
  Synthetic
ccagacggggaacgugg

SEQ ID NO: 27380 - RNA, 17 nt, Artificial Sequence
  Synthetic
cccccggacccgcgugg

SEQ ID NO: 27381 - RNA, 17 nt, Artificial Sequence
  Synthetic
cccccuccgcggcgugg

SEQ ID NO: 27382 - RNA, 17 nt, Artificial Sequence
  Synthetic
cgccccccagggggugg

SEQ ID NO: 27383 - RNA, 17 nt, Artificial Sequence
  Synthetic
agucgcugaugacuaug

SEQ ID NO: 27384 - RNA, 17 nt, Artificial Sequence
  Synthetic
ccacguaggccccuaug

SEQ ID NO: 27385 - RNA, 17 nt, Artificial Sequence
  Synthetic
gcgcgccccgacgacug

SEQ ID NO: 27386 - RNA, 17 nt, Artificial Sequence
  Synthetic
uuggcccccacccccug

SEQ ID NO: 27387 - RNA, 17 nt, Artificial Sequence
  Synthetic
ggccucucuucccccug

SEQ ID NO: 27388 - RNA, 17 nt, Artificial Sequence
  Synthetic
guccgcguccggcgcug

SEQ ID NO: 27389 - RNA, 17 nt, Artificial Sequence
  Synthetic
cgcgcucccugucgcug

SEQ ID NO: 27390 - RNA, 17 nt, Artificial Sequence
  Synthetic
acguggcggaccugcug

SEQ ID NO: 27391 - RNA, 17 nt, Artificial Sequence
  Synthetic
cuccgccucuuccucug

SEQ ID NO: 27392 - RNA, 17 nt, Artificial Sequence
  Synthetic
ggugggaucugggucug

SEQ ID NO: 27393 - RNA, 17 nt, Artificial Sequence
  Synthetic
aggccgaggcggccgug

SEQ ID NO: 27394 - RNA, 17 nt, Artificial Sequence
  Synthetic
ugggcagguagcgcgug

SEQ ID NO: 27395 - RNA, 17 nt, Artificial Sequence
  Synthetic
gcccccuccgcggcgug

SEQ ID NO: 27396 - RNA, 17 nt, Artificial Sequence
  Synthetic
acgcgcgcaacugcgug

SEQ ID NO: 27397 - RNA, 17 nt, Artificial Sequence
  Synthetic
gcgcgggggcggcggug

SEQ ID NO: 27398 - RNA, 17 nt, Artificial Sequence
  Synthetic
gcucggggagcagggug

SEQ ID NO: 27399 - RNA, 17 nt, Artificial Sequence
  Synthetic
ucgccccccagggggug

SEQ ID NO: 27400 - RNA, 17 nt, Artificial Sequence
  Synthetic
gcccgaggacaccugug

SEQ ID NO: 27401 - RNA, 17 nt, Artificial Sequence
  Synthetic
gcggcggcgccccguug

SEQ ID NO: 27402 - RNA, 17 nt, Artificial Sequence
  Synthetic
auggagacgggccacau

SEQ ID NO: 27403 - RNA, 17 nt, Artificial Sequence
  Synthetic
cucgagacccccgcgau

SEQ ID NO: 27404 - RNA, 17 nt, Artificial Sequence
  Synthetic
cgggggucguucacuau

SEQ ID NO: 27405 - RNA, 17 nt, Artificial Sequence
  Synthetic
gagucgcugaugacuau

SEQ ID NO: 27406 - RNA, 17 nt, Artificial Sequence
  Synthetic
gcgccgggccccggacu

SEQ ID NO: 27407 - RNA, 17 nt, Artificial Sequence
  Synthetic
ggccccggacucggacu

SEQ ID NO: 27408 - RNA, 17 nt, Artificial Sequence
  Synthetic
gaggcgcgggucggacu

SEQ ID NO: 27409 - RNA, 17 nt, Artificial Sequence
  Synthetic
cuuggcccccacccccu

SEQ ID NO: 27410 - RNA, 17 nt, Artificial Sequence
  Synthetic
agacgagaaaccucccu

SEQ ID NO: 27411 - RNA, 17 nt, Artificial Sequence
  Synthetic
ggugucggucugagccu

SEQ ID NO: 27412 - RNA, 17 nt, Artificial Sequence
  Synthetic
ggcccgcacggccgccu

SEQ ID NO: 27413 - RNA, 17 nt, Artificial Sequence
  Synthetic
ggcggcgaccgcggccu

SEQ ID NO: 27414 - RNA, 17 nt, Artificial Sequence
  Synthetic
gacuauggggggcuccu

SEQ ID NO: 27415 - RNA, 17 nt, Artificial Sequence
  Synthetic
cuccgcacagguguccu

SEQ ID NO: 27416 - RNA, 17 nt, Artificial Sequence
  Synthetic
uuccuggcacacuuccu

SEQ ID NO: 27417 - RNA, 17 nt, Artificial Sequence
  Synthetic
cguccgcguccggcgcu

SEQ ID NO: 27418 - RNA, 17 nt, Artificial Sequence
  Synthetic
ccgcgcucccugucgcu

SEQ ID NO: 27419 - RNA, 17 nt, Artificial Sequence
  Synthetic
gucgcgggccccgggcu

SEQ ID NO: 27420 - RNA, 17 nt, Artificial Sequence
  Synthetic
ucgggucgcggcgggcu

SEQ ID NO: 27421 - RNA, 17 nt, Artificial Sequence
  Synthetic
gcaguugcgcgcgugcu

SEQ ID NO: 27422 - RNA, 17 nt, Artificial Sequence
  Synthetic
ggcccagacucugugcu

SEQ ID NO: 27423 - RNA, 17 nt, Artificial Sequence
  Synthetic
gggcgggggugggaucu

SEQ ID NO: 27424 - RNA, 17 nt, Artificial Sequence
  Synthetic
ggaagagaggccacucu

SEQ ID NO: 27425 - RNA, 17 nt, Artificial Sequence
  Synthetic
gcgcggcgccgcccucu

SEQ ID NO: 27426 - RNA, 17 nt, Artificial Sequence
  Synthetic
acccaagcacagagucu

SEQ ID NO: 27427 - RNA, 17 nt, Artificial Sequence
  Synthetic
gggugggaucugggucu

SEQ ID NO: 27428 - RNA, 17 nt, Artificial Sequence
  Synthetic
cgcgccacccguggucu

SEQ ID NO: 27429 - RNA, 17 nt, Artificial Sequence
  Synthetic
guggcguaccugauagu

SEQ ID NO: 27430 - RNA, 17 nt, Artificial Sequence
  Synthetic
ggggggcgucggguagu

SEQ ID NO: 27431 - RNA, 17 nt, Artificial Sequence
  Synthetic
guccacgaggaccacgu

SEQ ID NO: 27432 - RNA, 17 nt, Artificial Sequence
  Synthetic
gggcgccgcgcccccgu

SEQ ID NO: 27433 - RNA, 17 nt, Artificial Sequence
  Synthetic
cccgacgccccccgcgu

SEQ ID NO: 27434 - RNA, 17 nt, Artificial Sequence
  Synthetic
ucccgacccgcgcgcgu

SEQ ID NO: 27435 - RNA, 17 nt, Artificial Sequence
  Synthetic
cgcccccuccgcggcgu

SEQ ID NO: 27436 - RNA, 17 nt, Artificial Sequence
  Synthetic
uccgacgcggggggcgu

SEQ ID NO: 27437 - RNA, 17 nt, Artificial Sequence
  Synthetic
aggucugccacagucgu

SEQ ID NO: 27438 - RNA, 17 nt, Artificial Sequence
  Synthetic
cucuggaugaccccggu

SEQ ID NO: 27439 - RNA, 17 nt, Artificial Sequence
  Synthetic
cgccagggggcgccggu

SEQ ID NO: 27440 - RNA, 17 nt, Artificial Sequence
  Synthetic
gaccgacgcgcgcgggu

SEQ ID NO: 27441 - RNA, 17 nt, Artificial Sequence
  Synthetic
ccggaagaggcgcgggu

SEQ ID NO: 27442 - RNA, 17 nt, Artificial Sequence
  Synthetic
gcgcaggcgcggcgggu

SEQ ID NO: 27443 - RNA, 17 nt, Artificial Sequence
  Synthetic
cucgccccccagggggu

SEQ ID NO: 27444 - RNA, 17 nt, Artificial Sequence
  Synthetic
ccguugcgggcgggggu

SEQ ID NO: 27445 - RNA, 17 nt, Artificial Sequence
  Synthetic
ccgggccacgggggggu

SEQ ID NO: 27446 - RNA, 17 nt, Artificial Sequence
  Synthetic
gaccagggcacccuggu

SEQ ID NO: 27447 - RNA, 17 nt, Artificial Sequence
  Synthetic
cugcgggcggggcuggu

SEQ ID NO: 27448 - RNA, 17 nt, Artificial Sequence
  Synthetic
ggcggcaccgggggugu

SEQ ID NO: 27449 - RNA, 17 nt, Artificial Sequence
  Synthetic
acucugugcuugggugu

SEQ ID NO: 27450 - RNA, 17 nt, Artificial Sequence
  Synthetic
gcccagacucugugcuu

SEQ ID NO: 27451 - RNA, 17 nt, Artificial Sequence
  Synthetic
cgcgccggggcgcucuu

SEQ ID NO: 27452 - RNA, 20 nt, Artificial Sequence
  Synthetic
ugcggaggaggaggagacaa

SEQ ID NO: 27453 - RNA, 20 nt, Artificial Sequence
  Synthetic
gaucccacccccgcccgcaa

SEQ ID NO: 27454 - RNA, 20 nt, Artificial Sequence
  Synthetic
ccugucgcuggggggacaca

SEQ ID NO: 27455 - RNA, 20 nt, Artificial Sequence
  Synthetic
cguguguccccccagcgaca

SEQ ID NO: 27456 - RNA, 20 nt, Artificial Sequence
  Synthetic
ccacgggggggugggcgaca

SEQ ID NO: 27457 - RNA, 20 nt, Artificial Sequence
  Synthetic
cugccugcccguccuggaca

SEQ ID NO: 27458 - RNA, 20 nt, Artificial Sequence
  Synthetic
guccgcgcucgcagacacca

SEQ ID NO: 27459 - RNA, 20 nt, Artificial Sequence
  Synthetic
gaaguccagcgcgcccacca

SEQ ID NO: 27460 - RNA, 20 nt, Artificial Sequence
  Synthetic
gcgcccugcucccgagacca

SEQ ID NO: 27461 - RNA, 20 nt, Artificial Sequence
  Synthetic
ggcaacaugcucuuugacca

SEQ ID NO: 27462 - RNA, 20 nt, Artificial Sequence
  Synthetic
cgcucgccccucgcccccca

SEQ ID NO: 27463 - RNA, 20 nt, Artificial Sequence
  Synthetic
cuuguucacguaaggcgcca

SEQ ID NO: 27464 - RNA, 20 nt, Artificial Sequence
  Synthetic
ugcugcuccgcggggcgcca

SEQ ID NO: 27465 - RNA, 20 nt, Artificial Sequence
  Synthetic
gacucgggcgaccgcggcca

SEQ ID NO: 27466 - RNA, 20 nt, Artificial Sequence
  Synthetic
ucgucguccgugccgggcca

SEQ ID NO: 27467 - RNA, 20 nt, Artificial Sequence
  Synthetic
ggcgacgcccccgcgggcca

SEQ ID NO: 27468 - RNA, 20 nt, Artificial Sequence
  Synthetic
gcccguccagauaaagucca

SEQ ID NO: 27469 - RNA, 20 nt, Artificial Sequence
  Synthetic
gugggcgcgcuggacuucca

SEQ ID NO: 27470 - RNA, 20 nt, Artificial Sequence
  Synthetic
cacccguggucucgggagca

SEQ ID NO: 27471 - RNA, 20 nt, Artificial Sequence
  Synthetic
gcgcgcgugcucggggagca

SEQ ID NO: 27472 - RNA, 20 nt, Artificial Sequence
  Synthetic
cacggccgugccggcccgca

SEQ ID NO: 27473 - RNA, 20 nt, Artificial Sequence
  Synthetic
cgcgccccccgccggccgca

SEQ ID NO: 27474 - RNA, 20 nt, Artificial Sequence
  Synthetic
gcacgacggccgcgacggca

SEQ ID NO: 27475 - RNA, 20 nt, Artificial Sequence
  Synthetic
gcggugcgcguccaccggca

SEQ ID NO: 27476 - RNA, 20 nt, Artificial Sequence
  Synthetic
cacccccccguggcccggca

SEQ ID NO: 27477 - RNA, 20 nt, Artificial Sequence
  Synthetic
ggcggccgugcgggccggca

SEQ ID NO: 27478 - RNA, 20 nt, Artificial Sequence
  Synthetic
uuacgugaacaagacgguca

SEQ ID NO: 27479 - RNA, 20 nt, Artificial Sequence
  Synthetic
ggcgccuuacgugaacaaga

SEQ ID NO: 27480 - RNA, 20 nt, Artificial Sequence
  Synthetic
ccagggggugggggccaaga

SEQ ID NO: 27481 - RNA, 20 nt, Artificial Sequence
  Synthetic
cgugguccucguggaccaga

SEQ ID NO: 27482 - RNA, 20 nt, Artificial Sequence
  Synthetic
cccgcggggcggcgcggaga

SEQ ID NO: 27483 - RNA, 20 nt, Artificial Sequence
  Synthetic
gcccguccuggacauggaga

SEQ ID NO: 27484 - RNA, 20 nt, Artificial Sequence
  Synthetic
agaggccacucucggcacga

SEQ ID NO: 27485 - RNA, 20 nt, Artificial Sequence
  Synthetic
gcgaccgcggccugggacga

SEQ ID NO: 27486 - RNA, 20 nt, Artificial Sequence
  Synthetic
ugggacgacggagacgccga

SEQ ID NO: 27487 - RNA, 20 nt, Artificial Sequence
  Synthetic
cgcagcagcgcgggggccga

SEQ ID NO: 27488 - RNA, 20 nt, Artificial Sequence
  Synthetic
gacgcucgagacccccgcga

SEQ ID NO: 27489 - RNA, 20 nt, Artificial Sequence
  Synthetic
ucucggcacgacggccgcga

SEQ ID NO: 27490 - RNA, 20 nt, Artificial Sequence
  Synthetic
acuccggacgcgcggggcga

SEQ ID NO: 27491 - RNA, 20 nt, Artificial Sequence
  Synthetic
ccccacccccuggggggcga

SEQ ID NO: 27492 - RNA, 20 nt, Artificial Sequence
  Synthetic
gcccgucuccauguccagga

SEQ ID NO: 27493 - RNA, 20 nt, Artificial Sequence
  Synthetic
aggaagacgcgccacgcgga

SEQ ID NO: 27494 - RNA, 20 nt, Artificial Sequence
  Synthetic
cuggacgggcaacccgcgga

SEQ ID NO: 27495 - RNA, 20 nt, Artificial Sequence
  Synthetic
gccgccccccacgccgcgga

SEQ ID NO: 27496 - RNA, 20 nt, Artificial Sequence
  Synthetic
ucgggagggccgggcgcgga

SEQ ID NO: 27497 - RNA, 20 nt, Artificial Sequence
  Synthetic
gaagacgccgcggcggcgga

SEQ ID NO: 27498 - RNA, 20 nt, Artificial Sequence
  Synthetic
ggggucguucacuaucggga

SEQ ID NO: 27499 - RNA, 20 nt, Artificial Sequence
  Synthetic
ccgacgcgcgcgggucggga

SEQ ID NO: 27500 - RNA, 20 nt, Artificial Sequence
  Synthetic
ggccguggacuuuaucugga

SEQ ID NO: 27501 - RNA, 20 nt, Artificial Sequence
  Synthetic
acauggagacgggccacaua

SEQ ID NO: 27502 - RNA, 20 nt, Artificial Sequence
  Synthetic
gggagagucgcugaugacua

SEQ ID NO: 27503 - RNA, 20 nt, Artificial Sequence
  Synthetic
gugaccgucuuguucacgua

SEQ ID NO: 27504 - RNA, 20 nt, Artificial Sequence
  Synthetic
aucccacccccgcccgcaac

SEQ ID NO: 27505 - RNA, 20 nt, Artificial Sequence
  Synthetic
uccgcgcucgcagacaccac

SEQ ID NO: 27506 - RNA, 20 nt, Artificial Sequence
  Synthetic
cgcccugcucccgagaccac

SEQ ID NO: 27507 - RNA, 20 nt, Artificial Sequence
  Synthetic
ucaaagagcauguugcccac

SEQ ID NO: 27508 - RNA, 20 nt, Artificial Sequence
  Synthetic
cccacuaucagguacgccac

SEQ ID NO: 27509 - RNA, 20 nt, Artificial Sequence
  Synthetic
acucgggcgaccgcggccac

SEQ ID NO: 27510 - RNA, 20 nt, Artificial Sequence
  Synthetic
cgucguccgugccgggccac

SEQ ID NO: 27511 - RNA, 20 nt, Artificial Sequence
  Synthetic
gcgacgcccccgcgggccac

SEQ ID NO: 27512 - RNA, 20 nt, Artificial Sequence
  Synthetic
ggcgcgcggugcgcguccac

SEQ ID NO: 27513 - RNA, 20 nt, Artificial Sequence
  Synthetic
ugucuccuccuccuccgcac

SEQ ID NO: 27514 - RNA, 20 nt, Artificial Sequence
  Synthetic
cgcggcguggggggcggcac

SEQ ID NO: 27515 - RNA, 20 nt, Artificial Sequence
  Synthetic
uacgugaacaagacggucac

SEQ ID NO: 27516 - RNA, 20 nt, Artificial Sequence
  Synthetic
gugguccucguggaccagac

SEQ ID NO: 27517 - RNA, 20 nt, Artificial Sequence
  Synthetic
cccguccuggacauggagac

SEQ ID NO: 27518 - RNA, 20 nt, Artificial Sequence
  Synthetic
ccagcccgccgcgacccgac

SEQ ID NO: 27519 - RNA, 20 nt, Artificial Sequence
  Synthetic
gggacgacggagacgccgac

SEQ ID NO: 27520 - RNA, 20 nt, Artificial Sequence
  Synthetic
ccguguguccccccagcgac

SEQ ID NO: 27521 - RNA, 20 nt, Artificial Sequence
  Synthetic
gagaccacggguggcgcgac

SEQ ID NO: 27522 - RNA, 20 nt, Artificial Sequence
  Synthetic
gagccugggucaugcgcgac

SEQ ID NO: 27523 - RNA, 20 nt, Artificial Sequence
  Synthetic
gccacgggggggugggcgac

SEQ ID NO: 27524 - RNA, 20 nt, Artificial Sequence
  Synthetic
cccgucuccauguccaggac

SEQ ID NO: 27525 - RNA, 20 nt, Artificial Sequence
  Synthetic
gccguggacuuuaucuggac

SEQ ID NO: 27526 - RNA, 20 nt, Artificial Sequence
  Synthetic
ggaaguccagcgcgcccacc

SEQ ID NO: 27527 - RNA, 20 nt, Artificial Sequence
  Synthetic
caaagagcauguugcccacc

SEQ ID NO: 27528 - RNA, 20 nt, Artificial Sequence
  Synthetic
ccacuaucagguacgccacc

SEQ ID NO: 27529 - RNA, 20 nt, Artificial Sequence
  Synthetic
gcggcguggggggcggcacc

SEQ ID NO: 27530 - RNA, 20 nt, Artificial Sequence
  Synthetic
cgagcccggggcccgcgacc

SEQ ID NO: 27531 - RNA, 20 nt, Artificial Sequence
  Synthetic
agccugggucaugcgcgacc

SEQ ID NO: 27532 - RNA, 20 nt, Artificial Sequence
  Synthetic
ccgggcgcggagggaggacc

SEQ ID NO: 27533 - RNA, 20 nt, Artificial Sequence
  Synthetic
ggacgacgaggacgaugacc

SEQ ID NO: 27534 - RNA, 20 nt, Artificial Sequence
  Synthetic
gggcaacaugcucuuugacc

SEQ ID NO: 27535 - RNA, 20 nt, Artificial Sequence
  Synthetic
gcucuuugaccagggcaccc

SEQ ID NO: 27536 - RNA, 20 nt, Artificial Sequence
  Synthetic
cgggcgcggagggaggaccc

SEQ ID NO: 27537 - RNA, 20 nt, Artificial Sequence
  Synthetic
guuggugccgcgggggaccc

SEQ ID NO: 27538 - RNA, 20 nt, Artificial Sequence
  Synthetic
gccccggucgcgcaugaccc

SEQ ID NO: 27539 - RNA, 20 nt, Artificial Sequence
  Synthetic
gaacagccucuggaugaccc

SEQ ID NO: 27540 - RNA, 20 nt, Artificial Sequence
  Synthetic
ccccgcggcaccaacacccc

SEQ ID NO: 27541 - RNA, 20 nt, Artificial Sequence
  Synthetic
ucccgauagugaacgacccc

SEQ ID NO: 27542 - RNA, 20 nt, Artificial Sequence
  Synthetic
uuggugccgcgggggacccc

SEQ ID NO: 27543 - RNA, 20 nt, Artificial Sequence
  Synthetic
cccucuuggcccccaccccc

SEQ ID NO: 27544 - RNA, 20 nt, Artificial Sequence
  Synthetic
uguggcagaccucccccccc

SEQ ID NO: 27545 - RNA, 20 nt, Artificial Sequence
  Synthetic
cuguggcagaccuccccccc

SEQ ID NO: 27546 - RNA, 20 nt, Artificial Sequence
  Synthetic
gcgcucgccccucgcccccc

SEQ ID NO: 27547 - RNA, 20 nt, Artificial Sequence
  Synthetic
gcgacccgaccggcgccccc

SEQ ID NO: 27548 - RNA, 20 nt, Artificial Sequence
  Synthetic
agggggcggcggcccgcccc

SEQ ID NO: 27549 - RNA, 20 nt, Artificial Sequence
  Synthetic
cgcgccgccccgcgggcccc

SEQ ID NO: 27550 - RNA, 20 nt, Artificial Sequence
  Synthetic
ggcgccgggucgcgggcccc

SEQ ID NO: 27551 - RNA, 20 nt, Artificial Sequence
  Synthetic
cacagguguccucgggcccc

SEQ ID NO: 27552 - RNA, 20 nt, Artificial Sequence
  Synthetic
cggagggcggccccgagccc

SEQ ID NO: 27553 - RNA, 20 nt, Artificial Sequence
  Synthetic
ccgccccccgaagagcgccc

SEQ ID NO: 27554 - RNA, 20 nt, Artificial Sequence
  Synthetic
uggacgcgcaccgcgcgccc

SEQ ID NO: 27555 - RNA, 20 nt, Artificial Sequence
  Synthetic
cggccacgggccgcucgccc

SEQ ID NO: 27556 - RNA, 20 nt, Artificial Sequence
  Synthetic
gagacaaaggagagcggccc

SEQ ID NO: 27557 - RNA, 20 nt, Artificial Sequence
  Synthetic
gagacagccccgcgcggccc

SEQ ID NO: 27558 - RNA, 20 nt, Artificial Sequence
  Synthetic
ggcggcgccgcgccgggccc

SEQ ID NO: 27559 - RNA, 20 nt, Artificial Sequence
  Synthetic
ccgcgccgccccgcgggccc

SEQ ID NO: 27560 - RNA, 20 nt, Artificial Sequence
  Synthetic
gggcgccgggucgcgggccc

SEQ ID NO: 27561 - RNA, 20 nt, Artificial Sequence
  Synthetic
gcacagguguccucgggccc

SEQ ID NO: 27562 - RNA, 20 nt, Artificial Sequence
  Synthetic
ggucucgagcgucguggccc

SEQ ID NO: 27563 - RNA, 20 nt, Artificial Sequence
  Synthetic
gcgcgcccaccagggugccc

SEQ ID NO: 27564 - RNA, 20 nt, Artificial Sequence
  Synthetic
gucggcgucuccgucguccc

SEQ ID NO: 27565 - RNA, 20 nt, Artificial Sequence
  Synthetic
gcggagggcggccccgagcc

SEQ ID NO: 27566 - RNA, 20 nt, Artificial Sequence
  Synthetic
cuugggugucggucugagcc

SEQ ID NO: 27567 - RNA, 20 nt, Artificial Sequence
  Synthetic
gcgcggcgcccgcggacgcc

SEQ ID NO: 27568 - RNA, 20 nt, Artificial Sequence
  Synthetic
cgcaccgccgcccccgcgcc

SEQ ID NO: 27569 - RNA, 20 nt, Artificial Sequence
  Synthetic
caagagggcggcgccgcgcc

SEQ ID NO: 27570 - RNA, 20 nt, Artificial Sequence
  Synthetic
ccggguccucccuccgcgcc

SEQ ID NO: 27571 - RNA, 20 nt, Artificial Sequence
  Synthetic
ucuuguucacguaaggcgcc

SEQ ID NO: 27572 - RNA, 20 nt, Artificial Sequence
  Synthetic
ggggcccgcgacccggcgcc

SEQ ID NO: 27573 - RNA, 20 nt, Artificial Sequence
  Synthetic
agcgcgugaggccgggcgcc

SEQ ID NO: 27574 - RNA, 20 nt, Artificial Sequence
  Synthetic
cugcugcuccgcggggcgcc

SEQ ID NO: 27575 - RNA, 20 nt, Artificial Sequence
  Synthetic
ggcagguagcgcgugaggcc

SEQ ID NO: 27576 - RNA, 20 nt, Artificial Sequence
  Synthetic
ggagacaaaggagagcggcc

SEQ ID NO: 27577 - RNA, 20 nt, Artificial Sequence
  Synthetic
cugcgagcgcggacgcggcc

SEQ ID NO: 27578 - RNA, 20 nt, Artificial Sequence
  Synthetic
aggcggcggcgaccgcggcc

SEQ ID NO: 27579 - RNA, 20 nt, Artificial Sequence
  Synthetic
gcgcgcgggucgggagggcc

SEQ ID NO: 27580 - RNA, 20 nt, Artificial Sequence
  Synthetic
cacggcgggcggcgcgggcc

SEQ ID NO: 27581 - RNA, 20 nt, Artificial Sequence
  Synthetic
ccgaguccgaguccggggcc

SEQ ID NO: 27582 - RNA, 20 nt, Artificial Sequence
  Synthetic
ccaagcacagagucugggcc

SEQ ID NO: 27583 - RNA, 20 nt, Artificial Sequence
  Synthetic
ucgcccacccccccguggcc

SEQ ID NO: 27584 - RNA, 20 nt, Artificial Sequence
  Synthetic
gcgcgucggucgcgccugcc

SEQ ID NO: 27585 - RNA, 20 nt, Artificial Sequence
  Synthetic
ucguccucgucguccgugcc

SEQ ID NO: 27586 - RNA, 20 nt, Artificial Sequence
  Synthetic
gggggccgaggaagugugcc

SEQ ID NO: 27587 - RNA, 20 nt, Artificial Sequence
  Synthetic
ugaugacuauggggggcucc

SEQ ID NO: 27588 - RNA, 20 nt, Artificial Sequence
  Synthetic
ggucgcccgaguccgagucc

SEQ ID NO: 27589 - RNA, 20 nt, Artificial Sequence
  Synthetic
gggggacugccugcccgucc

SEQ ID NO: 27590 - RNA, 20 nt, Artificial Sequence
  Synthetic
cucggccuccacgcgggucc

SEQ ID NO: 27591 - RNA, 20 nt, Artificial Sequence
  Synthetic
uguggcccgucuccaugucc

SEQ ID NO: 27592 - RNA, 20 nt, Artificial Sequence
  Synthetic
guccgacccgcgccucuucc

SEQ ID NO: 27593 - RNA, 20 nt, Artificial Sequence
  Synthetic
cuccgcguggcgcgucuucc

SEQ ID NO: 27594 - RNA, 20 nt, Artificial Sequence
  Synthetic
uagugggcgugaccgccagc

SEQ ID NO: 27595 - RNA, 20 nt, Artificial Sequence
  Synthetic
cgggggccgcggcccgcagc

SEQ ID NO: 27596 - RNA, 20 nt, Artificial Sequence
  Synthetic
ccacccguggucucgggagc

SEQ ID NO: 27597 - RNA, 20 nt, Artificial Sequence
  Synthetic
ugcgcgcgugcucggggagc

SEQ ID NO: 27598 - RNA, 20 nt, Artificial Sequence
  Synthetic
ggccgccucggccuccacgc

SEQ ID NO: 27599 - RNA, 20 nt, Artificial Sequence
  Synthetic
agggugcggcggcuccacgc

SEQ ID NO: 27600 - RNA, 20 nt, Artificial Sequence
  Synthetic
aggcuguuccacuccgacgc

SEQ ID NO: 27601 - RNA, 20 nt, Artificial Sequence
  Synthetic
ggcgcggcgcccgcggacgc

SEQ ID NO: 27602 - RNA, 20 nt, Artificial Sequence
  Synthetic
gauggugcugaacgacccgc

SEQ ID NO: 27603 - RNA, 20 nt, Artificial Sequence
  Synthetic
cgccugcgcgcgccccccgc

SEQ ID NO: 27604 - RNA, 20 nt, Artificial Sequence
  Synthetic
ccggccggcgacgcccccgc

SEQ ID NO: 27605 - RNA, 20 nt, Artificial Sequence
  Synthetic
ccgucuccgcgccgccccgc

SEQ ID NO: 27606 - RNA, 20 nt, Artificial Sequence
  Synthetic
gagagcggcccggggcccgc

SEQ ID NO: 27607 - RNA, 20 nt, Artificial Sequence
  Synthetic
cccccgcgcugcugcgccgc

SEQ ID NO: 27608 - RNA, 20 nt, Artificial Sequence
  Synthetic
gaggcggaggacgaggccgc

SEQ ID NO: 27609 - RNA, 20 nt, Artificial Sequence
  Synthetic
gcgcgccccccgccggccgc

SEQ ID NO: 27610 - RNA, 20 nt, Artificial Sequence
  Synthetic
accggggguguuggugccgc

SEQ ID NO: 27611 - RNA, 20 nt, Artificial Sequence
  Synthetic
cgccgcugcugcugcuccgc

SEQ ID NO: 27612 - RNA, 20 nt, Artificial Sequence
  Synthetic
gggagcgcggggccguccgc

SEQ ID NO: 27613 - RNA, 20 nt, Artificial Sequence
  Synthetic
ccgcucgccccggcguccgc

SEQ ID NO: 27614 - RNA, 20 nt, Artificial Sequence
  Synthetic
ggcgggcugggagguuccgc

SEQ ID NO: 27615 - RNA, 20 nt, Artificial Sequence
  Synthetic
uucucgucucuccccagcgc

SEQ ID NO: 27616 - RNA, 20 nt, Artificial Sequence
  Synthetic
cccccgcggcgcagcagcgc

SEQ ID NO: 27617 - RNA, 20 nt, Artificial Sequence
  Synthetic
ggggggcgaggggcgagcgc

SEQ ID NO: 27618 - RNA, 20 nt, Artificial Sequence
  Synthetic
cccccagcgacagggagcgc

SEQ ID NO: 27619 - RNA, 20 nt, Artificial Sequence
  Synthetic
ggggcggacuccggacgcgc

SEQ ID NO: 27620 - RNA, 20 nt, Artificial Sequence
  Synthetic
ccgcaccgccgcccccgcgc

SEQ ID NO: 27621 - RNA, 20 nt, Artificial Sequence
  Synthetic
ggagcagggcgcgcccgcgc

SEQ ID NO: 27622 - RNA, 20 nt, Artificial Sequence
  Synthetic
ccaagagggcggcgccgcgc

SEQ ID NO: 27623 - RNA, 20 nt, Artificial Sequence
  Synthetic
gcgcggggcgacggccgcgc

SEQ ID NO: 27624 - RNA, 20 nt, Artificial Sequence
  Synthetic
ggggggcuccugggccgcgc

SEQ ID NO: 27625 - RNA, 20 nt, Artificial Sequence
  Synthetic
caggcgcgaccgacgcgcgc

SEQ ID NO: 27626 - RNA, 20 nt, Artificial Sequence
  Synthetic
ggccggcggggggcgcgcgc

SEQ ID NO: 27627 - RNA, 20 nt, Artificial Sequence
  Synthetic
gggcacccuggugggcgcgc

SEQ ID NO: 27628 - RNA, 20 nt, Artificial Sequence
  Synthetic
cccgcccccggaagaggcgc

SEQ ID NO: 27629 - RNA, 20 nt, Artificial Sequence
  Synthetic
cccgaagagcgccccggcgc

SEQ ID NO: 27630 - RNA, 20 nt, Artificial Sequence
  Synthetic
ggggcgucgccggccggcgc

SEQ ID NO: 27631 - RNA, 20 nt, Artificial Sequence
  Synthetic
gucgcguccgcguccggcgc

SEQ ID NO: 27632 - RNA, 20 nt, Artificial Sequence
  Synthetic
cacgggggcggcggcggcgc

SEQ ID NO: 27633 - RNA, 20 nt, Artificial Sequence
  Synthetic
accggcacggcgggcggcgc

SEQ ID NO: 27634 - RNA, 20 nt, Artificial Sequence
  Synthetic
uagcgcgugaggccgggcgc

SEQ ID NO: 27635 - RNA, 20 nt, Artificial Sequence
  Synthetic
cgcggggcgccagggggcgc

SEQ ID NO: 27636 - RNA, 20 nt, Artificial Sequence
  Synthetic
acgcgcuaccugcccaucgc

SEQ ID NO: 27637 - RNA, 20 nt, Artificial Sequence
  Synthetic
gccgcgcggggcugucucgc

SEQ ID NO: 27638 - RNA, 20 nt, Artificial Sequence
  Synthetic
guggcccgcgggggcgucgc

SEQ ID NO: 27639 - RNA, 20 nt, Artificial Sequence
  Synthetic
gaggccgggcgccgggucgc

SEQ ID NO: 27640 - RNA, 20 nt, Artificial Sequence
  Synthetic
ggccccgcgcucccugucgc

SEQ ID NO: 27641 - RNA, 20 nt, Artificial Sequence
  Synthetic
gggcagguagcgcgugaggc

SEQ ID NO: 27642 - RNA, 20 nt, Artificial Sequence
  Synthetic
ugcgcguccaccggcacggc

SEQ ID NO: 27643 - RNA, 20 nt, Artificial Sequence
  Synthetic
cggggcggcgcggagacggc

SEQ ID NO: 27644 - RNA, 20 nt, Artificial Sequence
  Synthetic
ggcacgacggccgcgacggc

SEQ ID NO: 27645 - RNA, 20 nt, Artificial Sequence
  Synthetic
cagggcgcgcccgcgccggc

SEQ ID NO: 27646 - RNA, 20 nt, Artificial Sequence
  Synthetic
cccgcgggggcgucgccggc

SEQ ID NO: 27647 - RNA, 20 nt, Artificial Sequence
  Synthetic
cucuucccccugcggccggc

SEQ ID NO: 27648 - RNA, 20 nt, Artificial Sequence
  Synthetic
ucugcgagcgcggacgcggc

SEQ ID NO: 27649 - RNA, 20 nt, Artificial Sequence
  Synthetic
ggggcgcgcgcaggcgcggc

SEQ ID NO: 27650 - RNA, 20 nt, Artificial Sequence
  Synthetic
ggcgccggucgggucgcggc

SEQ ID NO: 27651 - RNA, 20 nt, Artificial Sequence
  Synthetic
gccucucuucccccugcggc

SEQ ID NO: 27652 - RNA, 20 nt, Artificial Sequence
  Synthetic
acgccgcggcggcggagggc

SEQ ID NO: 27653 - RNA, 20 nt, Artificial Sequence
  Synthetic
cgcgcgcgggucgggagggc

SEQ ID NO: 27654 - RNA, 20 nt, Artificial Sequence
  Synthetic
ucuccauguccaggacgggc

SEQ ID NO: 27655 - RNA, 20 nt, Artificial Sequence
  Synthetic
gcacagagucugggccgggc

SEQ ID NO: 27656 - RNA, 20 nt, Artificial Sequence
  Synthetic
ccggucgggucgcggcgggc

SEQ ID NO: 27657 - RNA, 20 nt, Artificial Sequence
  Synthetic
gcgcucuucggggggcgggc

SEQ ID NO: 27658 - RNA, 20 nt, Artificial Sequence
  Synthetic
ccgccucuuccucugcgggc

SEQ ID NO: 27659 - RNA, 20 nt, Artificial Sequence
  Synthetic
gccgaggcggccgugcgggc

SEQ ID NO: 27660 - RNA, 20 nt, Artificial Sequence
  Synthetic
ggcggcgccccguugcgggc

SEQ ID NO: 27661 - RNA, 20 nt, Artificial Sequence
  Synthetic
ucuuccucugcgggcggggc

SEQ ID NO: 27662 - RNA, 20 nt, Artificial Sequence
  Synthetic
cccgcgccucuuccgggggc

SEQ ID NO: 27663 - RNA, 20 nt, Artificial Sequence
  Synthetic
cggggcgcucuucggggggc

SEQ ID NO: 27664 - RNA, 20 nt, Artificial Sequence
  Synthetic
ucgagacccccgcgaugggc

SEQ ID NO: 27665 - RNA, 20 nt, Artificial Sequence
  Synthetic
cccaagcacagagucugggc

SEQ ID NO: 27666 - RNA, 20 nt, Artificial Sequence
  Synthetic
gaacguggcggaccugcugc

SEQ ID NO: 27667 - RNA, 20 nt, Artificial Sequence
  Synthetic
uccuccgccucuuccucugc

SEQ ID NO: 27668 - RNA, 20 nt, Artificial Sequence
  Synthetic
gcccgcgccgcccgccgugc

SEQ ID NO: 27669 - RNA, 20 nt, Artificial Sequence
  Synthetic
gauaaaguccacggccgugc

SEQ ID NO: 27670 - RNA, 20 nt, Artificial Sequence
  Synthetic
ggaggccgaggcggccgugc

SEQ ID NO: 27671 - RNA, 20 nt, Artificial Sequence
  Synthetic
aucguccucgucguccgugc

SEQ ID NO: 27672 - RNA, 20 nt, Artificial Sequence
  Synthetic
cggcgcgggggcggcggugc

SEQ ID NO: 27673 - RNA, 20 nt, Artificial Sequence
  Synthetic
cagcggcggcgccccguugc

SEQ ID NO: 27674 - RNA, 20 nt, Artificial Sequence
  Synthetic
uugcgggcgggggugggauc

SEQ ID NO: 27675 - RNA, 20 nt, Artificial Sequence
  Synthetic
uggcggucacgcccacuauc

SEQ ID NO: 27676 - RNA, 20 nt, Artificial Sequence
  Synthetic
uccgggggucguucacuauc

SEQ ID NO: 27677 - RNA, 20 nt, Artificial Sequence
  Synthetic
gcacggccguggacuuuauc

SEQ ID NO: 27678 - RNA, 20 nt, Artificial Sequence
  Synthetic
cggcggcgcggggcggacuc

SEQ ID NO: 27679 - RNA, 20 nt, Artificial Sequence
  Synthetic
cgggccccggacucggacuc

SEQ ID NO: 27680 - RNA, 20 nt, Artificial Sequence
  Synthetic
aagaggcgcgggucggacuc

SEQ ID NO: 27681 - RNA, 20 nt, Artificial Sequence
  Synthetic
cgucggaguggaacagccuc

SEQ ID NO: 27682 - RNA, 20 nt, Artificial Sequence
  Synthetic
cgcuggacuuccacggccuc

SEQ ID NO: 27683 - RNA, 20 nt, Artificial Sequence
  Synthetic
uccuccgcacagguguccuc

SEQ ID NO: 27684 - RNA, 20 nt, Artificial Sequence
  Synthetic
gggucgcgggccccgggcuc

SEQ ID NO: 27685 - RNA, 20 nt, Artificial Sequence
  Synthetic
acgcaguugcgcgcgugcuc

SEQ ID NO: 27686 - RNA, 20 nt, Artificial Sequence
  Synthetic
gucgcgccacccguggucuc

SEQ ID NO: 27687 - RNA, 20 nt, Artificial Sequence
  Synthetic
cgacacccaagcacagaguc

SEQ ID NO: 27688 - RNA, 20 nt, Artificial Sequence
  Synthetic
cggucgcccgaguccgaguc

SEQ ID NO: 27689 - RNA, 20 nt, Artificial Sequence
  Synthetic
gcggggggcgucggguaguc

SEQ ID NO: 27690 - RNA, 20 nt, Artificial Sequence
  Synthetic
gguccgccacguuccccguc

SEQ ID NO: 27691 - RNA, 20 nt, Artificial Sequence
  Synthetic
gggagcgucgcguccgcguc

SEQ ID NO: 27692 - RNA, 20 nt, Artificial Sequence
  Synthetic
cggccgucgccccgcgcguc

SEQ ID NO: 27693 - RNA, 20 nt, Artificial Sequence
  Synthetic
acuccgacgcggggggcguc

SEQ ID NO: 27694 - RNA, 20 nt, Artificial Sequence
  Synthetic
ggaggucugccacagucguc

SEQ ID NO: 27695 - RNA, 20 nt, Artificial Sequence
  Synthetic
ggcgccagggggcgccgguc

SEQ ID NO: 27696 - RNA, 20 nt, Artificial Sequence
  Synthetic
ccucggccuccacgcggguc

SEQ ID NO: 27697 - RNA, 20 nt, Artificial Sequence
  Synthetic
gcgaccgacgcgcgcggguc

SEQ ID NO: 27698 - RNA, 20 nt, Artificial Sequence
  Synthetic
gcgggggugggaucuggguc

SEQ ID NO: 27699 - RNA, 20 nt, Artificial Sequence
  Synthetic
aguccgacccgcgccucuuc

SEQ ID NO: 27700 - RNA, 20 nt, Artificial Sequence
  Synthetic
cccgcgccggggcgcucuuc

SEQ ID NO: 27701 - RNA, 20 nt, Artificial Sequence
  Synthetic
cccagggggugggggccaag

SEQ ID NO: 27702 - RNA, 20 nt, Artificial Sequence
  Synthetic
agccccgcccgcagaggaag

SEQ ID NO: 27703 - RNA, 20 nt, Artificial Sequence
  Synthetic
gcgcggggcggcggaggaag

SEQ ID NO: 27704 - RNA, 20 nt, Artificial Sequence
  Synthetic
cggcggcccgcccccggaag

SEQ ID NO: 27705 - RNA, 20 nt, Artificial Sequence
  Synthetic
gcucgccccucgccccccag

SEQ ID NO: 27706 - RNA, 20 nt, Artificial Sequence
  Synthetic
auagugggcgugaccgccag

SEQ ID NO: 27707 - RNA, 20 nt, Artificial Sequence
  Synthetic
gcugcuccgcggggcgccag

SEQ ID NO: 27708 - RNA, 20 nt, Artificial Sequence
  Synthetic
ugcccaccggggucauccag

SEQ ID NO: 27709 - RNA, 20 nt, Artificial Sequence
  Synthetic
gccccgcggagcagcagcag

SEQ ID NO: 27710 - RNA, 20 nt, Artificial Sequence
  Synthetic
cccaccagccccgcccgcag

SEQ ID NO: 27711 - RNA, 20 nt, Artificial Sequence
  Synthetic
gcgccccccgccggccgcag

SEQ ID NO: 27712 - RNA, 20 nt, Artificial Sequence
  Synthetic
gccggccgcagggggaagag

SEQ ID NO: 27713 - RNA, 20 nt, Artificial Sequence
  Synthetic
cgcggccgucgugccgagag

SEQ ID NO: 27714 - RNA, 20 nt, Artificial Sequence
  Synthetic
gaggaggagacaaaggagag

SEQ ID NO: 27715 - RNA, 20 nt, Artificial Sequence
  Synthetic
cccgcggacgccggggcgag

SEQ ID NO: 27716 - RNA, 20 nt, Artificial Sequence
  Synthetic
cccacccccuggggggcgag

SEQ ID NO: 27717 - RNA, 20 nt, Artificial Sequence
  Synthetic
ccgccccccacgccgcggag

SEQ ID NO: 27718 - RNA, 20 nt, Artificial Sequence
  Synthetic
cgacgccccccgcgucggag

SEQ ID NO: 27719 - RNA, 20 nt, Artificial Sequence
  Synthetic
cauggagacgggccacauag

SEQ ID NO: 27720 - RNA, 20 nt, Artificial Sequence
  Synthetic
cccgguggcguaccugauag

SEQ ID NO: 27721 - RNA, 20 nt, Artificial Sequence
  Synthetic
ucccacccccgcccgcaacg

SEQ ID NO: 27722 - RNA, 20 nt, Artificial Sequence
  Synthetic
cguggaccagacggggaacg

SEQ ID NO: 27723 - RNA, 20 nt, Artificial Sequence
  Synthetic
ccgcgcucgcagacaccacg

SEQ ID NO: 27724 - RNA, 20 nt, Artificial Sequence
  Synthetic
ugccaggaagacgcgccacg

SEQ ID NO: 27725 - RNA, 20 nt, Artificial Sequence
  Synthetic
gucguccgugccgggccacg

SEQ ID NO: 27726 - RNA, 20 nt, Artificial Sequence
  Synthetic
cgacgcccccgcgggccacg

SEQ ID NO: 27727 - RNA, 20 nt, Artificial Sequence
  Synthetic
cggccgccucggccuccacg

SEQ ID NO: 27728 - RNA, 20 nt, Artificial Sequence
  Synthetic
cagggugcggcggcuccacg

SEQ ID NO: 27729 - RNA, 20 nt, Artificial Sequence
  Synthetic
cguuccccgucugguccacg

SEQ ID NO: 27730 - RNA, 20 nt, Artificial Sequence
  Synthetic
acgugaacaagacggucacg

SEQ ID NO: 27731 - RNA, 20 nt, Artificial Sequence
  Synthetic
ugguccucguggaccagacg

SEQ ID NO: 27732 - RNA, 20 nt, Artificial Sequence
  Synthetic
guggcccggcacggacgacg

SEQ ID NO: 27733 - RNA, 20 nt, Artificial Sequence
  Synthetic
ggacgacggagacgccgacg

SEQ ID NO: 27734 - RNA, 20 nt, Artificial Sequence
  Synthetic
gaggcuguuccacuccgacg

SEQ ID NO: 27735 - RNA, 20 nt, Artificial Sequence
  Synthetic
ggaggaagaggcggaggacg

SEQ ID NO: 27736 - RNA, 20 nt, Artificial Sequence
  Synthetic
ucucuccccagcgccggacg

SEQ ID NO: 27737 - RNA, 20 nt, Artificial Sequence
  Synthetic
ggugucugcgagcgcggacg

SEQ ID NO: 27738 - RNA, 20 nt, Artificial Sequence
  Synthetic
gggccacauaggggccuacg

SEQ ID NO: 27739 - RNA, 20 nt, Artificial Sequence
  Synthetic
aaagagcauguugcccaccg

SEQ ID NO: 27740 - RNA, 20 nt, Artificial Sequence
  Synthetic
cggcguggggggcggcaccg

SEQ ID NO: 27741 - RNA, 20 nt, Artificial Sequence
  Synthetic
gccugggucaugcgcgaccg

SEQ ID NO: 27742 - RNA, 20 nt, Artificial Sequence
  Synthetic
ggaggaggcggcggcgaccg

SEQ ID NO: 27743 - RNA, 20 nt, Artificial Sequence
  Synthetic
gacucggacucgggcgaccg

SEQ ID NO: 27744 - RNA, 20 nt, Artificial Sequence
  Synthetic
uuaucuggacgggcaacccg

SEQ ID NO: 27745 - RNA, 20 nt, Artificial Sequence
  Synthetic
gccuccggucgcgccacccg

SEQ ID NO: 27746 - RNA, 20 nt, Artificial Sequence
  Synthetic
ggcggugcgggggcgacccg

SEQ ID NO: 27747 - RNA, 20 nt, Artificial Sequence
  Synthetic
gggcgcggagggaggacccg

SEQ ID NO: 27748 - RNA, 20 nt, Artificial Sequence
  Synthetic
cccugucgcccacccccccg

SEQ ID NO: 27749 - RNA, 20 nt, Artificial Sequence
  Synthetic
guggcagaccuccccccccg

SEQ ID NO: 27750 - RNA, 20 nt, Artificial Sequence
  Synthetic
gccggccggcgacgcccccg

SEQ ID NO: 27751 - RNA, 20 nt, Artificial Sequence
  Synthetic
ccgcgccgccgccgcccccg

SEQ ID NO: 27752 - RNA, 20 nt, Artificial Sequence
  Synthetic
gcacacuuccucggcccccg

SEQ ID NO: 27753 - RNA, 20 nt, Artificial Sequence
  Synthetic
ggaggacccggggucccccg

SEQ ID NO: 27754 - RNA, 20 nt, Artificial Sequence
  Synthetic
gccgucuccgcgccgccccg

SEQ ID NO: 27755 - RNA, 20 nt, Artificial Sequence
  Synthetic
cggcgcccccuggcgccccg

SEQ ID NO: 27756 - RNA, 20 nt, Artificial Sequence
  Synthetic
cgggucggacucgggccccg

SEQ ID NO: 27757 - RNA, 20 nt, Artificial Sequence
  Synthetic
acagguguccucgggccccg

SEQ ID NO: 27758 - RNA, 20 nt, Artificial Sequence
  Synthetic
ggagggcggccccgagcccg

SEQ ID NO: 27759 - RNA, 20 nt, Artificial Sequence
  Synthetic
cgacgggggcgcggcgcccg

SEQ ID NO: 27760 - RNA, 20 nt, Artificial Sequence
  Synthetic
agacaaaggagagcggcccg

SEQ ID NO: 27761 - RNA, 20 nt, Artificial Sequence
  Synthetic
acgccggggcgagcggcccg

SEQ ID NO: 27762 - RNA, 20 nt, Artificial Sequence
  Synthetic
accuccccccccggggcccg

SEQ ID NO: 27763 - RNA, 20 nt, Artificial Sequence
  Synthetic
ggagagcggcccggggcccg

SEQ ID NO: 27764 - RNA, 20 nt, Artificial Sequence
  Synthetic
cggugccgccccccacgccg

SEQ ID NO: 27765 - RNA, 20 nt, Artificial Sequence
  Synthetic
gcgggugggcgaagacgccg

SEQ ID NO: 27766 - RNA, 20 nt, Artificial Sequence
  Synthetic
cgcggcgcccgcggacgccg

SEQ ID NO: 27767 - RNA, 20 nt, Artificial Sequence
  Synthetic
cguccugcccuccgccgccg

SEQ ID NO: 27768 - RNA, 20 nt, Artificial Sequence
  Synthetic
gcaccgccgcccccgcgccg

SEQ ID NO: 27769 - RNA, 20 nt, Artificial Sequence
  Synthetic
gcccccgcgcugcugcgccg

SEQ ID NO: 27770 - RNA, 20 nt, Artificial Sequence
  Synthetic
gucuccgucgucccaggccg

SEQ ID NO: 27771 - RNA, 20 nt, Artificial Sequence
  Synthetic
agaggcggaggacgaggccg

SEQ ID NO: 27772 - RNA, 20 nt, Artificial Sequence
  Synthetic
gguggcgcgaccggaggccg

SEQ ID NO: 27773 - RNA, 20 nt, Artificial Sequence
  Synthetic
ccggacccgcguggaggccg

SEQ ID NO: 27774 - RNA, 20 nt, Artificial Sequence
  Synthetic
cgugcgggccggcacggccg

SEQ ID NO: 27775 - RNA, 20 nt, Artificial Sequence
  Synthetic
ggcggaccugcugcgggccg

SEQ ID NO: 27776 - RNA, 20 nt, Artificial Sequence
  Synthetic
gcggcuccacgcgggggccg

SEQ ID NO: 27777 - RNA, 20 nt, Artificial Sequence
  Synthetic
cugcugcgccgcgggggccg

SEQ ID NO: 27778 - RNA, 20 nt, Artificial Sequence
  Synthetic
gcgcagcagcgcgggggccg

SEQ ID NO: 27779 - RNA, 20 nt, Artificial Sequence
  Synthetic
gggcgagcggcccguggccg

SEQ ID NO: 27780 - RNA, 20 nt, Artificial Sequence
  Synthetic
caccggggguguuggugccg

SEQ ID NO: 27781 - RNA, 20 nt, Artificial Sequence
  Synthetic
gcgggccgccgcccccuccg

SEQ ID NO: 27782 - RNA, 20 nt, Artificial Sequence
  Synthetic
ccgccgcugcugcugcuccg

SEQ ID NO: 27783 - RNA, 20 nt, Artificial Sequence
  Synthetic
gucgcccgaguccgaguccg

SEQ ID NO: 27784 - RNA, 20 nt, Artificial Sequence
  Synthetic
agggagcgcggggccguccg

SEQ ID NO: 27785 - RNA, 20 nt, Artificial Sequence
  Synthetic
gccgcucgccccggcguccg

SEQ ID NO: 27786 - RNA, 20 nt, Artificial Sequence
  Synthetic
ucggccuccacgcggguccg

SEQ ID NO: 27787 - RNA, 20 nt, Artificial Sequence
  Synthetic
uccgacccgcgccucuuccg

SEQ ID NO: 27788 - RNA, 20 nt, Artificial Sequence
  Synthetic
cggcgggcugggagguuccg

SEQ ID NO: 27789 - RNA, 20 nt, Artificial Sequence
  Synthetic
gcccccgcggcgcagcagcg

SEQ ID NO: 27790 - RNA, 20 nt, Artificial Sequence
  Synthetic
uggggggcgaggggcgagcg

SEQ ID NO: 27791 - RNA, 20 nt, Artificial Sequence
  Synthetic
ccccguggugucugcgagcg

SEQ ID NO: 27792 - RNA, 20 nt, Artificial Sequence
  Synthetic
ccccccagcgacagggagcg

SEQ ID NO: 27793 - RNA, 20 nt, Artificial Sequence
  Synthetic
gggugcggcggcuccacgcg

SEQ ID NO: 27794 - RNA, 20 nt, Artificial Sequence
  Synthetic
ggcuguuccacuccgacgcg

SEQ ID NO: 27795 - RNA, 20 nt, Artificial Sequence
  Synthetic
cggggcggacuccggacgcg

SEQ ID NO: 27796 - RNA, 20 nt, Artificial Sequence
  Synthetic
gaacgacccccggacccgcg

SEQ ID NO: 27797 - RNA, 20 nt, Artificial Sequence
  Synthetic
gcgcgccgcgcgcccccgcg

SEQ ID NO: 27798 - RNA, 20 nt, Artificial Sequence
  Synthetic
ugcgggccgcggcccccgcg

SEQ ID NO: 27799 - RNA, 20 nt, Artificial Sequence
  Synthetic
ccccgcgagacagccccgcg

SEQ ID NO: 27800 - RNA, 20 nt, Artificial Sequence
  Synthetic
agagcggcccggggcccgcg

SEQ ID NO: 27801 - RNA, 20 nt, Artificial Sequence
  Synthetic
ccccgcgcugcugcgccgcg

SEQ ID NO: 27802 - RNA, 20 nt, Artificial Sequence
  Synthetic
aggcggaggacgaggccgcg

SEQ ID NO: 27803 - RNA, 20 nt, Artificial Sequence
  Synthetic
cgcgcggggcgacggccgcg

SEQ ID NO: 27804 - RNA, 20 nt, Artificial Sequence
  Synthetic
uggggggcuccugggccgcg

SEQ ID NO: 27805 - RNA, 20 nt, Artificial Sequence
  Synthetic
ccggggguguuggugccgcg

SEQ ID NO: 27806 - RNA, 20 nt, Artificial Sequence
  Synthetic
gcucggggccgcccuccgcg

SEQ ID NO: 27807 - RNA, 20 nt, Artificial Sequence
  Synthetic
gccgcugcugcugcuccgcg

SEQ ID NO: 27808 - RNA, 20 nt, Artificial Sequence
  Synthetic
ccccgcggcgcagcagcgcg

SEQ ID NO: 27809 - RNA, 20 nt, Artificial Sequence
  Synthetic
gggggcgaggggcgagcgcg

SEQ ID NO: 27810 - RNA, 20 nt, Artificial Sequence
  Synthetic
ccccagcgacagggagcgcg

SEQ ID NO: 27811 - RNA, 20 nt, Artificial Sequence
  Synthetic
gcaggcgcgaccgacgcgcg

SEQ ID NO: 27812 - RNA, 20 nt, Artificial Sequence
  Synthetic
gggcggacuccggacgcgcg

SEQ ID NO: 27813 - RNA, 20 nt, Artificial Sequence
  Synthetic
cgcggggcgacggccgcgcg

SEQ ID NO: 27814 - RNA, 20 nt, Artificial Sequence
  Synthetic
gggggcuccugggccgcgcg

SEQ ID NO: 27815 - RNA, 20 nt, Artificial Sequence
  Synthetic
ccgaagagcgccccggcgcg

SEQ ID NO: 27816 - RNA, 20 nt, Artificial Sequence
  Synthetic
acgggggcggcggcggcgcg

SEQ ID NO: 27817 - RNA, 20 nt, Artificial Sequence
  Synthetic
ucaugcgcgaccggggcgcg

SEQ ID NO: 27818 - RNA, 20 nt, Artificial Sequence
  Synthetic
gacggccgcgcgggggcgcg

SEQ ID NO: 27819 - RNA, 20 nt, Artificial Sequence
  Synthetic
cgcgcuaccugcccaucgcg

SEQ ID NO: 27820 - RNA, 20 nt, Artificial Sequence
  Synthetic
ccgcgcggggcugucucgcg

SEQ ID NO: 27821 - RNA, 20 nt, Artificial Sequence
  Synthetic
gcggggggcgcgcgcaggcg

SEQ ID NO: 27822 - RNA, 20 nt, Artificial Sequence
  Synthetic
gcccgcccccggaagaggcg

SEQ ID NO: 27823 - RNA, 20 nt, Artificial Sequence
  Synthetic
ggggcggcgcggagacggcg

SEQ ID NO: 27824 - RNA, 20 nt, Artificial Sequence
  Synthetic
ccccgaagagcgccccggcg

SEQ ID NO: 27825 - RNA, 20 nt, Artificial Sequence
  Synthetic
uccgaguccggggcccggcg

SEQ ID NO: 27826 - RNA, 20 nt, Artificial Sequence
  Synthetic
gggggcgucgccggccggcg

SEQ ID NO: 27827 - RNA, 20 nt, Artificial Sequence
  Synthetic
ucuucccccugcggccggcg

SEQ ID NO: 27828 - RNA, 20 nt, Artificial Sequence
  Synthetic
ccgccgcccccuccgcggcg

SEQ ID NO: 27829 - RNA, 20 nt, Artificial Sequence
  Synthetic
ccacgggggcggcggcggcg

SEQ ID NO: 27830 - RNA, 20 nt, Artificial Sequence
  Synthetic
caccggcacggcgggcggcg

SEQ ID NO: 27831 - RNA, 20 nt, Artificial Sequence
  Synthetic
ccggggcccgcggggcggcg

SEQ ID NO: 27832 - RNA, 20 nt, Artificial Sequence
  Synthetic
ggggggugggcgacagggcg

SEQ ID NO: 27833 - RNA, 20 nt, Artificial Sequence
  Synthetic
cgggucgggagggccgggcg

SEQ ID NO: 27834 - RNA, 20 nt, Artificial Sequence
  Synthetic
cgccucuuccucugcgggcg

SEQ ID NO: 27835 - RNA, 20 nt, Artificial Sequence
  Synthetic
gcggcgccccguugcgggcg

SEQ ID NO: 27836 - RNA, 20 nt, Artificial Sequence
  Synthetic
cggagacgccgacgggggcg

SEQ ID NO: 27837 - RNA, 20 nt, Artificial Sequence
  Synthetic
cccccacccccuggggggcg

SEQ ID NO: 27838 - RNA, 20 nt, Artificial Sequence
  Synthetic
ggcgcgggggcggcggugcg

SEQ ID NO: 27839 - RNA, 20 nt, Artificial Sequence
  Synthetic
cacgcgcuaccugcccaucg

SEQ ID NO: 27840 - RNA, 20 nt, Artificial Sequence
  Synthetic
aggggccuacgugguccucg

SEQ ID NO: 27841 - RNA, 20 nt, Artificial Sequence
  Synthetic
ggucgcgggccccgggcucg

SEQ ID NO: 27842 - RNA, 20 nt, Artificial Sequence
  Synthetic
cgcaguugcgcgcgugcucg

SEQ ID NO: 27843 - RNA, 20 nt, Artificial Sequence
  Synthetic
ggccgcgcggggcugucucg

SEQ ID NO: 27844 - RNA, 20 nt, Artificial Sequence
  Synthetic
cggggggcgucggguagucg

SEQ ID NO: 27845 - RNA, 20 nt, Artificial Sequence
  Synthetic
ugggggcggcccugccgucg

SEQ ID NO: 27846 - RNA, 20 nt, Artificial Sequence
  Synthetic
cgcgggggucucgagcgucg

SEQ ID NO: 27847 - RNA, 20 nt, Artificial Sequence
  Synthetic
gaggucugccacagucgucg

SEQ ID NO: 27848 - RNA, 20 nt, Artificial Sequence
  Synthetic
ugaggccgggcgccgggucg

SEQ ID NO: 27849 - RNA, 20 nt, Artificial Sequence
  Synthetic
agggggcgccggucgggucg

SEQ ID NO: 27850 - RNA, 20 nt, Artificial Sequence
  Synthetic
ccgcgccggggcgcucuucg

SEQ ID NO: 27851 - RNA, 20 nt, Artificial Sequence
  Synthetic
cucgccccucgccccccagg

SEQ ID NO: 27852 - RNA, 20 nt, Artificial Sequence
  Synthetic
cugcuccgcggggcgccagg

SEQ ID NO: 27853 - RNA, 20 nt, Artificial Sequence
  Synthetic
cgccccccgccggccgcagg

SEQ ID NO: 27854 - RNA, 20 nt, Artificial Sequence
  Synthetic
cccgcccgcagaggaagagg

SEQ ID NO: 27855 - RNA, 20 nt, Artificial Sequence
  Synthetic
cggggcggcggaggaagagg

SEQ ID NO: 27856 - RNA, 20 nt, Artificial Sequence
  Synthetic
gacccgcguggaggccgagg

SEQ ID NO: 27857 - RNA, 20 nt, Artificial Sequence
  Synthetic
agaggcggaggaggaggagg

SEQ ID NO: 27858 - RNA, 20 nt, Artificial Sequence
  Synthetic
ggaggcggaggaggaggagg

SEQ ID NO: 27859 - RNA, 20 nt, Artificial Sequence
  Synthetic
ggaagaggcggaggaggagg

SEQ ID NO: 27860 - RNA, 20 nt, Artificial Sequence
  Synthetic
ggaggaggcggaggaggagg

SEQ ID NO: 27861 - RNA, 20 nt, Artificial Sequence
  Synthetic
agaggaagaggcggaggagg

SEQ ID NO: 27862 - RNA, 20 nt, Artificial Sequence
  Synthetic
ggaggaggaggcggaggagg

SEQ ID NO: 27863 - RNA, 20 nt, Artificial Sequence
  Synthetic
ggacaccugugcggaggagg

SEQ ID NO: 27864 - RNA, 20 nt, Artificial Sequence
  Synthetic
cgccccccacgccgcggagg

SEQ ID NO: 27865 - RNA, 20 nt, Artificial Sequence
  Synthetic
cgcagaggaagaggcggagg

SEQ ID NO: 27866 - RNA, 20 nt, Artificial Sequence
  Synthetic
ggaggaggaggaggcggagg

SEQ ID NO: 27867 - RNA, 20 nt, Artificial Sequence
  Synthetic
cgaggacaccugugcggagg

SEQ ID NO: 27868 - RNA, 20 nt, Artificial Sequence
  Synthetic
cgcgcucgcagacaccacgg

SEQ ID NO: 27869 - RNA, 20 nt, Artificial Sequence
  Synthetic
ucguccgugccgggccacgg

SEQ ID NO: 27870 - RNA, 20 nt, Artificial Sequence
  Synthetic
gugcgcguccaccggcacgg

SEQ ID NO: 27871 - RNA, 20 nt, Artificial Sequence
  Synthetic
cgugaacaagacggucacgg

SEQ ID NO: 27872 - RNA, 20 nt, Artificial Sequence
  Synthetic
gcggggcggcgcggagacgg

SEQ ID NO: 27873 - RNA, 20 nt, Artificial Sequence
  Synthetic
gacgacggagacgccgacgg

SEQ ID NO: 27874 - RNA, 20 nt, Artificial Sequence
  Synthetic
ggcguggggggcggcaccgg

SEQ ID NO: 27875 - RNA, 20 nt, Artificial Sequence
  Synthetic
accacggguggcgcgaccgg

SEQ ID NO: 27876 - RNA, 20 nt, Artificial Sequence
  Synthetic
cagccucuggaugaccccgg

SEQ ID NO: 27877 - RNA, 20 nt, Artificial Sequence
  Synthetic
cagguguccucgggccccgg

SEQ ID NO: 27878 - RNA, 20 nt, Artificial Sequence
  Synthetic
ucucuucccccugcggccgg

SEQ ID NO: 27879 - RNA, 20 nt, Artificial Sequence
  Synthetic
cgcgccgcccgccgugccgg

SEQ ID NO: 27880 - RNA, 20 nt, Artificial Sequence
  Synthetic
cggccuccacgcggguccgg

SEQ ID NO: 27881 - RNA, 20 nt, Artificial Sequence
  Synthetic
ccgacccgcgccucuuccgg

SEQ ID NO: 27882 - RNA, 20 nt, Artificial Sequence
  Synthetic
ccgcggagcagcagcagcgg

SEQ ID NO: 27883 - RNA, 20 nt, Artificial Sequence
  Synthetic
caggaagacgcgccacgcgg

SEQ ID NO: 27884 - RNA, 20 nt, Artificial Sequence
  Synthetic
ggugcggcggcuccacgcgg

SEQ ID NO: 27885 - RNA, 20 nt, Artificial Sequence
  Synthetic
gcuguuccacuccgacgcgg

SEQ ID NO: 27886 - RNA, 20 nt, Artificial Sequence
  Synthetic
cuacuccccguggcccgcgg

SEQ ID NO: 27887 - RNA, 20 nt, Artificial Sequence
  Synthetic
ugccgccccccacgccgcgg

SEQ ID NO: 27888 - RNA, 20 nt, Artificial Sequence
  Synthetic
ggugggcgaagacgccgcgg

SEQ ID NO: 27889 - RNA, 20 nt, Artificial Sequence
  Synthetic
cccgcgcugcugcgccgcgg

SEQ ID NO: 27890 - RNA, 20 nt, Artificial Sequence
  Synthetic
cggggguguuggugccgcgg

SEQ ID NO: 27891 - RNA, 20 nt, Artificial Sequence
  Synthetic
cccgcggcgcagcagcgcgg

SEQ ID NO: 27892 - RNA, 20 nt, Artificial Sequence
  Synthetic
gcggggcgacggccgcgcgg

SEQ ID NO: 27893 - RNA, 20 nt, Artificial Sequence
  Synthetic
gggggcgcgcgcaggcgcgg

SEQ ID NO: 27894 - RNA, 20 nt, Artificial Sequence
  Synthetic
cgaagagcgccccggcgcgg

SEQ ID NO: 27895 - RNA, 20 nt, Artificial Sequence
  Synthetic
gucgggagggccgggcgcgg

SEQ ID NO: 27896 - RNA, 20 nt, Artificial Sequence
  Synthetic
gcgcuaccugcccaucgcgg

SEQ ID NO: 27897 - RNA, 20 nt, Artificial Sequence
  Synthetic
cgcgcggggcugucucgcgg

SEQ ID NO: 27898 - RNA, 20 nt, Artificial Sequence
  Synthetic
gggcgccggucgggucgcgg

SEQ ID NO: 27899 - RNA, 20 nt, Artificial Sequence
  Synthetic
gcccgcagaggaagaggcgg

SEQ ID NO: 27900 - RNA, 20 nt, Artificial Sequence
  Synthetic
ggcggcggaggaagaggcgg

SEQ ID NO: 27901 - RNA, 20 nt, Artificial Sequence
  Synthetic
ggcggaggaggaggaggcgg

SEQ ID NO: 27902 - RNA, 20 nt, Artificial Sequence
  Synthetic
gggcggcgcggagacggcgg

SEQ ID NO: 27903 - RNA, 20 nt, Artificial Sequence
  Synthetic
cuucccccugcggccggcgg

SEQ ID NO: 27904 - RNA, 20 nt, Artificial Sequence
  Synthetic
gggcgaagacgccgcggcgg

SEQ ID NO: 27905 - RNA, 20 nt, Artificial Sequence
  Synthetic
cgaagacgccgcggcggcgg

SEQ ID NO: 27906 - RNA, 20 nt, Artificial Sequence
  Synthetic
gggcgagcgcggggcggcgg

SEQ ID NO: 27907 - RNA, 20 nt, Artificial Sequence
  Synthetic
agacaccacgggggcggcgg

SEQ ID NO: 27908 - RNA, 20 nt, Artificial Sequence
  Synthetic
cggcgccccguugcgggcgg

SEQ ID NO: 27909 - RNA, 20 nt, Artificial Sequence
  Synthetic
gaggggcgagcgcggggcgg

SEQ ID NO: 27910 - RNA, 20 nt, Artificial Sequence
  Synthetic
ccacgccgcggagggggcgg

SEQ ID NO: 27911 - RNA, 20 nt, Artificial Sequence
  Synthetic
cgcagacaccacgggggcgg

SEQ ID NO: 27912 - RNA, 20 nt, Artificial Sequence
  Synthetic
gcgccccggcgcgggggcgg

SEQ ID NO: 27913 - RNA, 20 nt, Artificial Sequence
  Synthetic
gcgcgggggcggcggugcgg

SEQ ID NO: 27914 - RNA, 20 nt, Artificial Sequence
  Synthetic
gcucggggagcagggugcgg

SEQ ID NO: 27915 - RNA, 20 nt, Artificial Sequence
  Synthetic
gcccgaggacaccugugcgg

SEQ ID NO: 27916 - RNA, 20 nt, Artificial Sequence
  Synthetic
ggggggcgucggguagucgg

SEQ ID NO: 27917 - RNA, 20 nt, Artificial Sequence
  Synthetic
cgcgccggggcgcucuucgg

SEQ ID NO: 27918 - RNA, 20 nt, Artificial Sequence
  Synthetic
gggggugggggccaagaggg

SEQ ID NO: 27919 - RNA, 20 nt, Artificial Sequence
  Synthetic
agcagcgcgggggccgaggg

SEQ ID NO: 27920 - RNA, 20 nt, Artificial Sequence
  Synthetic
aagacgcgccacgcggaggg

SEQ ID NO: 27921 - RNA, 20 nt, Artificial Sequence
  Synthetic
ggagggccgggcgcggaggg

SEQ ID NO: 27922 - RNA, 20 nt, Artificial Sequence
  Synthetic
ccugcucccgagaccacggg

SEQ ID NO: 27923 - RNA, 20 nt, Artificial Sequence
  Synthetic
cguccgugccgggccacggg

SEQ ID NO: 27924 - RNA, 20 nt, Artificial Sequence
  Synthetic
agguguccucgggccccggg

SEQ ID NO: 27925 - RNA, 20 nt, Artificial Sequence
  Synthetic
cuguuccacuccgacgcggg

SEQ ID NO: 27926 - RNA, 20 nt, Artificial Sequence
  Synthetic
gcgcggggcugucucgcggg

SEQ ID NO: 27927 - RNA, 20 nt, Artificial Sequence
  Synthetic
gcguccaccggcacggcggg

SEQ ID NO: 27928 - RNA, 20 nt, Artificial Sequence
  Synthetic
uucccccugcggccggcggg

SEQ ID NO: 27929 - RNA, 20 nt, Artificial Sequence
  Synthetic
gcgcgcgcaggcgcggcggg

SEQ ID NO: 27930 - RNA, 20 nt, Artificial Sequence
  Synthetic
ggcgcucuucggggggcggg

SEQ ID NO: 27931 - RNA, 20 nt, Artificial Sequence
  Synthetic
uccgccucuuccucugcggg

SEQ ID NO: 27932 - RNA, 20 nt, Artificial Sequence
  Synthetic
cggcggcgccccguugcggg

SEQ ID NO: 27933 - RNA, 20 nt, Artificial Sequence
  Synthetic
gggggcgucggguagucggg

SEQ ID NO: 27934 - RNA, 20 nt, Artificial Sequence
  Synthetic
accgacgcgcgcgggucggg

SEQ ID NO: 27935 - RNA, 20 nt, Artificial Sequence
  Synthetic
gcgccggggcgcucuucggg

SEQ ID NO: 27936 - RNA, 20 nt, Artificial Sequence
  Synthetic
guccgugccgggccacgggg

SEQ ID NO: 27937 - RNA, 20 nt, Artificial Sequence
  Synthetic
gguguccucgggccccgggg

SEQ ID NO: 27938 - RNA, 20 nt, Artificial Sequence
  Synthetic
gcggcccggggcccgcgggg

SEQ ID NO: 27939 - RNA, 20 nt, Artificial Sequence
  Synthetic
ggcgaggggcgagcgcgggg

SEQ ID NO: 27940 - RNA, 20 nt, Artificial Sequence
  Synthetic
ggggcggcggcggcgcgggg

SEQ ID NO: 27941 - RNA, 20 nt, Artificial Sequence
  Synthetic
gccccucgccccccaggggg

SEQ ID NO: 27942 - RNA, 20 nt, Artificial Sequence
  Synthetic
cccccacgccgcggaggggg

SEQ ID NO: 27943 - RNA, 20 nt, Artificial Sequence
  Synthetic
gcucgcagacaccacggggg

SEQ ID NO: 27944 - RNA, 20 nt, Artificial Sequence
  Synthetic
guguccucgggccccggggg

SEQ ID NO: 27945 - RNA, 20 nt, Artificial Sequence
  Synthetic
acccgcgccucuuccggggg

SEQ ID NO: 27946 - RNA, 20 nt, Artificial Sequence
  Synthetic
agagcgccccggcgcggggg

SEQ ID NO: 27947 - RNA, 20 nt, Artificial Sequence
  Synthetic
cgccccguugcgggcggggg

SEQ ID NO: 27948 - RNA, 20 nt, Artificial Sequence
  Synthetic
ccggggcgcucuucgggggg

SEQ ID NO: 27949 - RNA, 20 nt, Artificial Sequence
  Synthetic
cgugccgggccacggggggg

SEQ ID NO: 27950 - RNA, 20 nt, Artificial Sequence
  Synthetic
uccucgggccccgggggggg

SEQ ID NO: 27951 - RNA, 20 nt, Artificial Sequence
  Synthetic
ccccuccgcggcgugggggg

SEQ ID NO: 27952 - RNA, 20 nt, Artificial Sequence
  Synthetic
gugggaucugggucuggggg

SEQ ID NO: 27953 - RNA, 20 nt, Artificial Sequence
  Synthetic
gagucgcugaugacuauggg

SEQ ID NO: 27954 - RNA, 20 nt, Artificial Sequence
  Synthetic
cuuggcccccacccccuggg

SEQ ID NO: 27955 - RNA, 20 nt, Artificial Sequence
  Synthetic
ccgcgcucccugucgcuggg

SEQ ID NO: 27956 - RNA, 20 nt, Artificial Sequence
  Synthetic
ucgggucgcggcgggcuggg

SEQ ID NO: 27957 - RNA, 20 nt, Artificial Sequence
  Synthetic
cgcccccuccgcggcguggg

SEQ ID NO: 27958 - RNA, 20 nt, Artificial Sequence
  Synthetic
agagucgcugaugacuaugg

SEQ ID NO: 27959 - RNA, 20 nt, Artificial Sequence
  Synthetic
cuuugaccagggcacccugg

SEQ ID NO: 27960 - RNA, 20 nt, Artificial Sequence
  Synthetic
ucuuggcccccacccccugg

SEQ ID NO: 27961 - RNA, 20 nt, Artificial Sequence
  Synthetic
ggugcugaacgacccgcugg

SEQ ID NO: 27962 - RNA, 20 nt, Artificial Sequence
  Synthetic
cccgcgcucccugucgcugg

SEQ ID NO: 27963 - RNA, 20 nt, Artificial Sequence
  Synthetic
uccucugcgggcggggcugg

SEQ ID NO: 27964 - RNA, 20 nt, Artificial Sequence
  Synthetic
ggggugggaucugggucugg

SEQ ID NO: 27965 - RNA, 20 nt, Artificial Sequence
  Synthetic
ggaccagacggggaacgugg

SEQ ID NO: 27966 - RNA, 20 nt, Artificial Sequence
  Synthetic
cgacccccggacccgcgugg

SEQ ID NO: 27967 - RNA, 20 nt, Artificial Sequence
  Synthetic
ccgcccccuccgcggcgugg

SEQ ID NO: 27968 - RNA, 20 nt, Artificial Sequence
  Synthetic
ccucgccccccagggggugg

SEQ ID NO: 27969 - RNA, 20 nt, Artificial Sequence
  Synthetic
gagagucgcugaugacuaug

SEQ ID NO: 27970 - RNA, 20 nt, Artificial Sequence
  Synthetic
ggaccacguaggccccuaug

SEQ ID NO: 27971 - RNA, 20 nt, Artificial Sequence
  Synthetic
gcggcgcgccccgacgacug

SEQ ID NO: 27972 - RNA, 20 nt, Artificial Sequence
  Synthetic
cucuuggcccccacccccug

SEQ ID NO: 27973 - RNA, 20 nt, Artificial Sequence
  Synthetic
aguggccucucuucccccug

SEQ ID NO: 27974 - RNA, 20 nt, Artificial Sequence
  Synthetic
cgcguccgcguccggcgcug

SEQ ID NO: 27975 - RNA, 20 nt, Artificial Sequence
  Synthetic
ccccgcgcucccugucgcug

SEQ ID NO: 27976 - RNA, 20 nt, Artificial Sequence
  Synthetic
ggaacguggcggaccugcug

SEQ ID NO: 27977 - RNA, 20 nt, Artificial Sequence
  Synthetic
cuccuccgccucuuccucug

SEQ ID NO: 27978 - RNA, 20 nt, Artificial Sequence
  Synthetic
gggggugggaucugggucug

SEQ ID NO: 27979 - RNA, 20 nt, Artificial Sequence
  Synthetic
uggaggccgaggcggccgug

SEQ ID NO: 27980 - RNA, 20 nt, Artificial Sequence
  Synthetic
cgaugggcagguagcgcgug

SEQ ID NO: 27981 - RNA, 20 nt, Artificial Sequence
  Synthetic
gccgcccccuccgcggcgug

SEQ ID NO: 27982 - RNA, 20 nt, Artificial Sequence
  Synthetic
agcacgcgcgcaacugcgug

SEQ ID NO: 27983 - RNA, 20 nt, Artificial Sequence
  Synthetic
ccggcgcgggggcggcggug

SEQ ID NO: 27984 - RNA, 20 nt, Artificial Sequence
  Synthetic
cgugcucggggagcagggug

SEQ ID NO: 27985 - RNA, 20 nt, Artificial Sequence
  Synthetic
cccucgccccccagggggug

SEQ ID NO: 27986 - RNA, 20 nt, Artificial Sequence
  Synthetic
ggggcccgaggacaccugug

SEQ ID NO: 27987 - RNA, 20 nt, Artificial Sequence
  Synthetic
gcagcggcggcgccccguug

SEQ ID NO: 27988 - RNA, 20 nt, Artificial Sequence
  Synthetic
gacauggagacgggccacau

SEQ ID NO: 27989 - RNA, 20 nt, Artificial Sequence
  Synthetic
acgcucgagacccccgcgau

SEQ ID NO: 27990 - RNA, 20 nt, Artificial Sequence
  Synthetic
guccgggggucguucacuau

SEQ ID NO: 27991 - RNA, 20 nt, Artificial Sequence
  Synthetic
ggagagucgcugaugacuau

SEQ ID NO: 27992 - RNA, 20 nt, Artificial Sequence
  Synthetic
gccgcgccgggccccggacu

SEQ ID NO: 27993 - RNA, 20 nt, Artificial Sequence
  Synthetic
ccgggccccggacucggacu

SEQ ID NO: 27994 - RNA, 20 nt, Artificial Sequence
  Synthetic
gaagaggcgcgggucggacu

SEQ ID NO: 27995 - RNA, 20 nt, Artificial Sequence
  Synthetic
ccucuuggcccccacccccu

SEQ ID NO: 27996 - RNA, 20 nt, Artificial Sequence
  Synthetic
gagagacgagaaaccucccu

SEQ ID NO: 27997 - RNA, 20 nt, Artificial Sequence
  Synthetic
uugggugucggucugagccu

SEQ ID NO: 27998 - RNA, 20 nt, Artificial Sequence
  Synthetic
gccggcccgcacggccgccu

SEQ ID NO: 27999 - RNA, 20 nt, Artificial Sequence
  Synthetic
ggcggcggcgaccgcggccu

SEQ ID NO: 28000 - RNA, 20 nt, Artificial Sequence
  Synthetic
gaugacuauggggggcuccu

SEQ ID NO: 28001 - RNA, 20 nt, Artificial Sequence
  Synthetic
cuccuccgcacagguguccu

SEQ ID NO: 28002 - RNA, 20 nt, Artificial Sequence
  Synthetic
gucuuccuggcacacuuccu

SEQ ID NO: 28003 - RNA, 20 nt, Artificial Sequence
  Synthetic
ucgcguccgcguccggcgcu

SEQ ID NO: 28004 - RNA, 20 nt, Artificial Sequence
  Synthetic
gccccgcgcucccugucgcu

SEQ ID NO: 28005 - RNA, 20 nt, Artificial Sequence
  Synthetic
cgggucgcgggccccgggcu

SEQ ID NO: 28006 - RNA, 20 nt, Artificial Sequence
  Synthetic
cggucgggucgcggcgggcu

SEQ ID NO: 28007 - RNA, 20 nt, Artificial Sequence
  Synthetic
cacgcaguugcgcgcgugcu

SEQ ID NO: 28008 - RNA, 20 nt, Artificial Sequence
  Synthetic
cccggcccagacucugugcu

SEQ ID NO: 28009 - RNA, 20 nt, Artificial Sequence
  Synthetic
ugcgggcgggggugggaucu

SEQ ID NO: 28010 - RNA, 20 nt, Artificial Sequence
  Synthetic
gggggaagagaggccacucu

SEQ ID NO: 28011 - RNA, 20 nt, Artificial Sequence
  Synthetic
ccggcgcggcgccgcccucu

SEQ ID NO: 28012 - RNA, 20 nt, Artificial Sequence
  Synthetic
gacacccaagcacagagucu

SEQ ID NO: 28013 - RNA, 20 nt, Artificial Sequence
  Synthetic
cgggggugggaucugggucu

SEQ ID NO: 28014 - RNA, 20 nt, Artificial Sequence
  Synthetic
ggucgcgccacccguggucu

SEQ ID NO: 28015 - RNA, 20 nt, Artificial Sequence
  Synthetic
ccgguggcguaccugauagu

SEQ ID NO: 28016 - RNA, 20 nt, Artificial Sequence
  Synthetic
cgcggggggcgucggguagu

SEQ ID NO: 28017 - RNA, 20 nt, Artificial Sequence
  Synthetic
cugguccacgaggaccacgu

SEQ ID NO: 28018 - RNA, 20 nt, Artificial Sequence
  Synthetic
cgcgggcgccgcgcccccgu

SEQ ID NO: 28019 - RNA, 20 nt, Artificial Sequence
  Synthetic
cuacccgacgccccccgcgu

SEQ ID NO: 28020 - RNA, 20 nt, Artificial Sequence
  Synthetic
cccucccgacccgcgcgcgu

SEQ ID NO: 28021 - RNA, 20 nt, Artificial Sequence
  Synthetic
cgccgcccccuccgcggcgu

SEQ ID NO: 28022 - RNA, 20 nt, Artificial Sequence
  Synthetic
cacuccgacgcggggggcgu

SEQ ID NO: 28023 - RNA, 20 nt, Artificial Sequence
  Synthetic
gggaggucugccacagucgu

SEQ ID NO: 28024 - RNA, 20 nt, Artificial Sequence
  Synthetic
agccucuggaugaccccggu

SEQ ID NO: 28025 - RNA, 20 nt, Artificial Sequence
  Synthetic
gggcgccagggggcgccggu

SEQ ID NO: 28026 - RNA, 20 nt, Artificial Sequence
  Synthetic
cgcgaccgacgcgcgcgggu

SEQ ID NO: 28027 - RNA, 20 nt, Artificial Sequence
  Synthetic
cccccggaagaggcgcgggu

SEQ ID NO: 28028 - RNA, 20 nt, Artificial Sequence
  Synthetic
cgcgcgcaggcgcggcgggu

SEQ ID NO: 28029 - RNA, 20 nt, Artificial Sequence
  Synthetic
ccccucgccccccagggggu

SEQ ID NO: 28030 - RNA, 20 nt, Artificial Sequence
  Synthetic
gccccguugcgggcgggggu

SEQ ID NO: 28031 - RNA, 20 nt, Artificial Sequence
  Synthetic
gugccgggccacgggggggu

SEQ ID NO: 28032 - RNA, 20 nt, Artificial Sequence
  Synthetic
uuugaccagggcacccuggu

SEQ ID NO: 28033 - RNA, 20 nt, Artificial Sequence
  Synthetic
ccucugcgggcggggcuggu

SEQ ID NO: 28034 - RNA, 20 nt, Artificial Sequence
  Synthetic
gggggcggcaccgggggugu

SEQ ID NO: 28035 - RNA, 20 nt, Artificial Sequence
  Synthetic
cagacucugugcuugggugu

SEQ ID NO: 28036 - RNA, 20 nt, Artificial Sequence
  Synthetic
ccggcccagacucugugcuu

SEQ ID NO: 28037 - RNA, 20 nt, Artificial Sequence
  Synthetic
ccccgcgccggggcgcucuu

SEQ ID NO: 28038 - RNA, 18 nt, Artificial Sequence
  Synthetic
gggacacguguugcgcaa

SEQ ID NO: 28039 - RNA, 19 nt, Artificial Sequence
  Synthetic
ggggacacguguugcgcaa

SEQ ID NO: 28040 - RNA, 24 nt, Artificial Sequence
  Synthetic
gcacaggggacacguguugcgcaa

SEQ ID NO: 28041 - RNA, 22 nt, Artificial Sequence
  Synthetic
gucuucaugcacgggaugcaga

SEQ ID NO: 28042 - RNA, 23 nt, Artificial Sequence
  Synthetic
ggucuucaugcacgggaugcaga

SEQ ID NO: 28043 - RNA, 21 nt, Artificial Sequence
  Synthetic
gcccgggagcucgugccgggc

SEQ ID NO: 28044 - RNA, 21 nt, Artificial Sequence
  Synthetic
gccgcggcggccgcucggggc

SEQ ID NO: 28045 - RNA, 23 nt, Artificial Sequence
  Synthetic
guccgugcugcccgccucggagg

SEQ ID NO: 28046 - RNA, 23 nt, Artificial Sequence
  Synthetic
gauucccaccucggucuccuccu

SEQ ID NO: 28047 - RNA, 19 nt, Artificial Sequence
  Synthetic
gcaucccgugcaugaagac

SEQ ID NO: 28048 - RNA, 21 nt, Artificial Sequence
  Synthetic
ggauccugugggggugggccc

SEQ ID NO: 28049 - RNA, 22 nt, Artificial Sequence
  Synthetic
gggauccugugggggugggccc

SEQ ID NO: 28050 - RNA, 21 nt, Artificial Sequence
  Synthetic
gccccacgcccgccgacgcgc

SEQ ID NO: 28051 - RNA, 24 nt, Artificial Sequence
  Synthetic
gcagccccacgcccgccgacgcgc

SEQ ID NO: 28052 - RNA, 22 nt, Artificial Sequence
  Synthetic
gaucgccccgccccugcgcugc

SEQ ID NO: 28053 - RNA, 24 nt, Artificial Sequence
  Synthetic
gagaucgccccgccccugcgcugc

SEQ ID NO: 28054 - RNA, 23 nt, Artificial Sequence
  Synthetic
gacucggaggaggagaccgaggu

SEQ ID NO: 28055 - RNA, 18 nt, Artificial Sequence
  Synthetic
gacgcgcagggauccugu

SEQ ID NO: 28056 - RNA, 21 nt, Artificial Sequence
  Synthetic
gccgacgcgcagggauccugu

SEQ ID NO: 28057 - RNA, 20 nt, Artificial Sequence
  Synthetic
aggggacacguguugcgcaa

SEQ ID NO: 28058 - RNA, 21 nt, Artificial Sequence
  Synthetic
caggggacacguguugcgcaa

SEQ ID NO: 28059 - RNA, 22 nt, Artificial Sequence
  Synthetic
acaggggacacguguugcgcaa

SEQ ID NO: 28060 - RNA, 23 nt, Artificial Sequence
  Synthetic
cacaggggacacguguugcgcaa

SEQ ID NO: 28061 - RNA, 18 nt, Artificial Sequence
  Synthetic
cccacgggcccaccccca

SEQ ID NO: 28062 - RNA, 19 nt, Artificial Sequence
  Synthetic
acccacgggcccaccccca

SEQ ID NO: 28063 - RNA, 20 nt, Artificial Sequence
  Synthetic
cacccacgggcccaccccca

SEQ ID NO: 28064 - RNA, 21 nt, Artificial Sequence
  Synthetic
ucacccacgggcccaccccca

SEQ ID NO: 28065 - RNA, 22 nt, Artificial Sequence
  Synthetic
cucacccacgggcccaccccca

SEQ ID NO: 28066 - RNA, 23 nt, Artificial Sequence
  Synthetic
ccucacccacgggcccaccccca

SEQ ID NO: 28067 - RNA, 24 nt, Artificial Sequence
  Synthetic
uccucacccacgggcccaccccca

SEQ ID NO: 28068 - RNA, 21 nt, Artificial Sequence
  Synthetic
cggaauccaggucuucaugca

SEQ ID NO: 28069 - RNA, 22 nt, Artificial Sequence
  Synthetic
acggaauccaggucuucaugca

SEQ ID NO: 28070 - RNA, 23 nt, Artificial Sequence
  Synthetic
aacggaauccaggucuucaugca

SEQ ID NO: 28071 - RNA, 24 nt, Artificial Sequence
  Synthetic
caacggaauccaggucuucaugca

SEQ ID NO: 28072 - RNA, 18 nt, Artificial Sequence
  Synthetic
ucaugcacgggaugcaga

SEQ ID NO: 28073 - RNA, 19 nt, Artificial Sequence
  Synthetic
uucaugcacgggaugcaga

SEQ ID NO: 28074 - RNA, 20 nt, Artificial Sequence
  Synthetic
cuucaugcacgggaugcaga

SEQ ID NO: 28075 - RNA, 21 nt, Artificial Sequence
  Synthetic
ucuucaugcacgggaugcaga

SEQ ID NO: 28076 - RNA, 24 nt, Artificial Sequence
  Synthetic
aggucuucaugcacgggaugcaga

SEQ ID NO: 28077 - RNA, 18 nt, Artificial Sequence
  Synthetic
cgggagcucgugccgggc

SEQ ID NO: 28078 - RNA, 19 nt, Artificial Sequence
  Synthetic
ccgggagcucgugccgggc

SEQ ID NO: 28079 - RNA, 20 nt, Artificial Sequence
  Synthetic
cccgggagcucgugccgggc

SEQ ID NO: 28080 - RNA, 22 nt, Artificial Sequence
  Synthetic
cgcccgggagcucgugccgggc

SEQ ID NO: 28081 - RNA, 23 nt, Artificial Sequence
  Synthetic
ccgcccgggagcucgugccgggc

SEQ ID NO: 28082 - RNA, 24 nt, Artificial Sequence
  Synthetic
uccgcccgggagcucgugccgggc

SEQ ID NO: 28083 - RNA, 22 nt, Artificial Sequence
  Synthetic
ugccgcggcggccgcucggggc

SEQ ID NO: 28084 - RNA, 23 nt, Artificial Sequence
  Synthetic
cugccgcggcggccgcucggggc

SEQ ID NO: 28085 - RNA, 24 nt, Artificial Sequence
  Synthetic
ucugccgcggcggccgcucggggc

SEQ ID NO: 28086 - RNA, 21 nt, Artificial Sequence
  Synthetic
ccgugcugcccgccucggagg

SEQ ID NO: 28087 - RNA, 22 nt, Artificial Sequence
  Synthetic
uccgugcugcccgccucggagg

SEQ ID NO: 28088 - RNA, 24 nt, Artificial Sequence
  Synthetic
uguccgugcugcccgccucggagg

SEQ ID NO: 28089 - RNA, 21 nt, Artificial Sequence
  Synthetic
uucccaccucggucuccuccu

SEQ ID NO: 28090 - RNA, 22 nt, Artificial Sequence
  Synthetic
auucccaccucggucuccuccu

SEQ ID NO: 28091 - RNA, 24 nt, Artificial Sequence
  Synthetic
agauucccaccucggucuccuccu

SEQ ID NO: 28092 - RNA, 18 nt, Artificial Sequence
  Synthetic
caucccgugcaugaagac

SEQ ID NO: 28093 - RNA, 20 nt, Artificial Sequence
  Synthetic
ugcaucccgugcaugaagac

SEQ ID NO: 28094 - RNA, 23 nt, Artificial Sequence
  Synthetic
agggauccugugggggugggccc

SEQ ID NO: 28095 - RNA, 24 nt, Artificial Sequence
  Synthetic
cagggauccugugggggugggccc

SEQ ID NO: 28096 - RNA, 22 nt, Artificial Sequence
  Synthetic
agccccacgcccgccgacgcgc

SEQ ID NO: 28097 - RNA, 23 nt, Artificial Sequence
  Synthetic
cagccccacgcccgccgacgcgc

SEQ ID NO: 28098 - RNA, 21 nt, Artificial Sequence
  Synthetic
aucgccccgccccugcgcugc

SEQ ID NO: 28099 - RNA, 23 nt, Artificial Sequence
  Synthetic
agaucgccccgccccugcgcugc

SEQ ID NO: 28100 - RNA, 21 nt, Artificial Sequence
  Synthetic
cucggaggaggagaccgaggu

SEQ ID NO: 28101 - RNA, 22 nt, Artificial Sequence
  Synthetic
acucggaggaggagaccgaggu

SEQ ID NO: 28102 - RNA, 24 nt, Artificial Sequence
  Synthetic
cgacucggaggaggagaccgaggu

SEQ ID NO: 28103 - RNA, 19 nt, Artificial Sequence
  Synthetic
cgacgcgcagggauccugu

SEQ ID NO: 28104 - RNA, 20 nt, Artificial Sequence
  Synthetic
ccgacgcgcagggauccugu

SEQ ID NO: 28105 - RNA, 22 nt, Artificial Sequence
  Synthetic
cgccgacgcgcagggauccugu

SEQ ID NO: 28106 - RNA, 23 nt, Artificial Sequence
  Synthetic
ccgccgacgcgcagggauccugu

SEQ ID NO: 28107 - RNA, 24 nt, Artificial Sequence
  Synthetic
cccgccgacgcgcagggauccugu

SEQ ID NO: 28108 - RNA, 18 nt, Artificial Sequence
  Synthetic
aauccaggucuucaugca

SEQ ID NO: 28109 - RNA, 19 nt, Artificial Sequence
  Synthetic
gaauccaggucuucaugca

SEQ ID NO: 28110 - RNA, 20 nt, Artificial Sequence
  Synthetic
ggaauccaggucuucaugca

SEQ ID NO: 28111 - RNA, 18 nt, Artificial Sequence
  Synthetic
gcggcggccgcucggggc

SEQ ID NO: 28112 - RNA, 19 nt, Artificial Sequence
  Synthetic
cgcggcggccgcucggggc

SEQ ID NO: 28113 - RNA, 20 nt, Artificial Sequence
  Synthetic
ccgcggcggccgcucggggc

SEQ ID NO: 28114 - RNA, 18 nt, Artificial Sequence
  Synthetic
ugcugcccgccucggagg

SEQ ID NO: 28115 - RNA, 19 nt, Artificial Sequence
  Synthetic
gugcugcccgccucggagg

SEQ ID NO: 28116 - RNA, 20 nt, Artificial Sequence
  Synthetic
cgugcugcccgccucggagg

SEQ ID NO: 28117 - RNA, 18 nt, Artificial Sequence
  Synthetic
ccaccucggucuccuccu

SEQ ID NO: 28118 - RNA, 19 nt, Artificial Sequence
  Synthetic
cccaccucggucuccuccu

SEQ ID NO: 28119 - RNA, 20 nt, Artificial Sequence
  Synthetic
ucccaccucggucuccuccu

SEQ ID NO: 28120 - RNA, 21 nt, Artificial Sequence
  Synthetic
cugcaucccgugcaugaagac

SEQ ID NO: 28121 - RNA, 22 nt, Artificial Sequence
  Synthetic
ucugcaucccgugcaugaagac

SEQ ID NO: 28122 - RNA, 23 nt, Artificial Sequence
  Synthetic
uucugcaucccgugcaugaagac

SEQ ID NO: 28123 - RNA, 24 nt, Artificial Sequence
  Synthetic
cuucugcaucccgugcaugaagac

SEQ ID NO: 28124 - RNA, 18 nt, Artificial Sequence
  Synthetic
uccugugggggugggccc

SEQ ID NO: 28125 - RNA, 19 nt, Artificial Sequence
  Synthetic
auccugugggggugggccc

SEQ ID NO: 28126 - RNA, 20 nt, Artificial Sequence
  Synthetic
gauccugugggggugggccc

SEQ ID NO: 28127 - RNA, 18 nt, Artificial Sequence
  Synthetic
ccacgcccgccgacgcgc

SEQ ID NO: 28128 - RNA, 19 nt, Artificial Sequence
  Synthetic
cccacgcccgccgacgcgc

SEQ ID NO: 28129 - RNA, 20 nt, Artificial Sequence
  Synthetic
ccccacgcccgccgacgcgc

SEQ ID NO: 28130 - RNA, 18 nt, Artificial Sequence
  Synthetic
gccccgccccugcgcugc

SEQ ID NO: 28131 - RNA, 19 nt, Artificial Sequence
  Synthetic
cgccccgccccugcgcugc

SEQ ID NO: 28132 - RNA, 20 nt, Artificial Sequence
  Synthetic
ucgccccgccccugcgcugc

SEQ ID NO: 28133 - RNA, 18 nt, Artificial Sequence
  Synthetic
cgccgccccgcacgccug

SEQ ID NO: 28134 - RNA, 19 nt, Artificial Sequence
  Synthetic
ccgccgccccgcacgccug

SEQ ID NO: 28135 - RNA, 20 nt, Artificial Sequence
  Synthetic
cccgccgccccgcacgccug

SEQ ID NO: 28136 - RNA, 18 nt, Artificial Sequence
  Synthetic
ggaggaggagaccgaggu

SEQ ID NO: 28137 - RNA, 19 nt, Artificial Sequence
  Synthetic
cggaggaggagaccgaggu

SEQ ID NO: 28138 - RNA, 20 nt, Artificial Sequence
  Synthetic
ucggaggaggagaccgaggu

SEQ ID NO: 28139 - RNA, 18 nt, Artificial Sequence
  Synthetic
ggggacacguguugcgca

SEQ ID NO: 28140 - RNA, 19 nt, Artificial Sequence
  Synthetic
aggggacacguguugcgca

SEQ ID NO: 28141 - RNA, 20 nt, Artificial Sequence
  Synthetic
caggggacacguguugcgca

SEQ ID NO: 28142 - RNA, 21 nt, Artificial Sequence
  Synthetic
acaggggacacguguugcgca

SEQ ID NO: 28143 - RNA, 22 nt, Artificial Sequence
  Synthetic
cacaggggacacguguugcgca

SEQ ID NO: 28144 - RNA, 23 nt, Artificial Sequence
  Synthetic
gcacaggggacacguguugcgca

SEQ ID NO: 28145 - RNA, 24 nt, Artificial Sequence
  Synthetic
ugcacaggggacacguguugcgca

SEQ ID NO: 28146 - RNA, 18 nt, Artificial Sequence
  Synthetic
gcagaaggggugcaggca

SEQ ID NO: 28147 - RNA, 19 nt, Artificial Sequence
  Synthetic
ugcagaaggggugcaggca

SEQ ID NO: 28148 - RNA, 20 nt, Artificial Sequence
  Synthetic
augcagaaggggugcaggca

SEQ ID NO: 28149 - RNA, 21 nt, Artificial Sequence
  Synthetic
gaugcagaaggggugcaggca

SEQ ID NO: 28150 - RNA, 22 nt, Artificial Sequence
  Synthetic
ggaugcagaaggggugcaggca

SEQ ID NO: 28151 - RNA, 23 nt, Artificial Sequence
  Synthetic
gggaugcagaaggggugcaggca

SEQ ID NO: 28152 - RNA, 24 nt, Artificial Sequence
  Synthetic
cgggaugcagaaggggugcaggca

SEQ ID NO: 28153 - RNA, 18 nt, Artificial Sequence
  Synthetic
uccgcuuccuccucaccc

SEQ ID NO: 28154 - RNA, 19 nt, Artificial Sequence
  Synthetic
uuccgcuuccuccucaccc

SEQ ID NO: 28155 - RNA, 20 nt, Artificial Sequence
  Synthetic
cuuccgcuuccuccucaccc

SEQ ID NO: 28156 - RNA, 21 nt, Artificial Sequence
  Synthetic
gcuuccgcuuccuccucaccc

SEQ ID NO: 28157 - RNA, 22 nt, Artificial Sequence
  Synthetic
cgcuuccgcuuccuccucaccc

SEQ ID NO: 28158 - RNA, 23 nt, Artificial Sequence
  Synthetic
ccgcuuccgcuuccuccucaccc

SEQ ID NO: 28159 - RNA, 24 nt, Artificial Sequence
  Synthetic
cccgcuuccgcuuccuccucaccc

SEQ ID NO: 28160 - RNA, 18 nt, Artificial Sequence
  Synthetic
cggggccgggguccgccc

SEQ ID NO: 28161 - RNA, 19 nt, Artificial Sequence
  Synthetic
ucggggccgggguccgccc

SEQ ID NO: 28162 - RNA, 20 nt, Artificial Sequence
  Synthetic
cucggggccgggguccgccc

SEQ ID NO: 28163 - RNA, 21 nt, Artificial Sequence
  Synthetic
gcucggggccgggguccgccc

SEQ ID NO: 28164 - RNA, 22 nt, Artificial Sequence
  Synthetic
cgcucggggccgggguccgccc

SEQ ID NO: 28165 - RNA, 23 nt, Artificial Sequence
  Synthetic
ccgcucggggccgggguccgccc

SEQ ID NO: 28166 - RNA, 24 nt, Artificial Sequence
  Synthetic
gccgcucggggccgggguccgccc

SEQ ID NO: 28167 - RNA, 18 nt, Artificial Sequence
  Synthetic
gcguccaucaggcccgcc

SEQ ID NO: 28168 - RNA, 19 nt, Artificial Sequence
  Synthetic
cgcguccaucaggcccgcc

SEQ ID NO: 28169 - RNA, 20 nt, Artificial Sequence
  Synthetic
ccgcguccaucaggcccgcc

SEQ ID NO: 28170 - RNA, 21 nt, Artificial Sequence
  Synthetic
gccgcguccaucaggcccgcc

SEQ ID NO: 28171 - RNA, 22 nt, Artificial Sequence
  Synthetic
ggccgcguccaucaggcccgcc

SEQ ID NO: 28172 - RNA, 23 nt, Artificial Sequence
  Synthetic
uggccgcguccaucaggcccgcc

SEQ ID NO: 28173 - RNA, 24 nt, Artificial Sequence
  Synthetic
guggccgcguccaucaggcccgcc

SEQ ID NO: 28174 - RNA, 18 nt, Artificial Sequence
  Synthetic
guguccgugcugcccgcc

SEQ ID NO: 28175 - RNA, 19 nt, Artificial Sequence
  Synthetic
cguguccgugcugcccgcc

SEQ ID NO: 28176 - RNA, 20 nt, Artificial Sequence
  Synthetic
ccguguccgugcugcccgcc

SEQ ID NO: 28177 - RNA, 21 nt, Artificial Sequence
  Synthetic
uccguguccgugcugcccgcc

SEQ ID NO: 28178 - RNA, 22 nt, Artificial Sequence
  Synthetic
cuccguguccgugcugcccgcc

SEQ ID NO: 28179 - RNA, 23 nt, Artificial Sequence
  Synthetic
ucuccguguccgugcugcccgcc

SEQ ID NO: 28180 - RNA, 24 nt, Artificial Sequence
  Synthetic
aucuccguguccgugcugcccgcc

SEQ ID NO: 28181 - RNA, 18 nt, Artificial Sequence
  Synthetic
ucggggccgggguccgcc

SEQ ID NO: 28182 - RNA, 19 nt, Artificial Sequence
  Synthetic
cucggggccgggguccgcc

SEQ ID NO: 28183 - RNA, 20 nt, Artificial Sequence
  Synthetic
gcucggggccgggguccgcc

SEQ ID NO: 28184 - RNA, 21 nt, Artificial Sequence
  Synthetic
cgcucggggccgggguccgcc

SEQ ID NO: 28185 - RNA, 22 nt, Artificial Sequence
  Synthetic
ccgcucggggccgggguccgcc

SEQ ID NO: 28186 - RNA, 23 nt, Artificial Sequence
  Synthetic
gccgcucggggccgggguccgcc

SEQ ID NO: 28187 - RNA, 24 nt, Artificial Sequence
  Synthetic
ggccgcucggggccgggguccgcc

SEQ ID NO: 28188 - RNA, 18 nt, Artificial Sequence
  Synthetic
cugcccuggcgcucggcc

SEQ ID NO: 28189 - RNA, 19 nt, Artificial Sequence
  Synthetic
gcugcccuggcgcucggcc

SEQ ID NO: 28190 - RNA, 20 nt, Artificial Sequence
  Synthetic
ggcugcccuggcgcucggcc

SEQ ID NO: 28191 - RNA, 21 nt, Artificial Sequence
  Synthetic
gggcugcccuggcgcucggcc

SEQ ID NO: 28192 - RNA, 22 nt, Artificial Sequence
  Synthetic
ggggcugcccuggcgcucggcc

SEQ ID NO: 28193 - RNA, 23 nt, Artificial Sequence
  Synthetic
uggggcugcccuggcgcucggcc

SEQ ID NO: 28194 - RNA, 24 nt, Artificial Sequence
  Synthetic
guggggcugcccuggcgcucggcc

SEQ ID NO: 28195 - RNA, 18 nt, Artificial Sequence
  Synthetic
ucggccgggggccgggcc

SEQ ID NO: 28196 - RNA, 19 nt, Artificial Sequence
  Synthetic
cucggccgggggccgggcc

SEQ ID NO: 28197 - RNA, 20 nt, Artificial Sequence
  Synthetic
gcucggccgggggccgggcc

SEQ ID NO: 28198 - RNA, 21 nt, Artificial Sequence
  Synthetic
cgcucggccgggggccgggcc

SEQ ID NO: 28199 - RNA, 22 nt, Artificial Sequence
  Synthetic
gcgcucggccgggggccgggcc

SEQ ID NO: 28200 - RNA, 23 nt, Artificial Sequence
  Synthetic
ggcgcucggccgggggccgggcc

SEQ ID NO: 28201 - RNA, 24 nt, Artificial Sequence
  Synthetic
uggcgcucggccgggggccgggcc

SEQ ID NO: 28202 - RNA, 18 nt, Artificial Sequence
  Synthetic
gucugccgcggcggccgc

SEQ ID NO: 28203 - RNA, 19 nt, Artificial Sequence
  Synthetic
ggucugccgcggcggccgc

SEQ ID NO: 28204 - RNA, 20 nt, Artificial Sequence
  Synthetic
gggucugccgcggcggccgc

SEQ ID NO: 28205 - RNA, 21 nt, Artificial Sequence
  Synthetic
ggggucugccgcggcggccgc

SEQ ID NO: 28206 - RNA, 22 nt, Artificial Sequence
  Synthetic
gggggucugccgcggcggccgc

SEQ ID NO: 28207 - RNA, 23 nt, Artificial Sequence
  Synthetic
cgggggucugccgcggcggccgc

SEQ ID NO: 28208 - RNA, 24 nt, Artificial Sequence
  Synthetic
ccgggggucugccgcggcggccgc

SEQ ID NO: 28209 - RNA, 18 nt, Artificial Sequence
  Synthetic
cucggggccgggguccgc

SEQ ID NO: 28210 - RNA, 19 nt, Artificial Sequence
  Synthetic
gcucggggccgggguccgc

SEQ ID NO: 28211 - RNA, 20 nt, Artificial Sequence
  Synthetic
cgcucggggccgggguccgc

SEQ ID NO: 28212 - RNA, 21 nt, Artificial Sequence
  Synthetic
ccgcucggggccgggguccgc

SEQ ID NO: 28213 - RNA, 22 nt, Artificial Sequence
  Synthetic
gccgcucggggccgggguccgc

SEQ ID NO: 28214 - RNA, 23 nt, Artificial Sequence
  Synthetic
ggccgcucggggccgggguccgc

SEQ ID NO: 28215 - RNA, 24 nt, Artificial Sequence
  Synthetic
cggccgcucggggccgggguccgc

SEQ ID NO: 28216 - RNA, 18 nt, Artificial Sequence
  Synthetic
ggaaaacucuggcagcgc

SEQ ID NO: 28217 - RNA, 19 nt, Artificial Sequence
  Synthetic
gggaaaacucuggcagcgc

SEQ ID NO: 28218 - RNA, 20 nt, Artificial Sequence
  Synthetic
agggaaaacucuggcagcgc

SEQ ID NO: 28219 - RNA, 21 nt, Artificial Sequence
  Synthetic
cagggaaaacucuggcagcgc

SEQ ID NO: 28220 - RNA, 22 nt, Artificial Sequence
  Synthetic
gcagggaaaacucuggcagcgc

SEQ ID NO: 28221 - RNA, 23 nt, Artificial Sequence
  Synthetic
ggcagggaaaacucuggcagcgc

SEQ ID NO: 28222 - RNA, 24 nt, Artificial Sequence
  Synthetic
aggcagggaaaacucuggcagcgc

SEQ ID NO: 28223 - RNA, 18 nt, Artificial Sequence
  Synthetic
ugcagaaggggugcaggc

SEQ ID NO: 28224 - RNA, 19 nt, Artificial Sequence
  Synthetic
augcagaaggggugcaggc

SEQ ID NO: 28225 - RNA, 20 nt, Artificial Sequence
  Synthetic
gaugcagaaggggugcaggc

SEQ ID NO: 28226 - RNA, 21 nt, Artificial Sequence
  Synthetic
ggaugcagaaggggugcaggc

SEQ ID NO: 28227 - RNA, 22 nt, Artificial Sequence
  Synthetic
gggaugcagaaggggugcaggc

SEQ ID NO: 28228 - RNA, 23 nt, Artificial Sequence
  Synthetic
cgggaugcagaaggggugcaggc

SEQ ID NO: 28229 - RNA, 24 nt, Artificial Sequence
  Synthetic
acgggaugcagaaggggugcaggc

SEQ ID NO: 28230 - RNA, 18 nt, Artificial Sequence
  Synthetic
gcugcccuggcgcucggc

SEQ ID NO: 28231 - RNA, 19 nt, Artificial Sequence
  Synthetic
ggcugcccuggcgcucggc

SEQ ID NO: 28232 - RNA, 20 nt, Artificial Sequence
  Synthetic
gggcugcccuggcgcucggc

SEQ ID NO: 28233 - RNA, 21 nt, Artificial Sequence
  Synthetic
ggggcugcccuggcgcucggc

SEQ ID NO: 28234 - RNA, 22 nt, Artificial Sequence
  Synthetic
uggggcugcccuggcgcucggc

SEQ ID NO: 28235 - RNA, 23 nt, Artificial Sequence
  Synthetic
guggggcugcccuggcgcucggc

SEQ ID NO: 28236 - RNA, 24 nt, Artificial Sequence
  Synthetic
cguggggcugcccuggcgcucggc

SEQ ID NO: 28237 - RNA, 18 nt, Artificial Sequence
  Synthetic
cucggccgggggccgggc

SEQ ID NO: 28238 - RNA, 19 nt, Artificial Sequence
  Synthetic
gcucggccgggggccgggc

SEQ ID NO: 28239 - RNA, 20 nt, Artificial Sequence
  Synthetic
cgcucggccgggggccgggc

SEQ ID NO: 28240 - RNA, 21 nt, Artificial Sequence
  Synthetic
gcgcucggccgggggccgggc

SEQ ID NO: 28241 - RNA, 22 nt, Artificial Sequence
  Synthetic
ggcgcucggccgggggccgggc

SEQ ID NO: 28242 - RNA, 23 nt, Artificial Sequence
  Synthetic
uggcgcucggccgggggccgggc

SEQ ID NO: 28243 - RNA, 24 nt, Artificial Sequence
  Synthetic
cuggcgcucggccgggggccgggc

SEQ ID NO: 28244 - RNA, 18 nt, Artificial Sequence
  Synthetic
cccugcgcgucggcgggc

SEQ ID NO: 28245 - RNA, 19 nt, Artificial Sequence
  Synthetic
ucccugcgcgucggcgggc

SEQ ID NO: 28246 - RNA, 20 nt, Artificial Sequence
  Synthetic
aucccugcgcgucggcgggc

SEQ ID NO: 28247 - RNA, 21 nt, Artificial Sequence
  Synthetic
gaucccugcgcgucggcgggc

SEQ ID NO: 28248 - RNA, 22 nt, Artificial Sequence
  Synthetic
ggaucccugcgcgucggcgggc

SEQ ID NO: 28249 - RNA, 23 nt, Artificial Sequence
  Synthetic
aggaucccugcgcgucggcgggc

SEQ ID NO: 28250 - RNA, 24 nt, Artificial Sequence
  Synthetic
caggaucccugcgcgucggcgggc

SEQ ID NO: 28251 - RNA, 18 nt, Artificial Sequence
  Synthetic
gaauccaggucuucaugc

SEQ ID NO: 28252 - RNA, 19 nt, Artificial Sequence
  Synthetic
ggaauccaggucuucaugc

SEQ ID NO: 28253 - RNA, 20 nt, Artificial Sequence
  Synthetic
cggaauccaggucuucaugc

SEQ ID NO: 28254 - RNA, 21 nt, Artificial Sequence
  Synthetic
acggaauccaggucuucaugc

SEQ ID NO: 28255 - RNA, 22 nt, Artificial Sequence
  Synthetic
aacggaauccaggucuucaugc

SEQ ID NO: 28256 - RNA, 23 nt, Artificial Sequence
  Synthetic
caacggaauccaggucuucaugc

SEQ ID NO: 28257 - RNA, 24 nt, Artificial Sequence
  Synthetic
gcaacggaauccaggucuucaugc

SEQ ID NO: 28258 - RNA, 18 nt, Artificial Sequence
  Synthetic
uucaugcacgggaugcag

SEQ ID NO: 28259 - RNA, 19 nt, Artificial Sequence
  Synthetic
cuucaugcacgggaugcag

SEQ ID NO: 28260 - RNA, 20 nt, Artificial Sequence
  Synthetic
ucuucaugcacgggaugcag

SEQ ID NO: 28261 - RNA, 21 nt, Artificial Sequence
  Synthetic
gucuucaugcacgggaugcag

SEQ ID NO: 28262 - RNA, 22 nt, Artificial Sequence
  Synthetic
ggucuucaugcacgggaugcag

SEQ ID NO: 28263 - RNA, 23 nt, Artificial Sequence
  Synthetic
aggucuucaugcacgggaugcag

SEQ ID NO: 28264 - RNA, 24 nt, Artificial Sequence
  Synthetic
caggucuucaugcacgggaugcag

SEQ ID NO: 28265 - RNA, 18 nt, Artificial Sequence
  Synthetic
gugcugcccgccucggag

SEQ ID NO: 28266 - RNA, 19 nt, Artificial Sequence
  Synthetic
cgugcugcccgccucggag

SEQ ID NO: 28267 - RNA, 20 nt, Artificial Sequence
  Synthetic
ccgugcugcccgccucggag

SEQ ID NO: 28268 - RNA, 21 nt, Artificial Sequence
  Synthetic
uccgugcugcccgccucggag

SEQ ID NO: 28269 - RNA, 22 nt, Artificial Sequence
  Synthetic
guccgugcugcccgccucggag

SEQ ID NO: 28270 - RNA, 23 nt, Artificial Sequence
  Synthetic
uguccgugcugcccgccucggag

SEQ ID NO: 28271 - RNA, 24 nt, Artificial Sequence
  Synthetic
guguccgugcugcccgccucggag

SEQ ID NO: 28272 - RNA, 18 nt, Artificial Sequence
  Synthetic
gggaaaacucuggcagcg

SEQ ID NO: 28273 - RNA, 19 nt, Artificial Sequence
  Synthetic
agggaaaacucuggcagcg

SEQ ID NO: 28274 - RNA, 20 nt, Artificial Sequence
  Synthetic
cagggaaaacucuggcagcg

SEQ ID NO: 28275 - RNA, 21 nt, Artificial Sequence
  Synthetic
gcagggaaaacucuggcagcg

SEQ ID NO: 28276 - RNA, 22 nt, Artificial Sequence
  Synthetic
ggcagggaaaacucuggcagcg

SEQ ID NO: 28277 - RNA, 23 nt, Artificial Sequence
  Synthetic
aggcagggaaaacucuggcagcg

SEQ ID NO: 28278 - RNA, 24 nt, Artificial Sequence
  Synthetic
caggcagggaaaacucuggcagcg

SEQ ID NO: 28279 - RNA, 18 nt, Artificial Sequence
  Synthetic
cucggagguggagucgcg

SEQ ID NO: 28280 - RNA, 19 nt, Artificial Sequence
  Synthetic
ccucggagguggagucgcg

SEQ ID NO: 28281 - RNA, 20 nt, Artificial Sequence
  Synthetic
gccucggagguggagucgcg

SEQ ID NO: 28282 - RNA, 21 nt, Artificial Sequence
  Synthetic
cgccucggagguggagucgcg

SEQ ID NO: 28283 - RNA, 22 nt, Artificial Sequence
  Synthetic
ccgccucggagguggagucgcg

SEQ ID NO: 28284 - RNA, 23 nt, Artificial Sequence
  Synthetic
cccgccucggagguggagucgcg

SEQ ID NO: 28285 - RNA, 24 nt, Artificial Sequence
  Synthetic
gcccgccucggagguggagucgcg

SEQ ID NO: 28286 - RNA, 18 nt, Artificial Sequence
  Synthetic
ccugcgcgucggcgggcg

SEQ ID NO: 28287 - RNA, 19 nt, Artificial Sequence
  Synthetic
cccugcgcgucggcgggcg

SEQ ID NO: 28288 - RNA, 20 nt, Artificial Sequence
  Synthetic
ucccugcgcgucggcgggcg

SEQ ID NO: 28289 - RNA, 21 nt, Artificial Sequence
  Synthetic
aucccugcgcgucggcgggcg

SEQ ID NO: 28290 - RNA, 22 nt, Artificial Sequence
  Synthetic
gaucccugcgcgucggcgggcg

SEQ ID NO: 28291 - RNA, 23 nt, Artificial Sequence
  Synthetic
ggaucccugcgcgucggcgggcg

SEQ ID NO: 28292 - RNA, 24 nt, Artificial Sequence
  Synthetic
aggaucccugcgcgucggcgggcg

SEQ ID NO: 28293 - RNA, 18 nt, Artificial Sequence
  Synthetic
ccccaggcgugcggggcg

SEQ ID NO: 28294 - RNA, 19 nt, Artificial Sequence
  Synthetic
cccccaggcgugcggggcg

SEQ ID NO: 28295 - RNA, 20 nt, Artificial Sequence
  Synthetic
ucccccaggcgugcggggcg

SEQ ID NO: 28296 - RNA, 21 nt, Artificial Sequence
  Synthetic
aucccccaggcgugcggggcg

SEQ ID NO: 28297 - RNA, 22 nt, Artificial Sequence
  Synthetic
caucccccaggcgugcggggcg

SEQ ID NO: 28298 - RNA, 23 nt, Artificial Sequence
  Synthetic
gcaucccccaggcgugcggggcg

SEQ ID NO: 28299 - RNA, 24 nt, Artificial Sequence
  Synthetic
agcaucccccaggcgugcggggcg

SEQ ID NO: 28300 - RNA, 18 nt, Artificial Sequence
  Synthetic
caggaucccugcgcgucg

SEQ ID NO: 28301 - RNA, 19 nt, Artificial Sequence
  Synthetic
acaggaucccugcgcgucg

SEQ ID NO: 28302 - RNA, 20 nt, Artificial Sequence
  Synthetic
cacaggaucccugcgcgucg

SEQ ID NO: 28303 - RNA, 21 nt, Artificial Sequence
  Synthetic
ccacaggaucccugcgcgucg

SEQ ID NO: 28304 - RNA, 22 nt, Artificial Sequence
  Synthetic
cccacaggaucccugcgcgucg

SEQ ID NO: 28305 - RNA, 23 nt, Artificial Sequence
  Synthetic
ccccacaggaucccugcgcgucg

SEQ ID NO: 28306 - RNA, 24 nt, Artificial Sequence
  Synthetic
cccccacaggaucccugcgcgucg

SEQ ID NO: 28307 - RNA, 18 nt, Artificial Sequence
  Synthetic
gcgagccacugcaugucg

SEQ ID NO: 28308 - RNA, 19 nt, Artificial Sequence
  Synthetic
ggcgagccacugcaugucg

SEQ ID NO: 28309 - RNA, 20 nt, Artificial Sequence
  Synthetic
uggcgagccacugcaugucg

SEQ ID NO: 28310 - RNA, 21 nt, Artificial Sequence
  Synthetic
cuggcgagccacugcaugucg

SEQ ID NO: 28311 - RNA, 22 nt, Artificial Sequence
  Synthetic
gcuggcgagccacugcaugucg

SEQ ID NO: 28312 - RNA, 23 nt, Artificial Sequence
  Synthetic
ugcuggcgagccacugcaugucg

SEQ ID NO: 28313 - RNA, 24 nt, Artificial Sequence
  Synthetic
cugcuggcgagccacugcaugucg

SEQ ID NO: 28314 - RNA, 18 nt, Artificial Sequence
  Synthetic
augcagaaggggugcagg

SEQ ID NO: 28315 - RNA, 19 nt, Artificial Sequence
  Synthetic
gaugcagaaggggugcagg

SEQ ID NO: 28316 - RNA, 20 nt, Artificial Sequence
  Synthetic
ggaugcagaaggggugcagg

SEQ ID NO: 28317 - RNA, 21 nt, Artificial Sequence
  Synthetic
gggaugcagaaggggugcagg

SEQ ID NO: 28318 - RNA, 22 nt, Artificial Sequence
  Synthetic
cgggaugcagaaggggugcagg

SEQ ID NO: 28319 - RNA, 23 nt, Artificial Sequence
  Synthetic
acgggaugcagaaggggugcagg

SEQ ID NO: 28320 - RNA, 24 nt, Artificial Sequence
  Synthetic
cacgggaugcagaaggggugcagg

SEQ ID NO: 28321 - RNA, 18 nt, Artificial Sequence
  Synthetic
ggcugcccuggcgcucgg

SEQ ID NO: 28322 - RNA, 19 nt, Artificial Sequence
  Synthetic
gggcugcccuggcgcucgg

SEQ ID NO: 28323 - RNA, 20 nt, Artificial Sequence
  Synthetic
ggggcugcccuggcgcucgg

SEQ ID NO: 28324 - RNA, 21 nt, Artificial Sequence
  Synthetic
uggggcugcccuggcgcucgg

SEQ ID NO: 28325 - RNA, 22 nt, Artificial Sequence
  Synthetic
guggggcugcccuggcgcucgg

SEQ ID NO: 28326 - RNA, 23 nt, Artificial Sequence
  Synthetic
cguggggcugcccuggcgcucgg

SEQ ID NO: 28327 - RNA, 24 nt, Artificial Sequence
  Synthetic
gcguggggcugcccuggcgcucgg

SEQ ID NO: 28328 - RNA, 18 nt, Artificial Sequence
  Synthetic
aacucuggcagcgcaggg

SEQ ID NO: 28329 - RNA, 19 nt, Artificial Sequence
  Synthetic
aaacucuggcagcgcaggg

SEQ ID NO: 28330 - RNA, 20 nt, Artificial Sequence
  Synthetic
aaaacucuggcagcgcaggg

SEQ ID NO: 28331 - RNA, 21 nt, Artificial Sequence
  Synthetic
gaaaacucuggcagcgcaggg

SEQ ID NO: 28332 - RNA, 22 nt, Artificial Sequence
  Synthetic
ggaaaacucuggcagcgcaggg

SEQ ID NO: 28333 - RNA, 23 nt, Artificial Sequence
  Synthetic
gggaaaacucuggcagcgcaggg

SEQ ID NO: 28334 - RNA, 24 nt, Artificial Sequence
  Synthetic
agggaaaacucuggcagcgcaggg

SEQ ID NO: 28335 - RNA, 18 nt, Artificial Sequence
  Synthetic
gcucggccgggggccggg

SEQ ID NO: 28336 - RNA, 19 nt, Artificial Sequence
  Synthetic
cgcucggccgggggccggg

SEQ ID NO: 28337 - RNA, 20 nt, Artificial Sequence
  Synthetic
gcgcucggccgggggccggg

SEQ ID NO: 28338 - RNA, 21 nt, Artificial Sequence
  Synthetic
ggcgcucggccgggggccggg

SEQ ID NO: 28339 - RNA, 22 nt, Artificial Sequence
  Synthetic
uggcgcucggccgggggccggg

SEQ ID NO: 28340 - RNA, 23 nt, Artificial Sequence
  Synthetic
cuggcgcucggccgggggccggg

SEQ ID NO: 28341 - RNA, 24 nt, Artificial Sequence
  Synthetic
ccuggcgcucggccgggggccggg

SEQ ID NO: 28342 - RNA, 18 nt, Artificial Sequence
  Synthetic
ccgggagcucgugccggg

SEQ ID NO: 28343 - RNA, 19 nt, Artificial Sequence
  Synthetic
cccgggagcucgugccggg

SEQ ID NO: 28344 - RNA, 20 nt, Artificial Sequence
  Synthetic
gcccgggagcucgugccggg

SEQ ID NO: 28345 - RNA, 21 nt, Artificial Sequence
  Synthetic
cgcccgggagcucgugccggg

SEQ ID NO: 28346 - RNA, 22 nt, Artificial Sequence
  Synthetic
ccgcccgggagcucgugccggg

SEQ ID NO: 28347 - RNA, 23 nt, Artificial Sequence
  Synthetic
uccgcccgggagcucgugccggg

SEQ ID NO: 28348 - RNA, 24 nt, Artificial Sequence
  Synthetic
guccgcccgggagcucgugccggg

SEQ ID NO: 28349 - RNA, 18 nt, Artificial Sequence
  Synthetic
acucuggcagcgcagggg

SEQ ID NO: 28350 - RNA, 19 nt, Artificial Sequence
  Synthetic
aacucuggcagcgcagggg

SEQ ID NO: 28351 - RNA, 20 nt, Artificial Sequence
  Synthetic
aaacucuggcagcgcagggg

SEQ ID NO: 28352 - RNA, 21 nt, Artificial Sequence
  Synthetic
aaaacucuggcagcgcagggg

SEQ ID NO: 28353 - RNA, 22 nt, Artificial Sequence
  Synthetic
gaaaacucuggcagcgcagggg

SEQ ID NO: 28354 - RNA, 23 nt, Artificial Sequence
  Synthetic
ggaaaacucuggcagcgcagggg

SEQ ID NO: 28355 - RNA, 24 nt, Artificial Sequence
  Synthetic
gggaaaacucuggcagcgcagggg

SEQ ID NO: 28356 - RNA, 18 nt, Artificial Sequence
  Synthetic
cgcggcggccgcucgggg

SEQ ID NO: 28357 - RNA, 19 nt, Artificial Sequence
  Synthetic
ccgcggcggccgcucgggg

SEQ ID NO: 28358 - RNA, 20 nt, Artificial Sequence
  Synthetic
gccgcggcggccgcucgggg

SEQ ID NO: 28359 - RNA, 21 nt, Artificial Sequence
  Synthetic
ugccgcggcggccgcucgggg

SEQ ID NO: 28360 - RNA, 22 nt, Artificial Sequence
  Synthetic
cugccgcggcggccgcucgggg

SEQ ID NO: 28361 - RNA, 23 nt, Artificial Sequence
  Synthetic
ucugccgcggcggccgcucgggg

SEQ ID NO: 28362 - RNA, 24 nt, Artificial Sequence
  Synthetic
gucugccgcggcggccgcucgggg

SEQ ID NO: 28363 - RNA, 18 nt, Artificial Sequence
  Synthetic
cuggcgcucggccggggg

SEQ ID NO: 28364 - RNA, 19 nt, Artificial Sequence
  Synthetic
ccuggcgcucggccggggg

SEQ ID NO: 28365 - RNA, 20 nt, Artificial Sequence
  Synthetic
cccuggcgcucggccggggg

SEQ ID NO: 28366 - RNA, 21 nt, Artificial Sequence
  Synthetic
gcccuggcgcucggccggggg

SEQ ID NO: 28367 - RNA, 22 nt, Artificial Sequence
  Synthetic
ugcccuggcgcucggccggggg

SEQ ID NO: 28368 - RNA, 23 nt, Artificial Sequence
  Synthetic
cugcccuggcgcucggccggggg

SEQ ID NO: 28369 - RNA, 24 nt, Artificial Sequence
  Synthetic
gcugcccuggcgcucggccggggg

SEQ ID NO: 28370 - RNA, 18 nt, Artificial Sequence
  Synthetic
gucuucaugcacgggaug

SEQ ID NO: 28371 - RNA, 19 nt, Artificial Sequence
  Synthetic
ggucuucaugcacgggaug

SEQ ID NO: 28372 - RNA, 20 nt, Artificial Sequence
  Synthetic
aggucuucaugcacgggaug

SEQ ID NO: 28373 - RNA, 21 nt, Artificial Sequence
  Synthetic
caggucuucaugcacgggaug

SEQ ID NO: 28374 - RNA, 22 nt, Artificial Sequence
  Synthetic
ccaggucuucaugcacgggaug

SEQ ID NO: 28375 - RNA, 23 nt, Artificial Sequence
  Synthetic
uccaggucuucaugcacgggaug

SEQ ID NO: 28376 - RNA, 24 nt, Artificial Sequence
  Synthetic
auccaggucuucaugcacgggaug

SEQ ID NO: 28377 - RNA, 18 nt, Artificial Sequence
  Synthetic
uccuccgagucgcugcug

SEQ ID NO: 28378 - RNA, 19 nt, Artificial Sequence
  Synthetic
cuccuccgagucgcugcug

SEQ ID NO: 28379 - RNA, 20 nt, Artificial Sequence
  Synthetic
ccuccuccgagucgcugcug

SEQ ID NO: 28380 - RNA, 21 nt, Artificial Sequence
  Synthetic
uccuccuccgagucgcugcug

SEQ ID NO: 28381 - RNA, 22 nt, Artificial Sequence
  Synthetic
cuccuccuccgagucgcugcug

SEQ ID NO: 28382 - RNA, 23 nt, Artificial Sequence
  Synthetic
ucuccuccuccgagucgcugcug

SEQ ID NO: 28383 - RNA, 24 nt, Artificial Sequence
  Synthetic
gucuccuccuccgagucgcugcug

SEQ ID NO: 28384 - RNA, 18 nt, Artificial Sequence
  Synthetic
gagcaucccccaggcgug

SEQ ID NO: 28385 - RNA, 19 nt, Artificial Sequence
  Synthetic
ugagcaucccccaggcgug

SEQ ID NO: 28386 - RNA, 20 nt, Artificial Sequence
  Synthetic
uugagcaucccccaggcgug

SEQ ID NO: 28387 - RNA, 21 nt, Artificial Sequence
  Synthetic
guugagcaucccccaggcgug

SEQ ID NO: 28388 - RNA, 22 nt, Artificial Sequence
  Synthetic
cguugagcaucccccaggcgug

SEQ ID NO: 28389 - RNA, 23 nt, Artificial Sequence
  Synthetic
ucguugagcaucccccaggcgug

SEQ ID NO: 28390 - RNA, 24 nt, Artificial Sequence
  Synthetic
gucguugagcaucccccaggcgug

SEQ ID NO: 28391 - RNA, 18 nt, Artificial Sequence
  Synthetic
uccgcccgggagcucgug

SEQ ID NO: 28392 - RNA, 19 nt, Artificial Sequence
  Synthetic
guccgcccgggagcucgug

SEQ ID NO: 28393 - RNA, 20 nt, Artificial Sequence
  Synthetic
gguccgcccgggagcucgug

SEQ ID NO: 28394 - RNA, 21 nt, Artificial Sequence
  Synthetic
ggguccgcccgggagcucgug

SEQ ID NO: 28395 - RNA, 22 nt, Artificial Sequence
  Synthetic
gggguccgcccgggagcucgug

SEQ ID NO: 28396 - RNA, 23 nt, Artificial Sequence
  Synthetic
cgggguccgcccgggagcucgug

SEQ ID NO: 28397 - RNA, 24 nt, Artificial Sequence
  Synthetic
ccgggguccgcccgggagcucgug

SEQ ID NO: 28398 - RNA, 18 nt, Artificial Sequence
  Synthetic
uguccgugcugcccgccu

SEQ ID NO: 28399 - RNA, 19 nt, Artificial Sequence
  Synthetic
guguccgugcugcccgccu

SEQ ID NO: 28400 - RNA, 20 nt, Artificial Sequence
  Synthetic
cguguccgugcugcccgccu

SEQ ID NO: 28401 - RNA, 21 nt, Artificial Sequence
  Synthetic
ccguguccgugcugcccgccu

SEQ ID NO: 28402 - RNA, 22 nt, Artificial Sequence
  Synthetic
uccguguccgugcugcccgccu

SEQ ID NO: 28403 - RNA, 23 nt, Artificial Sequence
  Synthetic
cuccguguccgugcugcccgccu

SEQ ID NO: 28404 - RNA, 24 nt, Artificial Sequence
  Synthetic
ucuccguguccgugcugcccgccu

SEQ ID NO: 28405 - RNA, 18 nt, Artificial Sequence
  Synthetic
ucugccgcggcggccgcu

SEQ ID NO: 28406 - RNA, 19 nt, Artificial Sequence
  Synthetic
gucugccgcggcggccgcu

SEQ ID NO: 28407 - RNA, 20 nt, Artificial Sequence
  Synthetic
ggucugccgcggcggccgcu

SEQ ID NO: 28408 - RNA, 21 nt, Artificial Sequence
  Synthetic
gggucugccgcggcggccgcu

SEQ ID NO: 28409 - RNA, 22 nt, Artificial Sequence
  Synthetic
ggggucugccgcggcggccgcu

SEQ ID NO: 28410 - RNA, 23 nt, Artificial Sequence
  Synthetic
gggggucugccgcggcggccgcu

SEQ ID NO: 28411 - RNA, 24 nt, Artificial Sequence
  Synthetic
cgggggucugccgcggcggccgcu

SEQ ID NO: 28412 - RNA, 18 nt, Artificial Sequence
  Synthetic
ugagcaucccccaggcgu

SEQ ID NO: 28413 - RNA, 19 nt, Artificial Sequence
  Synthetic
uugagcaucccccaggcgu

SEQ ID NO: 28414 - RNA, 20 nt, Artificial Sequence
  Synthetic
guugagcaucccccaggcgu

SEQ ID NO: 28415 - RNA, 21 nt, Artificial Sequence
  Synthetic
cguugagcaucccccaggcgu

SEQ ID NO: 28416 - RNA, 22 nt, Artificial Sequence
  Synthetic
ucguugagcaucccccaggcgu

SEQ ID NO: 28417 - RNA, 23 nt, Artificial Sequence
  Synthetic
gucguugagcaucccccaggcgu

SEQ ID NO: 28418 - RNA, 24 nt, Artificial Sequence
  Synthetic
ugucguugagcaucccccaggcgu

SEQ ID NO: 28419 - RNA, 18 nt, Artificial Sequence
  Synthetic
cgcggugaaggucgucgu

SEQ ID NO: 28420 - RNA, 19 nt, Artificial Sequence
  Synthetic
ucgcggugaaggucgucgu

SEQ ID NO: 28421 - RNA, 20 nt, Artificial Sequence
  Synthetic
gucgcggugaaggucgucgu

SEQ ID NO: 28422 - RNA, 21 nt, Artificial Sequence
  Synthetic
agucgcggugaaggucgucgu

SEQ ID NO: 28423 - RNA, 22 nt, Artificial Sequence
  Synthetic
gagucgcggugaaggucgucgu

SEQ ID NO: 28424 - RNA, 23 nt, Artificial Sequence
  Synthetic
ggagucgcggugaaggucgucgu

SEQ ID NO: 28425 - RNA, 24 nt, Artificial Sequence
  Synthetic
uggagucgcggugaaggucgucgu

SEQ ID NO: 28426 - RNA, 18 nt, Artificial Sequence
  Synthetic
cccgugggugaggaggaa

SEQ ID NO: 28427 - RNA, 19 nt, Artificial Sequence
  Synthetic
gcccgugggugaggaggaa

SEQ ID NO: 28428 - RNA, 20 nt, Artificial Sequence
  Synthetic
ggcccgugggugaggaggaa

SEQ ID NO: 28429 - RNA, 21 nt, Artificial Sequence
  Synthetic
gggcccgugggugaggaggaa

SEQ ID NO: 28430 - RNA, 22 nt, Artificial Sequence
  Synthetic
ugggcccgugggugaggaggaa

SEQ ID NO: 28431 - RNA, 23 nt, Artificial Sequence
  Synthetic
gugggcccgugggugaggaggaa

SEQ ID NO: 28432 - RNA, 24 nt, Artificial Sequence
  Synthetic
ggugggcccgugggugaggaggaa

SEQ ID NO: 28433 - RNA, 18 nt, Artificial Sequence
  Synthetic
ggugaggaggaagcggaa

SEQ ID NO: 28434 - RNA, 19 nt, Artificial Sequence
  Synthetic
gggugaggaggaagcggaa

SEQ ID NO: 28435 - RNA, 20 nt, Artificial Sequence
  Synthetic
ugggugaggaggaagcggaa

SEQ ID NO: 28436 - RNA, 21 nt, Artificial Sequence
  Synthetic
gugggugaggaggaagcggaa

SEQ ID NO: 28437 - RNA, 22 nt, Artificial Sequence
  Synthetic
cgugggugaggaggaagcggaa

SEQ ID NO: 28438 - RNA, 23 nt, Artificial Sequence
  Synthetic
ccgugggugaggaggaagcggaa

SEQ ID NO: 28439 - RNA, 24 nt, Artificial Sequence
  Synthetic
cccgugggugaggaggaagcggaa

SEQ ID NO: 28440 - RNA, 18 nt, Artificial Sequence
  Synthetic
aggcgggcagcacggaca

SEQ ID NO: 28441 - RNA, 19 nt, Artificial Sequence
  Synthetic
gaggcgggcagcacggaca

SEQ ID NO: 28442 - RNA, 20 nt, Artificial Sequence
  Synthetic
cgaggcgggcagcacggaca

SEQ ID NO: 28443 - RNA, 21 nt, Artificial Sequence
  Synthetic
ccgaggcgggcagcacggaca

SEQ ID NO: 28444 - RNA, 22 nt, Artificial Sequence
  Synthetic
uccgaggcgggcagcacggaca

SEQ ID NO: 28445 - RNA, 23 nt, Artificial Sequence
  Synthetic
cuccgaggcgggcagcacggaca

SEQ ID NO: 28446 - RNA, 24 nt, Artificial Sequence
  Synthetic
ccuccgaggcgggcagcacggaca

SEQ ID NO: 28447 - RNA, 18 nt, Artificial Sequence
  Synthetic
gcgacucggaggaggaga

SEQ ID NO: 28448 - RNA, 19 nt, Artificial Sequence
  Synthetic
agcgacucggaggaggaga

SEQ ID NO: 28449 - RNA, 20 nt, Artificial Sequence
  Synthetic
cagcgacucggaggaggaga

SEQ ID NO: 28450 - RNA, 21 nt, Artificial Sequence
  Synthetic
gcagcgacucggaggaggaga

SEQ ID NO: 28451 - RNA, 22 nt, Artificial Sequence
  Synthetic
agcagcgacucggaggaggaga

SEQ ID NO: 28452 - RNA, 23 nt, Artificial Sequence
  Synthetic
cagcagcgacucggaggaggaga

SEQ ID NO: 28453 - RNA, 24 nt, Artificial Sequence
  Synthetic
ccagcagcgacucggaggaggaga

SEQ ID NO: 28454 - RNA, 18 nt, Artificial Sequence
  Synthetic
gaggaagcggaagcggga

SEQ ID NO: 28455 - RNA, 19 nt, Artificial Sequence
  Synthetic
ggaggaagcggaagcggga

SEQ ID NO: 28456 - RNA, 20 nt, Artificial Sequence
  Synthetic
aggaggaagcggaagcggga

SEQ ID NO: 28457 - RNA, 21 nt, Artificial Sequence
  Synthetic
gaggaggaagcggaagcggga

SEQ ID NO: 28458 - RNA, 22 nt, Artificial Sequence
  Synthetic
ugaggaggaagcggaagcggga

SEQ ID NO: 28459 - RNA, 23 nt, Artificial Sequence
  Synthetic
gugaggaggaagcggaagcggga

SEQ ID NO: 28460 - RNA, 24 nt, Artificial Sequence
  Synthetic
ggugaggaggaagcggaagcggga

SEQ ID NO: 28461 - RNA, 18 nt, Artificial Sequence
  Synthetic
uggcucgccagcagcgac

SEQ ID NO: 28462 - RNA, 19 nt, Artificial Sequence
  Synthetic
guggcucgccagcagcgac

SEQ ID NO: 28463 - RNA, 20 nt, Artificial Sequence
  Synthetic
aguggcucgccagcagcgac

SEQ ID NO: 28464 - RNA, 21 nt, Artificial Sequence
  Synthetic
caguggcucgccagcagcgac

SEQ ID NO: 28465 - RNA, 22 nt, Artificial Sequence
  Synthetic
gcaguggcucgccagcagcgac

SEQ ID NO: 28466 - RNA, 23 nt, Artificial Sequence
  Synthetic
ugcaguggcucgccagcagcgac

SEQ ID NO: 28467 - RNA, 24 nt, Artificial Sequence
  Synthetic
augcaguggcucgccagcagcgac

SEQ ID NO: 28468 - RNA, 18 nt, Artificial Sequence
  Synthetic
gaggcgggcagcacggac

SEQ ID NO: 28469 - RNA, 19 nt, Artificial Sequence
  Synthetic
cgaggcgggcagcacggac

SEQ ID NO: 28470 - RNA, 20 nt, Artificial Sequence
  Synthetic
ccgaggcgggcagcacggac

SEQ ID NO: 28471 - RNA, 21 nt, Artificial Sequence
  Synthetic
uccgaggcgggcagcacggac

SEQ ID NO: 28472 - RNA, 22 nt, Artificial Sequence
  Synthetic
cuccgaggcgggcagcacggac

SEQ ID NO: 28473 - RNA, 23 nt, Artificial Sequence
  Synthetic
ccuccgaggcgggcagcacggac

SEQ ID NO: 28474 - RNA, 24 nt, Artificial Sequence
  Synthetic
accuccgaggcgggcagcacggac

SEQ ID NO: 28475 - RNA, 18 nt, Artificial Sequence
  Synthetic
cccgggcggaccccggcc

SEQ ID NO: 28476 - RNA, 19 nt, Artificial Sequence
  Synthetic
ucccgggcggaccccggcc

SEQ ID NO: 28477 - RNA, 20 nt, Artificial Sequence
  Synthetic
cucccgggcggaccccggcc

SEQ ID NO: 28478 - RNA, 21 nt, Artificial Sequence
  Synthetic
gcucccgggcggaccccggcc

SEQ ID NO: 28479 - RNA, 22 nt, Artificial Sequence
  Synthetic
agcucccgggcggaccccggcc

SEQ ID NO: 28480 - RNA, 23 nt, Artificial Sequence
  Synthetic
gagcucccgggcggaccccggcc

SEQ ID NO: 28481 - RNA, 24 nt, Artificial Sequence
  Synthetic
cgagcucccgggcggaccccggcc

SEQ ID NO: 28482 - RNA, 18 nt, Artificial Sequence
  Synthetic
ugaggaggaagcggaagc

SEQ ID NO: 28483 - RNA, 19 nt, Artificial Sequence
  Synthetic
gugaggaggaagcggaagc

SEQ ID NO: 28484 - RNA, 20 nt, Artificial Sequence
  Synthetic
ggugaggaggaagcggaagc

SEQ ID NO: 28485 - RNA, 21 nt, Artificial Sequence
  Synthetic
gggugaggaggaagcggaagc

SEQ ID NO: 28486 - RNA, 22 nt, Artificial Sequence
  Synthetic
ugggugaggaggaagcggaagc

SEQ ID NO: 28487 - RNA, 23 nt, Artificial Sequence
  Synthetic
gugggugaggaggaagcggaagc

SEQ ID NO: 28488 - RNA, 24 nt, Artificial Sequence
  Synthetic
cgugggugaggaggaagcggaagc

SEQ ID NO: 28489 - RNA, 18 nt, Artificial Sequence
  Synthetic
accuccgaggcgggcagc

SEQ ID NO: 28490 - RNA, 19 nt, Artificial Sequence
  Synthetic
caccuccgaggcgggcagc

SEQ ID NO: 28491 - RNA, 20 nt, Artificial Sequence
  Synthetic
ccaccuccgaggcgggcagc

SEQ ID NO: 28492 - RNA, 21 nt, Artificial Sequence
  Synthetic
uccaccuccgaggcgggcagc

SEQ ID NO: 28493 - RNA, 22 nt, Artificial Sequence
  Synthetic
cuccaccuccgaggcgggcagc

SEQ ID NO: 28494 - RNA, 23 nt, Artificial Sequence
  Synthetic
acuccaccuccgaggcgggcagc

SEQ ID NO: 28495 - RNA, 24 nt, Artificial Sequence
  Synthetic
gacuccaccuccgaggcgggcagc

SEQ ID NO: 28496 - RNA, 18 nt, Artificial Sequence
  Synthetic
cggcccccggccgagcgc

SEQ ID NO: 28497 - RNA, 19 nt, Artificial Sequence
  Synthetic
ccggcccccggccgagcgc

SEQ ID NO: 28498 - RNA, 20 nt, Artificial Sequence
  Synthetic
cccggcccccggccgagcgc

SEQ ID NO: 28499 - RNA, 21 nt, Artificial Sequence
  Synthetic
gcccggcccccggccgagcgc

SEQ ID NO: 28500 - RNA, 22 nt, Artificial Sequence
  Synthetic
ggcccggcccccggccgagcgc

SEQ ID NO: 28501 - RNA, 23 nt, Artificial Sequence
  Synthetic
cggcccggcccccggccgagcgc

SEQ ID NO: 28502 - RNA, 24 nt, Artificial Sequence
  Synthetic
ccggcccggcccccggccgagcgc

SEQ ID NO: 28503 - RNA, 18 nt, Artificial Sequence
  Synthetic
cccuucugcaucccgugc

SEQ ID NO: 28504 - RNA, 19 nt, Artificial Sequence
  Synthetic
ccccuucugcaucccgugc

SEQ ID NO: 28505 - RNA, 20 nt, Artificial Sequence
  Synthetic
accccuucugcaucccgugc

SEQ ID NO: 28506 - RNA, 21 nt, Artificial Sequence
  Synthetic
caccccuucugcaucccgugc

SEQ ID NO: 28507 - RNA, 22 nt, Artificial Sequence
  Synthetic
gcaccccuucugcaucccgugc

SEQ ID NO: 28508 - RNA, 23 nt, Artificial Sequence
  Synthetic
ugcaccccuucugcaucccgugc

SEQ ID NO: 28509 - RNA, 24 nt, Artificial Sequence
  Synthetic
cugcaccccuucugcaucccgugc

SEQ ID NO: 28510 - RNA, 18 nt, Artificial Sequence
  Synthetic
gacgugugugccgugugc

SEQ ID NO: 28511 - RNA, 19 nt, Artificial Sequence
  Synthetic
cgacgugugugccgugugc

SEQ ID NO: 28512 - RNA, 20 nt, Artificial Sequence
  Synthetic
gcgacgugugugccgugugc

SEQ ID NO: 28513 - RNA, 21 nt, Artificial Sequence
  Synthetic
ggcgacgugugugccgugugc

SEQ ID NO: 28514 - RNA, 22 nt, Artificial Sequence
  Synthetic
gggcgacgugugugccgugugc

SEQ ID NO: 28515 - RNA, 23 nt, Artificial Sequence
  Synthetic
ggggcgacgugugugccgugugc

SEQ ID NO: 28516 - RNA, 24 nt, Artificial Sequence
  Synthetic
gggggcgacgugugugccgugugc

SEQ ID NO: 28517 - RNA, 18 nt, Artificial Sequence
  Synthetic
ccggcccggcacgagcuc

SEQ ID NO: 28518 - RNA, 19 nt, Artificial Sequence
  Synthetic
cccggcccggcacgagcuc

SEQ ID NO: 28519 - RNA, 20 nt, Artificial Sequence
  Synthetic
ccccggcccggcacgagcuc

SEQ ID NO: 28520 - RNA, 21 nt, Artificial Sequence
  Synthetic
accccggcccggcacgagcuc

SEQ ID NO: 28521 - RNA, 22 nt, Artificial Sequence
  Synthetic
aaccccggcccggcacgagcuc

SEQ ID NO: 28522 - RNA, 23 nt, Artificial Sequence
  Synthetic
gaaccccggcccggcacgagcuc

SEQ ID NO: 28523 - RNA, 24 nt, Artificial Sequence
  Synthetic
ggaaccccggcccggcacgagcuc

SEQ ID NO: 28524 - RNA, 18 nt, Artificial Sequence
  Synthetic
ccgugggugaggaggaag

SEQ ID NO: 28525 - RNA, 19 nt, Artificial Sequence
  Synthetic
cccgugggugaggaggaag

SEQ ID NO: 28526 - RNA, 20 nt, Artificial Sequence
  Synthetic
gcccgugggugaggaggaag

SEQ ID NO: 28527 - RNA, 21 nt, Artificial Sequence
  Synthetic
ggcccgugggugaggaggaag

SEQ ID NO: 28528 - RNA, 22 nt, Artificial Sequence
  Synthetic
gggcccgugggugaggaggaag

SEQ ID NO: 28529 - RNA, 23 nt, Artificial Sequence
  Synthetic
ugggcccgugggugaggaggaag

SEQ ID NO: 28530 - RNA, 24 nt, Artificial Sequence
  Synthetic
gugggcccgugggugaggaggaag

SEQ ID NO: 28531 - RNA, 18 nt, Artificial Sequence
  Synthetic
gugaggaggaagcggaag

SEQ ID NO: 28532 - RNA, 19 nt, Artificial Sequence
  Synthetic
ggugaggaggaagcggaag

SEQ ID NO: 28533 - RNA, 20 nt, Artificial Sequence
  Synthetic
gggugaggaggaagcggaag

SEQ ID NO: 28534 - RNA, 21 nt, Artificial Sequence
  Synthetic
ugggugaggaggaagcggaag

SEQ ID NO: 28535 - RNA, 22 nt, Artificial Sequence
  Synthetic
gugggugaggaggaagcggaag

SEQ ID NO: 28536 - RNA, 23 nt, Artificial Sequence
  Synthetic
cgugggugaggaggaagcggaag

SEQ ID NO: 28537 - RNA, 24 nt, Artificial Sequence
  Synthetic
ccgugggugaggaggaagcggaag

SEQ ID NO: 28538 - RNA, 18 nt, Artificial Sequence
  Synthetic
ucggaggaggagaccgag

SEQ ID NO: 28539 - RNA, 19 nt, Artificial Sequence
  Synthetic
cucggaggaggagaccgag

SEQ ID NO: 28540 - RNA, 20 nt, Artificial Sequence
  Synthetic
acucggaggaggagaccgag

SEQ ID NO: 28541 - RNA, 21 nt, Artificial Sequence
  Synthetic
gacucggaggaggagaccgag

SEQ ID NO: 28542 - RNA, 22 nt, Artificial Sequence
  Synthetic
cgacucggaggaggagaccgag

SEQ ID NO: 28543 - RNA, 23 nt, Artificial Sequence
  Synthetic
gcgacucggaggaggagaccgag

SEQ ID NO: 28544 - RNA, 24 nt, Artificial Sequence
  Synthetic
agcgacucggaggaggagaccgag

SEQ ID NO: 28545 - RNA, 18 nt, Artificial Sequence
  Synthetic
cgcgacuccaccuccgag

SEQ ID NO: 28546 - RNA, 19 nt, Artificial Sequence
  Synthetic
ccgcgacuccaccuccgag

SEQ ID NO: 28547 - RNA, 20 nt, Artificial Sequence
  Synthetic
accgcgacuccaccuccgag

SEQ ID NO: 28548 - RNA, 21 nt, Artificial Sequence
  Synthetic
caccgcgacuccaccuccgag

SEQ ID NO: 28549 - RNA, 22 nt, Artificial Sequence
  Synthetic
ucaccgcgacuccaccuccgag

SEQ ID NO: 28550 - RNA, 23 nt, Artificial Sequence
  Synthetic
uucaccgcgacuccaccuccgag

SEQ ID NO: 28551 - RNA, 24 nt, Artificial Sequence
  Synthetic
cuucaccgcgacuccaccuccgag

SEQ ID NO: 28552 - RNA, 18 nt, Artificial Sequence
  Synthetic
gacacggagauguucgag

SEQ ID NO: 28553 - RNA, 19 nt, Artificial Sequence
  Synthetic
ggacacggagauguucgag

SEQ ID NO: 28554 - RNA, 20 nt, Artificial Sequence
  Synthetic
cggacacggagauguucgag

SEQ ID NO: 28555 - RNA, 21 nt, Artificial Sequence
  Synthetic
acggacacggagauguucgag

SEQ ID NO: 28556 - RNA, 22 nt, Artificial Sequence
  Synthetic
cacggacacggagauguucgag

SEQ ID NO: 28557 - RNA, 23 nt, Artificial Sequence
  Synthetic
gcacggacacggagauguucgag

SEQ ID NO: 28558 - RNA, 24 nt, Artificial Sequence
  Synthetic
agcacggacacggagauguucgag

SEQ ID NO: 28559 - RNA, 18 nt, Artificial Sequence
  Synthetic
gccagcagcgacucggag

SEQ ID NO: 28560 - RNA, 19 nt, Artificial Sequence
  Synthetic
cgccagcagcgacucggag

SEQ ID NO: 28561 - RNA, 20 nt, Artificial Sequence
  Synthetic
ucgccagcagcgacucggag

SEQ ID NO: 28562 - RNA, 21 nt, Artificial Sequence
  Synthetic
cucgccagcagcgacucggag

SEQ ID NO: 28563 - RNA, 22 nt, Artificial Sequence
  Synthetic
gcucgccagcagcgacucggag

SEQ ID NO: 28564 - RNA, 23 nt, Artificial Sequence
  Synthetic
ggcucgccagcagcgacucggag

SEQ ID NO: 28565 - RNA, 24 nt, Artificial Sequence
  Synthetic
uggcucgccagcagcgacucggag

SEQ ID NO: 28566 - RNA, 18 nt, Artificial Sequence
  Synthetic
aggaagcggaagcgggag

SEQ ID NO: 28567 - RNA, 19 nt, Artificial Sequence
  Synthetic
gaggaagcggaagcgggag

SEQ ID NO: 28568 - RNA, 20 nt, Artificial Sequence
  Synthetic
ggaggaagcggaagcgggag

SEQ ID NO: 28569 - RNA, 21 nt, Artificial Sequence
  Synthetic
aggaggaagcggaagcgggag

SEQ ID NO: 28570 - RNA, 22 nt, Artificial Sequence
  Synthetic
gaggaggaagcggaagcgggag

SEQ ID NO: 28571 - RNA, 23 nt, Artificial Sequence
  Synthetic
ugaggaggaagcggaagcgggag

SEQ ID NO: 28572 - RNA, 24 nt, Artificial Sequence
  Synthetic
gugaggaggaagcggaagcgggag

SEQ ID NO: 28573 - RNA, 18 nt, Artificial Sequence
  Synthetic
ggugggcccgugggugag

SEQ ID NO: 28574 - RNA, 19 nt, Artificial Sequence
  Synthetic
gggugggcccgugggugag

SEQ ID NO: 28575 - RNA, 20 nt, Artificial Sequence
  Synthetic
ggggugggcccgugggugag

SEQ ID NO: 28576 - RNA, 21 nt, Artificial Sequence
  Synthetic
gggggugggcccgugggugag

SEQ ID NO: 28577 - RNA, 22 nt, Artificial Sequence
  Synthetic
ugggggugggcccgugggugag

SEQ ID NO: 28578 - RNA, 23 nt, Artificial Sequence
  Synthetic
gugggggugggcccgugggugag

SEQ ID NO: 28579 - RNA, 24 nt, Artificial Sequence
  Synthetic
ugugggggugggcccgugggugag

SEQ ID NO: 28580 - RNA, 18 nt, Artificial Sequence
  Synthetic
cccacgcccgccgacgcg

SEQ ID NO: 28581 - RNA, 19 nt, Artificial Sequence
  Synthetic
ccccacgcccgccgacgcg

SEQ ID NO: 28582 - RNA, 20 nt, Artificial Sequence
  Synthetic
gccccacgcccgccgacgcg

SEQ ID NO: 28583 - RNA, 21 nt, Artificial Sequence
  Synthetic
agccccacgcccgccgacgcg

SEQ ID NO: 28584 - RNA, 22 nt, Artificial Sequence
  Synthetic
cagccccacgcccgccgacgcg

SEQ ID NO: 28585 - RNA, 23 nt, Artificial Sequence
  Synthetic
gcagccccacgcccgccgacgcg

SEQ ID NO: 28586 - RNA, 24 nt, Artificial Sequence
  Synthetic
ggcagccccacgcccgccgacgcg

SEQ ID NO: 28587 - RNA, 18 nt, Artificial Sequence
  Synthetic
cucgccagcagcgacucg

SEQ ID NO: 28588 - RNA, 19 nt, Artificial Sequence
  Synthetic
gcucgccagcagcgacucg

SEQ ID NO: 28589 - RNA, 20 nt, Artificial Sequence
  Synthetic
ggcucgccagcagcgacucg

SEQ ID NO: 28590 - RNA, 21 nt, Artificial Sequence
  Synthetic
uggcucgccagcagcgacucg

SEQ ID NO: 28591 - RNA, 22 nt, Artificial Sequence
  Synthetic
guggcucgccagcagcgacucg

SEQ ID NO: 28592 - RNA, 23 nt, Artificial Sequence
  Synthetic
aguggcucgccagcagcgacucg

SEQ ID NO: 28593 - RNA, 24 nt, Artificial Sequence
  Synthetic
caguggcucgccagcagcgacucg

SEQ ID NO: 28594 - RNA, 18 nt, Artificial Sequence
  Synthetic
cggaggaggagaccgagg

SEQ ID NO: 28595 - RNA, 19 nt, Artificial Sequence
  Synthetic
ucggaggaggagaccgagg

SEQ ID NO: 28596 - RNA, 20 nt, Artificial Sequence
  Synthetic
cucggaggaggagaccgagg

SEQ ID NO: 28597 - RNA, 21 nt, Artificial Sequence
  Synthetic
acucggaggaggagaccgagg

SEQ ID NO: 28598 - RNA, 22 nt, Artificial Sequence
  Synthetic
gacucggaggaggagaccgagg

SEQ ID NO: 28599 - RNA, 23 nt, Artificial Sequence
  Synthetic
cgacucggaggaggagaccgagg

SEQ ID NO: 28600 - RNA, 24 nt, Artificial Sequence
  Synthetic
gcgacucggaggaggagaccgagg

SEQ ID NO: 28601 - RNA, 18 nt, Artificial Sequence
  Synthetic
ccagcagcgacucggagg

SEQ ID NO: 28602 - RNA, 19 nt, Artificial Sequence
  Synthetic
gccagcagcgacucggagg

SEQ ID NO: 28603 - RNA, 20 nt, Artificial Sequence
  Synthetic
cgccagcagcgacucggagg

SEQ ID NO: 28604 - RNA, 21 nt, Artificial Sequence
  Synthetic
ucgccagcagcgacucggagg

SEQ ID NO: 28605 - RNA, 22 nt, Artificial Sequence
  Synthetic
cucgccagcagcgacucggagg

SEQ ID NO: 28606 - RNA, 23 nt, Artificial Sequence
  Synthetic
gcucgccagcagcgacucggagg

SEQ ID NO: 28607 - RNA, 24 nt, Artificial Sequence
  Synthetic
ggcucgccagcagcgacucggagg

SEQ ID NO: 28608 - RNA, 18 nt, Artificial Sequence
  Synthetic
ggaagcggaagcgggagg

SEQ ID NO: 28609 - RNA, 19 nt, Artificial Sequence
  Synthetic
aggaagcggaagcgggagg

SEQ ID NO: 28610 - RNA, 20 nt, Artificial Sequence
  Synthetic
gaggaagcggaagcgggagg

SEQ ID NO: 28611 - RNA, 21 nt, Artificial Sequence
  Synthetic
ggaggaagcggaagcgggagg

SEQ ID NO: 28612 - RNA, 22 nt, Artificial Sequence
  Synthetic
aggaggaagcggaagcgggagg

SEQ ID NO: 28613 - RNA, 23 nt, Artificial Sequence
  Synthetic
gaggaggaagcggaagcgggagg

SEQ ID NO: 28614 - RNA, 24 nt, Artificial Sequence
  Synthetic
ugaggaggaagcggaagcgggagg

SEQ ID NO: 28615 - RNA, 18 nt, Artificial Sequence
  Synthetic
gugggcccgugggugagg

SEQ ID NO: 28616 - RNA, 19 nt, Artificial Sequence
  Synthetic
ggugggcccgugggugagg

SEQ ID NO: 28617 - RNA, 20 nt, Artificial Sequence
  Synthetic
gggugggcccgugggugagg

SEQ ID NO: 28618 - RNA, 21 nt, Artificial Sequence
  Synthetic
ggggugggcccgugggugagg

SEQ ID NO: 28619 - RNA, 22 nt, Artificial Sequence
  Synthetic
gggggugggcccgugggugagg

SEQ ID NO: 28620 - RNA, 23 nt, Artificial Sequence
  Synthetic
ugggggugggcccgugggugagg

SEQ ID NO: 28621 - RNA, 24 nt, Artificial Sequence
  Synthetic
gugggggugggcccgugggugagg

SEQ ID NO: 28622 - RNA, 18 nt, Artificial Sequence
  Synthetic
ugugugccgugugcacgg

SEQ ID NO: 28623 - RNA, 19 nt, Artificial Sequence
  Synthetic
gugugugccgugugcacgg

SEQ ID NO: 28624 - RNA, 20 nt, Artificial Sequence
  Synthetic
cgugugugccgugugcacgg

SEQ ID NO: 28625 - RNA, 21 nt, Artificial Sequence
  Synthetic
acgugugugccgugugcacgg

SEQ ID NO: 28626 - RNA, 22 nt, Artificial Sequence
  Synthetic
gacgugugugccgugugcacgg

SEQ ID NO: 28627 - RNA, 23 nt, Artificial Sequence
  Synthetic
cgacgugugugccgugugcacgg

SEQ ID NO: 28628 - RNA, 24 nt, Artificial Sequence
  Synthetic
gcgacgugugugccgugugcacgg

SEQ ID NO: 28629 - RNA, 18 nt, Artificial Sequence
  Synthetic
ccccggcccggcccccgg

SEQ ID NO: 28630 - RNA, 19 nt, Artificial Sequence
  Synthetic
cccccggcccggcccccgg

SEQ ID NO: 28631 - RNA, 20 nt, Artificial Sequence
  Synthetic
gcccccggcccggcccccgg

SEQ ID NO: 28632 - RNA, 21 nt, Artificial Sequence
  Synthetic
cgcccccggcccggcccccgg

SEQ ID NO: 28633 - RNA, 22 nt, Artificial Sequence
  Synthetic
acgcccccggcccggcccccgg

SEQ ID NO: 28634 - RNA, 23 nt, Artificial Sequence
  Synthetic
cacgcccccggcccggcccccgg

SEQ ID NO: 28635 - RNA, 24 nt, Artificial Sequence
  Synthetic
ccacgcccccggcccggcccccgg

SEQ ID NO: 28636 - RNA, 18 nt, Artificial Sequence
  Synthetic
cccggcacgagcucccgg

SEQ ID NO: 28637 - RNA, 19 nt, Artificial Sequence
  Synthetic
gcccggcacgagcucccgg

SEQ ID NO: 28638 - RNA, 20 nt, Artificial Sequence
  Synthetic
ggcccggcacgagcucccgg

SEQ ID NO: 28639 - RNA, 21 nt, Artificial Sequence
  Synthetic
cggcccggcacgagcucccgg

SEQ ID NO: 28640 - RNA, 22 nt, Artificial Sequence
  Synthetic
ccggcccggcacgagcucccgg

SEQ ID NO: 28641 - RNA, 23 nt, Artificial Sequence
  Synthetic
cccggcccggcacgagcucccgg

SEQ ID NO: 28642 - RNA, 24 nt, Artificial Sequence
  Synthetic
ccccggcccggcacgagcucccgg

SEQ ID NO: 28643 - RNA, 18 nt, Artificial Sequence
  Synthetic
aggaggaagcggaagcgg

SEQ ID NO: 28644 - RNA, 19 nt, Artificial Sequence
  Synthetic
gaggaggaagcggaagcgg

SEQ ID NO: 28645 - RNA, 20 nt, Artificial Sequence
  Synthetic
ugaggaggaagcggaagcgg

SEQ ID NO: 28646 - RNA, 21 nt, Artificial Sequence
  Synthetic
gugaggaggaagcggaagcgg

SEQ ID NO: 28647 - RNA, 22 nt, Artificial Sequence
  Synthetic
ggugaggaggaagcggaagcgg

SEQ ID NO: 28648 - RNA, 23 nt, Artificial Sequence
  Synthetic
gggugaggaggaagcggaagcgg

SEQ ID NO: 28649 - RNA, 24 nt, Artificial Sequence
  Synthetic
ugggugaggaggaagcggaagcgg

SEQ ID NO: 28650 - RNA, 18 nt, Artificial Sequence
  Synthetic
ucgccagcagcgacucgg

SEQ ID NO: 28651 - RNA, 19 nt, Artificial Sequence
  Synthetic
cucgccagcagcgacucgg

SEQ ID NO: 28652 - RNA, 20 nt, Artificial Sequence
  Synthetic
gcucgccagcagcgacucgg

SEQ ID NO: 28653 - RNA, 21 nt, Artificial Sequence
  Synthetic
ggcucgccagcagcgacucgg

SEQ ID NO: 28654 - RNA, 22 nt, Artificial Sequence
  Synthetic
uggcucgccagcagcgacucgg

SEQ ID NO: 28655 - RNA, 23 nt, Artificial Sequence
  Synthetic
guggcucgccagcagcgacucgg

SEQ ID NO: 28656 - RNA, 24 nt, Artificial Sequence
  Synthetic
aguggcucgccagcagcgacucgg

SEQ ID NO: 28657 - RNA, 18 nt, Artificial Sequence
  Synthetic
gaagcggaagcgggaggg

SEQ ID NO: 28658 - RNA, 19 nt, Artificial Sequence
  Synthetic
ggaagcggaagcgggaggg

SEQ ID NO: 28659 - RNA, 20 nt, Artificial Sequence
  Synthetic
aggaagcggaagcgggaggg

SEQ ID NO: 28660 - RNA, 21 nt, Artificial Sequence
  Synthetic
gaggaagcggaagcgggaggg

SEQ ID NO: 28661 - RNA, 22 nt, Artificial Sequence
  Synthetic
ggaggaagcggaagcgggaggg

SEQ ID NO: 28662 - RNA, 23 nt, Artificial Sequence
  Synthetic
aggaggaagcggaagcgggaggg

SEQ ID NO: 28663 - RNA, 24 nt, Artificial Sequence
  Synthetic
gaggaggaagcggaagcgggaggg

SEQ ID NO: 28664 - RNA, 18 nt, Artificial Sequence
  Synthetic
ggaggaagcggaagcggg

SEQ ID NO: 28665 - RNA, 19 nt, Artificial Sequence
  Synthetic
aggaggaagcggaagcggg

SEQ ID NO: 28666 - RNA, 20 nt, Artificial Sequence
  Synthetic
gaggaggaagcggaagcggg

SEQ ID NO: 28667 - RNA, 21 nt, Artificial Sequence
  Synthetic
ugaggaggaagcggaagcggg

SEQ ID NO: 28668 - RNA, 22 nt, Artificial Sequence
  Synthetic
gugaggaggaagcggaagcggg

SEQ ID NO: 28669 - RNA, 23 nt, Artificial Sequence
  Synthetic
ggugaggaggaagcggaagcggg

SEQ ID NO: 28670 - RNA, 24 nt, Artificial Sequence
  Synthetic
gggugaggaggaagcggaagcggg

SEQ ID NO: 28671 - RNA, 18 nt, Artificial Sequence
  Synthetic
cgcagggauccugugggg

SEQ ID NO: 28672 - RNA, 19 nt, Artificial Sequence
  Synthetic
gcgcagggauccugugggg

SEQ ID NO: 28673 - RNA, 20 nt, Artificial Sequence
  Synthetic
cgcgcagggauccugugggg

SEQ ID NO: 28674 - RNA, 21 nt, Artificial Sequence
  Synthetic
acgcgcagggauccugugggg

SEQ ID NO: 28675 - RNA, 22 nt, Artificial Sequence
  Synthetic
gacgcgcagggauccugugggg

SEQ ID NO: 28676 - RNA, 23 nt, Artificial Sequence
  Synthetic
cgacgcgcagggauccugugggg

SEQ ID NO: 28677 - RNA, 24 nt, Artificial Sequence
  Synthetic
ccgacgcgcagggauccugugggg

SEQ ID NO: 28678 - RNA, 18 nt, Artificial Sequence
  Synthetic
gugggggugggcccgugg

SEQ ID NO: 28679 - RNA, 19 nt, Artificial Sequence
  Synthetic
ugugggggugggcccgugg

SEQ ID NO: 28680 - RNA, 20 nt, Artificial Sequence
  Synthetic
cugugggggugggcccgugg

SEQ ID NO: 28681 - RNA, 21 nt, Artificial Sequence
  Synthetic
ccugugggggugggcccgugg

SEQ ID NO: 28682 - RNA, 22 nt, Artificial Sequence
  Synthetic
uccugugggggugggcccgugg

SEQ ID NO: 28683 - RNA, 23 nt, Artificial Sequence
  Synthetic
auccugugggggugggcccgugg

SEQ ID NO: 28684 - RNA, 24 nt, Artificial Sequence
  Synthetic
gauccugugggggugggcccgugg

SEQ ID NO: 28685 - RNA, 18 nt, Artificial Sequence
  Synthetic
auguucgaggcgggccug

SEQ ID NO: 28686 - RNA, 19 nt, Artificial Sequence
  Synthetic
gauguucgaggcgggccug

SEQ ID NO: 28687 - RNA, 20 nt, Artificial Sequence
  Synthetic
agauguucgaggcgggccug

SEQ ID NO: 28688 - RNA, 21 nt, Artificial Sequence
  Synthetic
gagauguucgaggcgggccug

SEQ ID NO: 28689 - RNA, 22 nt, Artificial Sequence
  Synthetic
ggagauguucgaggcgggccug

SEQ ID NO: 28690 - RNA, 23 nt, Artificial Sequence
  Synthetic
cggagauguucgaggcgggccug

SEQ ID NO: 28691 - RNA, 24 nt, Artificial Sequence
  Synthetic
acggagauguucgaggcgggccug

SEQ ID NO: 28692 - RNA, 18 nt, Artificial Sequence
  Synthetic
cgacgcgcagggauccug

SEQ ID NO: 28693 - RNA, 19 nt, Artificial Sequence
  Synthetic
ccgacgcgcagggauccug

SEQ ID NO: 28694 - RNA, 20 nt, Artificial Sequence
  Synthetic
gccgacgcgcagggauccug

SEQ ID NO: 28695 - RNA, 21 nt, Artificial Sequence
  Synthetic
cgccgacgcgcagggauccug

SEQ ID NO: 28696 - RNA, 22 nt, Artificial Sequence
  Synthetic
ccgccgacgcgcagggauccug

SEQ ID NO: 28697 - RNA, 23 nt, Artificial Sequence
  Synthetic
cccgccgacgcgcagggauccug

SEQ ID NO: 28698 - RNA, 24 nt, Artificial Sequence
  Synthetic
gcccgccgacgcgcagggauccug

SEQ ID NO: 28699 - RNA, 18 nt, Artificial Sequence
  Synthetic
ggggugggcccgugggug

SEQ ID NO: 28700 - RNA, 19 nt, Artificial Sequence
  Synthetic
gggggugggcccgugggug

SEQ ID NO: 28701 - RNA, 20 nt, Artificial Sequence
  Synthetic
ugggggugggcccgugggug

SEQ ID NO: 28702 - RNA, 21 nt, Artificial Sequence
  Synthetic
gugggggugggcccgugggug

SEQ ID NO: 28703 - RNA, 22 nt, Artificial Sequence
  Synthetic
ugugggggugggcccgugggug

SEQ ID NO: 28704 - RNA, 23 nt, Artificial Sequence
  Synthetic
cugugggggugggcccgugggug

SEQ ID NO: 28705 - RNA, 24 nt, Artificial Sequence
  Synthetic
ccugugggggugggcccgugggug

SEQ ID NO: 28706 - RNA, 18 nt, Artificial Sequence
  Synthetic
ggcucgccagcagcgacu

SEQ ID NO: 28707 - RNA, 19 nt, Artificial Sequence
  Synthetic
uggcucgccagcagcgacu

SEQ ID NO: 28708 - RNA, 20 nt, Artificial Sequence
  Synthetic
guggcucgccagcagcgacu

SEQ ID NO: 28709 - RNA, 21 nt, Artificial Sequence
  Synthetic
aguggcucgccagcagcgacu

SEQ ID NO: 28710 - RNA, 22 nt, Artificial Sequence
  Synthetic
caguggcucgccagcagcgacu

SEQ ID NO: 28711 - RNA, 23 nt, Artificial Sequence
  Synthetic
gcaguggcucgccagcagcgacu

SEQ ID NO: 28712 - RNA, 24 nt, Artificial Sequence
  Synthetic
ugcaguggcucgccagcagcgacu

SEQ ID NO: 28713 - RNA, 18 nt, Artificial Sequence
  Synthetic
uucaccgcgacuccaccu

SEQ ID NO: 28714 - RNA, 19 nt, Artificial Sequence
  Synthetic
cuucaccgcgacuccaccu

SEQ ID NO: 28715 - RNA, 20 nt, Artificial Sequence
  Synthetic
ccuucaccgcgacuccaccu

SEQ ID NO: 28716 - RNA, 21 nt, Artificial Sequence
  Synthetic
accuucaccgcgacuccaccu

SEQ ID NO: 28717 - RNA, 22 nt, Artificial Sequence
  Synthetic
gaccuucaccgcgacuccaccu

SEQ ID NO: 28718 - RNA, 23 nt, Artificial Sequence
  Synthetic
cgaccuucaccgcgacuccaccu

SEQ ID NO: 28719 - RNA, 24 nt, Artificial Sequence
  Synthetic
acgaccuucaccgcgacuccaccu

SEQ ID NO: 28720 - RNA, 18 nt, Artificial Sequence
  Synthetic
ccgacgcgcagggauccu

SEQ ID NO: 28721 - RNA, 19 nt, Artificial Sequence
  Synthetic
gccgacgcgcagggauccu

SEQ ID NO: 28722 - RNA, 20 nt, Artificial Sequence
  Synthetic
cgccgacgcgcagggauccu

SEQ ID NO: 28723 - RNA, 21 nt, Artificial Sequence
  Synthetic
ccgccgacgcgcagggauccu

SEQ ID NO: 28724 - RNA, 22 nt, Artificial Sequence
  Synthetic
cccgccgacgcgcagggauccu

SEQ ID NO: 28725 - RNA, 23 nt, Artificial Sequence
  Synthetic
gcccgccgacgcgcagggauccu

SEQ ID NO: 28726 - RNA, 24 nt, Artificial Sequence
  Synthetic
cgcccgccgacgcgcagggauccu

SEQ ID NO: 28727 - RNA, 18 nt, Artificial Sequence
  Synthetic
gggggugggcccgugggu

SEQ ID NO: 28728 - RNA, 19 nt, Artificial Sequence
  Synthetic
ugggggugggcccgugggu

SEQ ID NO: 28729 - RNA, 20 nt, Artificial Sequence
  Synthetic
gugggggugggcccgugggu

SEQ ID NO: 28730 - RNA, 21 nt, Artificial Sequence
  Synthetic
ugugggggugggcccgugggu

SEQ ID NO: 28731 - RNA, 22 nt, Artificial Sequence
  Synthetic
cugugggggugggcccgugggu

SEQ ID NO: 28732 - RNA, 23 nt, Artificial Sequence
  Synthetic
ccugugggggugggcccgugggu

SEQ ID NO: 28733 - RNA, 24 nt, Artificial Sequence
  Synthetic
uccugugggggugggcccgugggu

SEQ ID NO: 28734 - RNA, 18 nt, Artificial Sequence
  Synthetic
gcacggacacggagaugu

SEQ ID NO: 28735 - RNA, 19 nt, Artificial Sequence
  Synthetic
agcacggacacggagaugu

SEQ ID NO: 28736 - RNA, 20 nt, Artificial Sequence
  Synthetic
cagcacggacacggagaugu

SEQ ID NO: 28737 - RNA, 21 nt, Artificial Sequence
  Synthetic
gcagcacggacacggagaugu

SEQ ID NO: 28738 - RNA, 22 nt, Artificial Sequence
  Synthetic
ggcagcacggacacggagaugu

SEQ ID NO: 28739 - RNA, 23 nt, Artificial Sequence
  Synthetic
gggcagcacggacacggagaugu

SEQ ID NO: 28740 - RNA, 24 nt, Artificial Sequence
  Synthetic
cgggcagcacggacacggagaugu

SEQ ID NO: 28741 - RNA, 18 nt, Artificial Sequence
  Synthetic
gaaguccagcgcgcccac

SEQ ID NO: 28742 - RNA, 19 nt, Artificial Sequence
  Synthetic
ggaaguccagcgcgcccac

SEQ ID NO: 28743 - RNA, 21 nt, Artificial Sequence
  Synthetic
guggaaguccagcgcgcccac

SEQ ID NO: 28744 - RNA, 24 nt, Artificial Sequence
  Synthetic
gccguggaaguccagcgcgcccac

SEQ ID NO: 28745 - RNA, 21 nt, Artificial Sequence
  Synthetic
gucaaagagcauguugcccac

SEQ ID NO: 28746 - RNA, 22 nt, Artificial Sequence
  Synthetic
ggucaaagagcauguugcccac

SEQ ID NO: 28747 - RNA, 18 nt, Artificial Sequence
  Synthetic
ggccgccucggccuccac

SEQ ID NO: 28748 - RNA, 22 nt, Artificial Sequence
  Synthetic
gcacggccgccucggccuccac

SEQ ID NO: 28749 - RNA, 18 nt, Artificial Sequence
  Synthetic
ggcguggggggcggcacc

SEQ ID NO: 28750 - RNA, 20 nt, Artificial Sequence
  Synthetic
gcggcguggggggcggcacc

SEQ ID NO: 28751 - RNA, 19 nt, Artificial Sequence
  Synthetic
gcgcccugcucccgagacc

SEQ ID NO: 28752 - RNA, 21 nt, Artificial Sequence
  Synthetic
gcgcgcccugcucccgagacc

SEQ ID NO: 28753 - RNA, 22 nt, Artificial Sequence
  Synthetic
ggcgcgcccugcucccgagacc

SEQ ID NO: 28754 - RNA, 23 nt, Artificial Sequence
  Synthetic
gggcgcgcccugcucccgagacc

SEQ ID NO: 28755 - RNA, 19 nt, Artificial Sequence
  Synthetic
guuggugccgcgggggacc

SEQ ID NO: 28756 - RNA, 21 nt, Artificial Sequence
  Synthetic
guguuggugccgcgggggacc

SEQ ID NO: 28757 - RNA, 22 nt, Artificial Sequence
  Synthetic
gguguuggugccgcgggggacc

SEQ ID NO: 28758 - RNA, 23 nt, Artificial Sequence
  Synthetic
ggguguuggugccgcgggggacc

SEQ ID NO: 28759 - RNA, 24 nt, Artificial Sequence
  Synthetic
gggguguuggugccgcgggggacc

SEQ ID NO: 28760 - RNA, 18 nt, Artificial Sequence
  Synthetic
gggagcgcggggccgucc

SEQ ID NO: 28761 - RNA, 22 nt, Artificial Sequence
  Synthetic
gacagggagcgcggggccgucc

SEQ ID NO: 28762 - RNA, 24 nt, Artificial Sequence
  Synthetic
gcgacagggagcgcggggccgucc

SEQ ID NO: 28763 - RNA, 22 nt, Artificial Sequence
  Synthetic
gccucggccuccacgcgggucc

SEQ ID NO: 28764 - RNA, 18 nt, Artificial Sequence
  Synthetic
ggcgggcugggagguucc

SEQ ID NO: 28765 - RNA, 20 nt, Artificial Sequence
  Synthetic
gcggcgggcugggagguucc

SEQ ID NO: 28766 - RNA, 23 nt, Artificial Sequence
  Synthetic
gucgcggcgggcugggagguucc

SEQ ID NO: 28767 - RNA, 24 nt, Artificial Sequence
  Synthetic
ggucgcggcgggcugggagguucc

SEQ ID NO: 28768 - RNA, 20 nt, Artificial Sequence
  Synthetic
gcuugggugucggucugagc

SEQ ID NO: 28769 - RNA, 22 nt, Artificial Sequence
  Synthetic
gugcuugggugucggucugagc

SEQ ID NO: 28770 - RNA, 18 nt, Artificial Sequence
  Synthetic
gcccguggccgcggucgc

SEQ ID NO: 28771 - RNA, 19 nt, Artificial Sequence
  Synthetic
ggcccguggccgcggucgc

SEQ ID NO: 28772 - RNA, 21 nt, Artificial Sequence
  Synthetic
gcggcccguggccgcggucgc

SEQ ID NO: 28773 - RNA, 23 nt, Artificial Sequence
  Synthetic
gagcggcccguggccgcggucgc

SEQ ID NO: 28774 - RNA, 19 nt, Artificial Sequence
  Synthetic
gaggacgaggccgcggggc

SEQ ID NO: 28775 - RNA, 20 nt, Artificial Sequence
  Synthetic
ggaggacgaggccgcggggc

SEQ ID NO: 28776 - RNA, 22 nt, Artificial Sequence
  Synthetic
gcggaggacgaggccgcggggc

SEQ ID NO: 28777 - RNA, 23 nt, Artificial Sequence
  Synthetic
ggcggaggacgaggccgcggggc

SEQ ID NO: 28778 - RNA, 20 nt, Artificial Sequence
  Synthetic
gcccggcccagacucugugc

SEQ ID NO: 28779 - RNA, 24 nt, Artificial Sequence
  Synthetic
gccugcccggcccagacucugugc

SEQ ID NO: 28780 - RNA, 18 nt, Artificial Sequence
  Synthetic
gcgcgcgugcucggggag

SEQ ID NO: 28781 - RNA, 21 nt, Artificial Sequence
  Synthetic
guugcgcgcgugcucggggag

SEQ ID NO: 28782 - RNA, 24 nt, Artificial Sequence
  Synthetic
gcaguugcgcgcgugcucggggag

SEQ ID NO: 28783 - RNA, 20 nt, Artificial Sequence
  Synthetic
guagcgcgugaggccgggcg

SEQ ID NO: 28784 - RNA, 21 nt, Artificial Sequence
  Synthetic
gguagcgcgugaggccgggcg

SEQ ID NO: 28785 - RNA, 24 nt, Artificial Sequence
  Synthetic
gcagguagcgcgugaggccgggcg

SEQ ID NO: 28786 - RNA, 23 nt, Artificial Sequence
  Synthetic
guuccacuccgacgcggggggcg

SEQ ID NO: 28787 - RNA, 18 nt, Artificial Sequence
  Synthetic
guccgugccgggccacgg

SEQ ID NO: 28788 - RNA, 21 nt, Artificial Sequence
  Synthetic
gucguccgugccgggccacgg

SEQ ID NO: 28789 - RNA, 18 nt, Artificial Sequence
  Synthetic
ggcgccagggggcgccgg

SEQ ID NO: 28790 - RNA, 19 nt, Artificial Sequence
  Synthetic
gggcgccagggggcgccgg

SEQ ID NO: 28791 - RNA, 20 nt, Artificial Sequence
  Synthetic
ggggcgccagggggcgccgg

SEQ ID NO: 28792 - RNA, 22 nt, Artificial Sequence
  Synthetic
gcggggcgccagggggcgccgg

SEQ ID NO: 28793 - RNA, 18 nt, Artificial Sequence
  Synthetic
ggcgcggagacggcgggg

SEQ ID NO: 28794 - RNA, 20 nt, Artificial Sequence
  Synthetic
gcggcgcggagacggcgggg

SEQ ID NO: 28795 - RNA, 21 nt, Artificial Sequence
  Synthetic
ggcggcgcggagacggcgggg

SEQ ID NO: 28796 - RNA, 22 nt, Artificial Sequence
  Synthetic
gggcggcgcggagacggcgggg

SEQ ID NO: 28797 - RNA, 23 nt, Artificial Sequence
  Synthetic
ggggcggcgcggagacggcgggg

SEQ ID NO: 28798 - RNA, 20 nt, Artificial Sequence
  Synthetic
guccgggggucguucacuau

SEQ ID NO: 28799 - RNA, 21 nt, Artificial Sequence
  Synthetic
gguccgggggucguucacuau

SEQ ID NO: 28800 - RNA, 22 nt, Artificial Sequence
  Synthetic
ggguccgggggucguucacuau

SEQ ID NO: 28801 - RNA, 24 nt, Artificial Sequence
  Synthetic
gcggguccgggggucguucacuau

SEQ ID NO: 28802 - RNA, 18 nt, Artificial Sequence
  Synthetic
ggccgcggucgcccgagu

SEQ ID NO: 28803 - RNA, 20 nt, Artificial Sequence
  Synthetic
guggccgcggucgcccgagu

SEQ ID NO: 28804 - RNA, 24 nt, Artificial Sequence
  Synthetic
gcccguggccgcggucgcccgagu

SEQ ID NO: 28805 - RNA, 19 nt, Artificial Sequence
  Synthetic
gcucgccccucgcccccca

SEQ ID NO: 28806 - RNA, 21 nt, Artificial Sequence
  Synthetic
gcgcucgccccucgcccccca

SEQ ID NO: 28807 - RNA, 20 nt, Artificial Sequence
  Synthetic
gauagugggcgugaccgcca

SEQ ID NO: 28808 - RNA, 21 nt, Artificial Sequence
  Synthetic
gcucagaccgacacccaagca

SEQ ID NO: 28809 - RNA, 22 nt, Artificial Sequence
  Synthetic
ggcucagaccgacacccaagca

SEQ ID NO: 28810 - RNA, 18 nt, Artificial Sequence
  Synthetic
gggcgcggagggaggacc

SEQ ID NO: 28811 - RNA, 21 nt, Artificial Sequence
  Synthetic
gccgggcgcggagggaggacc

SEQ ID NO: 28812 - RNA, 22 nt, Artificial Sequence
  Synthetic
ggccgggcgcggagggaggacc

SEQ ID NO: 28813 - RNA, 23 nt, Artificial Sequence
  Synthetic
gggccgggcgcggagggaggacc

SEQ ID NO: 28814 - RNA, 20 nt, Artificial Sequence
  Synthetic
gccgucgcggccgucgugcc

SEQ ID NO: 28815 - RNA, 19 nt, Artificial Sequence
  Synthetic
gcaggcgcgaccgacgcgc

SEQ ID NO: 28816 - RNA, 20 nt, Artificial Sequence
  Synthetic
ggcaggcgcgaccgacgcgc

SEQ ID NO: 28817 - RNA, 21 nt, Artificial Sequence
  Synthetic
gggcaggcgcgaccgacgcgc

SEQ ID NO: 28818 - RNA, 24 nt, Artificial Sequence
  Synthetic
gccgggcaggcgcgaccgacgcgc

SEQ ID NO: 28819 - RNA, 18 nt, Artificial Sequence
  Synthetic
gcgcuaccugcccaucgc

SEQ ID NO: 28820 - RNA, 19 nt, Artificial Sequence
  Synthetic
gcccgcccccggaagaggc

SEQ ID NO: 28821 - RNA, 20 nt, Artificial Sequence
  Synthetic
ggcccgcccccggaagaggc

SEQ ID NO: 28822 - RNA, 22 nt, Artificial Sequence
  Synthetic
gcggcccgcccccggaagaggc

SEQ ID NO: 28823 - RNA, 23 nt, Artificial Sequence
  Synthetic
ggcggcccgcccccggaagaggc

SEQ ID NO: 28824 - RNA, 19 nt, Artificial Sequence
  Synthetic
gcggcgccccguugcgggc

SEQ ID NO: 28825 - RNA, 20 nt, Artificial Sequence
  Synthetic
ggcggcgccccguugcgggc

SEQ ID NO: 28826 - RNA, 22 nt, Artificial Sequence
  Synthetic
gcggcggcgccccguugcgggc

SEQ ID NO: 28827 - RNA, 18 nt, Artificial Sequence
  Synthetic
gccgucgccccgcgcguc

SEQ ID NO: 28828 - RNA, 19 nt, Artificial Sequence
  Synthetic
ggccgucgccccgcgcguc

SEQ ID NO: 28829 - RNA, 21 nt, Artificial Sequence
  Synthetic
gcggccgucgccccgcgcguc

SEQ ID NO: 28830 - RNA, 23 nt, Artificial Sequence
  Synthetic
gcgcggccgucgccccgcgcguc

SEQ ID NO: 28831 - RNA, 19 nt, Artificial Sequence
  Synthetic
gacgcccccgcgggccacg

SEQ ID NO: 28832 - RNA, 21 nt, Artificial Sequence
  Synthetic
gcgacgcccccgcgggccacg

SEQ ID NO: 28833 - RNA, 22 nt, Artificial Sequence
  Synthetic
ggcgacgcccccgcgggccacg

SEQ ID NO: 28834 - RNA, 18 nt, Artificial Sequence
  Synthetic
ggggcgcgcgcaggcgcg

SEQ ID NO: 28835 - RNA, 19 nt, Artificial Sequence
  Synthetic
gggggcgcgcgcaggcgcg

SEQ ID NO: 28836 - RNA, 20 nt, Artificial Sequence
  Synthetic
ggggggcgcgcgcaggcgcg

SEQ ID NO: 28837 - RNA, 22 nt, Artificial Sequence
  Synthetic
gcggggggcgcgcgcaggcgcg

SEQ ID NO: 28838 - RNA, 23 nt, Artificial Sequence
  Synthetic
ggcggggggcgcgcgcaggcgcg

SEQ ID NO: 28839 - RNA, 19 nt, Artificial Sequence
  Synthetic
gccccguugcgggcggggg

SEQ ID NO: 28840 - RNA, 21 nt, Artificial Sequence
  Synthetic
gcgccccguugcgggcggggg

SEQ ID NO: 28841 - RNA, 22 nt, Artificial Sequence
  Synthetic
ggcgccccguugcgggcggggg

SEQ ID NO: 28842 - RNA, 24 nt, Artificial Sequence
  Synthetic
gcggcgccccguugcgggcggggg

SEQ ID NO: 28843 - RNA, 20 nt, Artificial Sequence
  Synthetic
guugcgggcgggggugggau

SEQ ID NO: 28844 - RNA, 18 nt, Artificial Sequence
  Synthetic
gucggaguggaacagccu

SEQ ID NO: 28845 - RNA, 20 nt, Artificial Sequence
  Synthetic
gcgucggaguggaacagccu

SEQ ID NO: 28846 - RNA, 22 nt, Artificial Sequence
  Synthetic
gacuacccgacgccccccgcgu

SEQ ID NO: 28847 - RNA, 20 nt, Artificial Sequence
  Synthetic
uggaaguccagcgcgcccac

SEQ ID NO: 28848 - RNA, 22 nt, Artificial Sequence
  Synthetic
cguggaaguccagcgcgcccac

SEQ ID NO: 28849 - RNA, 23 nt, Artificial Sequence
  Synthetic
ccguggaaguccagcgcgcccac

SEQ ID NO: 28850 - RNA, 18 nt, Artificial Sequence
  Synthetic
aaagagcauguugcccac

SEQ ID NO: 28851 - RNA, 19 nt, Artificial Sequence
  Synthetic
caaagagcauguugcccac

SEQ ID NO: 28852 - RNA, 20 nt, Artificial Sequence
  Synthetic
ucaaagagcauguugcccac

SEQ ID NO: 28853 - RNA, 23 nt, Artificial Sequence
  Synthetic
uggucaaagagcauguugcccac

SEQ ID NO: 28854 - RNA, 24 nt, Artificial Sequence
  Synthetic
cuggucaaagagcauguugcccac

SEQ ID NO: 28855 - RNA, 19 nt, Artificial Sequence
  Synthetic
cggccgccucggccuccac

SEQ ID NO: 28856 - RNA, 20 nt, Artificial Sequence
  Synthetic
acggccgccucggccuccac

SEQ ID NO: 28857 - RNA, 21 nt, Artificial Sequence
  Synthetic
cacggccgccucggccuccac

SEQ ID NO: 28858 - RNA, 23 nt, Artificial Sequence
  Synthetic
cgcacggccgccucggccuccac

SEQ ID NO: 28859 - RNA, 24 nt, Artificial Sequence
  Synthetic
ccgcacggccgccucggccuccac

SEQ ID NO: 28860 - RNA, 19 nt, Artificial Sequence
  Synthetic
cggcguggggggcggcacc

SEQ ID NO: 28861 - RNA, 21 nt, Artificial Sequence
  Synthetic
cgcggcguggggggcggcacc

SEQ ID NO: 28862 - RNA, 22 nt, Artificial Sequence
  Synthetic
ccgcggcguggggggcggcacc

SEQ ID NO: 28863 - RNA, 23 nt, Artificial Sequence
  Synthetic
uccgcggcguggggggcggcacc

SEQ ID NO: 28864 - RNA, 24 nt, Artificial Sequence
  Synthetic
cuccgcggcguggggggcggcacc

SEQ ID NO: 28865 - RNA, 18 nt, Artificial Sequence
  Synthetic
cgcccugcucccgagacc

SEQ ID NO: 28866 - RNA, 20 nt, Artificial Sequence
  Synthetic
cgcgcccugcucccgagacc

SEQ ID NO: 28867 - RNA, 24 nt, Artificial Sequence
  Synthetic
cgggcgcgcccugcucccgagacc

SEQ ID NO: 28868 - RNA, 18 nt, Artificial Sequence
  Synthetic
uuggugccgcgggggacc

SEQ ID NO: 28869 - RNA, 20 nt, Artificial Sequence
  Synthetic
uguuggugccgcgggggacc

SEQ ID NO: 28870 - RNA, 19 nt, Artificial Sequence
  Synthetic
agggagcgcggggccgucc

SEQ ID NO: 28871 - RNA, 20 nt, Artificial Sequence
  Synthetic
cagggagcgcggggccgucc

SEQ ID NO: 28872 - RNA, 21 nt, Artificial Sequence
  Synthetic
acagggagcgcggggccgucc

SEQ ID NO: 28873 - RNA, 23 nt, Artificial Sequence
  Synthetic
cgacagggagcgcggggccgucc

SEQ ID NO: 28874 - RNA, 18 nt, Artificial Sequence
  Synthetic
cggccuccacgcgggucc

SEQ ID NO: 28875 - RNA, 19 nt, Artificial Sequence
  Synthetic
ucggccuccacgcgggucc

SEQ ID NO: 28876 - RNA, 20 nt, Artificial Sequence
  Synthetic
cucggccuccacgcgggucc

SEQ ID NO: 28877 - RNA, 21 nt, Artificial Sequence
  Synthetic
ccucggccuccacgcgggucc

SEQ ID NO: 28878 - RNA, 23 nt, Artificial Sequence
  Synthetic
cgccucggccuccacgcgggucc

SEQ ID NO: 28879 - RNA, 24 nt, Artificial Sequence
  Synthetic
ccgccucggccuccacgcgggucc

SEQ ID NO: 28880 - RNA, 19 nt, Artificial Sequence
  Synthetic
cggcgggcugggagguucc

SEQ ID NO: 28881 - RNA, 21 nt, Artificial Sequence
  Synthetic
cgcggcgggcugggagguucc

SEQ ID NO: 28882 - RNA, 22 nt, Artificial Sequence
  Synthetic
ucgcggcgggcugggagguucc

SEQ ID NO: 28883 - RNA, 18 nt, Artificial Sequence
  Synthetic
uugggugucggucugagc

SEQ ID NO: 28884 - RNA, 19 nt, Artificial Sequence
  Synthetic
cuugggugucggucugagc

SEQ ID NO: 28885 - RNA, 21 nt, Artificial Sequence
  Synthetic
ugcuugggugucggucugagc

SEQ ID NO: 28886 - RNA, 23 nt, Artificial Sequence
  Synthetic
ugugcuugggugucggucugagc

SEQ ID NO: 28887 - RNA, 24 nt, Artificial Sequence
  Synthetic
cugugcuugggugucggucugagc

SEQ ID NO: 28888 - RNA, 20 nt, Artificial Sequence
  Synthetic
cggcccguggccgcggucgc

SEQ ID NO: 28889 - RNA, 22 nt, Artificial Sequence
  Synthetic
agcggcccguggccgcggucgc

SEQ ID NO: 28890 - RNA, 24 nt, Artificial Sequence
  Synthetic
cgagcggcccguggccgcggucgc

SEQ ID NO: 28891 - RNA, 18 nt, Artificial Sequence
  Synthetic
aggacgaggccgcggggc

SEQ ID NO: 28892 - RNA, 21 nt, Artificial Sequence
  Synthetic
cggaggacgaggccgcggggc

SEQ ID NO: 28893 - RNA, 24 nt, Artificial Sequence
  Synthetic
aggcggaggacgaggccgcggggc

SEQ ID NO: 28894 - RNA, 18 nt, Artificial Sequence
  Synthetic
ccggcccagacucugugc

SEQ ID NO: 28895 - RNA, 19 nt, Artificial Sequence
  Synthetic
cccggcccagacucugugc

SEQ ID NO: 28896 - RNA, 21 nt, Artificial Sequence
  Synthetic
ugcccggcccagacucugugc

SEQ ID NO: 28897 - RNA, 22 nt, Artificial Sequence
  Synthetic
cugcccggcccagacucugugc

SEQ ID NO: 28898 - RNA, 23 nt, Artificial Sequence
  Synthetic
ccugcccggcccagacucugugc

SEQ ID NO: 28899 - RNA, 19 nt, Artificial Sequence
  Synthetic
ugcgcgcgugcucggggag

SEQ ID NO: 28900 - RNA, 20 nt, Artificial Sequence
  Synthetic
uugcgcgcgugcucggggag

SEQ ID NO: 28901 - RNA, 22 nt, Artificial Sequence
  Synthetic
aguugcgcgcgugcucggggag

SEQ ID NO: 28902 - RNA, 23 nt, Artificial Sequence
  Synthetic
caguugcgcgcgugcucggggag

SEQ ID NO: 28903 - RNA, 18 nt, Artificial Sequence
  Synthetic
agcgcgugaggccgggcg

SEQ ID NO: 28904 - RNA, 19 nt, Artificial Sequence
  Synthetic
uagcgcgugaggccgggcg

SEQ ID NO: 28905 - RNA, 22 nt, Artificial Sequence
  Synthetic
agguagcgcgugaggccgggcg

SEQ ID NO: 28906 - RNA, 23 nt, Artificial Sequence
  Synthetic
cagguagcgcgugaggccgggcg

SEQ ID NO: 28907 - RNA, 18 nt, Artificial Sequence
  Synthetic
acuccgacgcggggggcg

SEQ ID NO: 28908 - RNA, 19 nt, Artificial Sequence
  Synthetic
cacuccgacgcggggggcg

SEQ ID NO: 28909 - RNA, 20 nt, Artificial Sequence
  Synthetic
ccacuccgacgcggggggcg

SEQ ID NO: 28910 - RNA, 21 nt, Artificial Sequence
  Synthetic
uccacuccgacgcggggggcg

SEQ ID NO: 28911 - RNA, 22 nt, Artificial Sequence
  Synthetic
uuccacuccgacgcggggggcg

SEQ ID NO: 28912 - RNA, 24 nt, Artificial Sequence
  Synthetic
uguuccacuccgacgcggggggcg

SEQ ID NO: 28913 - RNA, 19 nt, Artificial Sequence
  Synthetic
cguccgugccgggccacgg

SEQ ID NO: 28914 - RNA, 20 nt, Artificial Sequence
  Synthetic
ucguccgugccgggccacgg

SEQ ID NO: 28915 - RNA, 22 nt, Artificial Sequence
  Synthetic
cgucguccgugccgggccacgg

SEQ ID NO: 28916 - RNA, 23 nt, Artificial Sequence
  Synthetic
ucgucguccgugccgggccacgg

SEQ ID NO: 28917 - RNA, 24 nt, Artificial Sequence
  Synthetic
cucgucguccgugccgggccacgg

SEQ ID NO: 28918 - RNA, 21 nt, Artificial Sequence
  Synthetic
cggggcgccagggggcgccgg

SEQ ID NO: 28919 - RNA, 23 nt, Artificial Sequence
  Synthetic
cgcggggcgccagggggcgccgg

SEQ ID NO: 28920 - RNA, 24 nt, Artificial Sequence
  Synthetic
ccgcggggcgccagggggcgccgg

SEQ ID NO: 28921 - RNA, 19 nt, Artificial Sequence
  Synthetic
cggcgcggagacggcgggg

SEQ ID NO: 28922 - RNA, 24 nt, Artificial Sequence
  Synthetic
cggggcggcgcggagacggcgggg

SEQ ID NO: 28923 - RNA, 18 nt, Artificial Sequence
  Synthetic
ccgggggucguucacuau

SEQ ID NO: 28924 - RNA, 19 nt, Artificial Sequence
  Synthetic
uccgggggucguucacuau

SEQ ID NO: 28925 - RNA, 23 nt, Artificial Sequence
  Synthetic
cggguccgggggucguucacuau

SEQ ID NO: 28926 - RNA, 19 nt, Artificial Sequence
  Synthetic
uggccgcggucgcccgagu

SEQ ID NO: 28927 - RNA, 21 nt, Artificial Sequence
  Synthetic
cguggccgcggucgcccgagu

SEQ ID NO: 28928 - RNA, 22 nt, Artificial Sequence
  Synthetic
ccguggccgcggucgcccgagu

SEQ ID NO: 28929 - RNA, 23 nt, Artificial Sequence
  Synthetic
cccguggccgcggucgcccgagu

SEQ ID NO: 28930 - RNA, 18 nt, Artificial Sequence
  Synthetic
cucgccccucgcccccca

SEQ ID NO: 28931 - RNA, 20 nt, Artificial Sequence
  Synthetic
cgcucgccccucgcccccca

SEQ ID NO: 28932 - RNA, 22 nt, Artificial Sequence
  Synthetic
cgcgcucgccccucgcccccca

SEQ ID NO: 28933 - RNA, 23 nt, Artificial Sequence
  Synthetic
ccgcgcucgccccucgcccccca

SEQ ID NO: 28934 - RNA, 24 nt, Artificial Sequence
  Synthetic
cccgcgcucgccccucgcccccca

SEQ ID NO: 28935 - RNA, 18 nt, Artificial Sequence
  Synthetic
uagugggcgugaccgcca

SEQ ID NO: 28936 - RNA, 19 nt, Artificial Sequence
  Synthetic
auagugggcgugaccgcca

SEQ ID NO: 28937 - RNA, 21 nt, Artificial Sequence
  Synthetic
ugauagugggcgugaccgcca

SEQ ID NO: 28938 - RNA, 22 nt, Artificial Sequence
  Synthetic
cugauagugggcgugaccgcca

SEQ ID NO: 28939 - RNA, 23 nt, Artificial Sequence
  Synthetic
ccugauagugggcgugaccgcca

SEQ ID NO: 28940 - RNA, 24 nt, Artificial Sequence
  Synthetic
accugauagugggcgugaccgcca

SEQ ID NO: 28941 - RNA, 18 nt, Artificial Sequence
  Synthetic
cagaccgacacccaagca

SEQ ID NO: 28942 - RNA, 19 nt, Artificial Sequence
  Synthetic
ucagaccgacacccaagca

SEQ ID NO: 28943 - RNA, 20 nt, Artificial Sequence
  Synthetic
cucagaccgacacccaagca

SEQ ID NO: 28944 - RNA, 23 nt, Artificial Sequence
  Synthetic
aggcucagaccgacacccaagca

SEQ ID NO: 28945 - RNA, 24 nt, Artificial Sequence
  Synthetic
caggcucagaccgacacccaagca

SEQ ID NO: 28946 - RNA, 19 nt, Artificial Sequence
  Synthetic
cgggcgcggagggaggacc

SEQ ID NO: 28947 - RNA, 20 nt, Artificial Sequence
  Synthetic
ccgggcgcggagggaggacc

SEQ ID NO: 28948 - RNA, 24 nt, Artificial Sequence
  Synthetic
agggccgggcgcggagggaggacc

SEQ ID NO: 28949 - RNA, 18 nt, Artificial Sequence
  Synthetic
cgucgcggccgucgugcc

SEQ ID NO: 28950 - RNA, 19 nt, Artificial Sequence
  Synthetic
ccgucgcggccgucgugcc

SEQ ID NO: 28951 - RNA, 21 nt, Artificial Sequence
  Synthetic
ugccgucgcggccgucgugcc

SEQ ID NO: 28952 - RNA, 22 nt, Artificial Sequence
  Synthetic
cugccgucgcggccgucgugcc

SEQ ID NO: 28953 - RNA, 23 nt, Artificial Sequence
  Synthetic
ccugccgucgcggccgucgugcc

SEQ ID NO: 28954 - RNA, 24 nt, Artificial Sequence
  Synthetic
cccugccgucgcggccgucgugcc

SEQ ID NO: 28955 - RNA, 18 nt, Artificial Sequence
  Synthetic
caggcgcgaccgacgcgc

SEQ ID NO: 28956 - RNA, 22 nt, Artificial Sequence
  Synthetic
cgggcaggcgcgaccgacgcgc

SEQ ID NO: 28957 - RNA, 23 nt, Artificial Sequence
  Synthetic
ccgggcaggcgcgaccgacgcgc

SEQ ID NO: 28958 - RNA, 19 nt, Artificial Sequence
  Synthetic
cgcgcuaccugcccaucgc

SEQ ID NO: 28959 - RNA, 20 nt, Artificial Sequence
  Synthetic
acgcgcuaccugcccaucgc

SEQ ID NO: 28960 - RNA, 21 nt, Artificial Sequence
  Synthetic
cacgcgcuaccugcccaucgc

SEQ ID NO: 28961 - RNA, 22 nt, Artificial Sequence
  Synthetic
ucacgcgcuaccugcccaucgc

SEQ ID NO: 28962 - RNA, 23 nt, Artificial Sequence
  Synthetic
cucacgcgcuaccugcccaucgc

SEQ ID NO: 28963 - RNA, 24 nt, Artificial Sequence
  Synthetic
ccucacgcgcuaccugcccaucgc

SEQ ID NO: 28964 - RNA, 18 nt, Artificial Sequence
  Synthetic
cccgcccccggaagaggc

SEQ ID NO: 28965 - RNA, 21 nt, Artificial Sequence
  Synthetic
cggcccgcccccggaagaggc

SEQ ID NO: 28966 - RNA, 24 nt, Artificial Sequence
  Synthetic
cggcggcccgcccccggaagaggc

SEQ ID NO: 28967 - RNA, 18 nt, Artificial Sequence
  Synthetic
cggcgccccguugcgggc

SEQ ID NO: 28968 - RNA, 21 nt, Artificial Sequence
  Synthetic
cggcggcgccccguugcgggc

SEQ ID NO: 28969 - RNA, 23 nt, Artificial Sequence
  Synthetic
agcggcggcgccccguugcgggc

SEQ ID NO: 28970 - RNA, 24 nt, Artificial Sequence
  Synthetic
cagcggcggcgccccguugcgggc

SEQ ID NO: 28971 - RNA, 20 nt, Artificial Sequence
  Synthetic
cggccgucgccccgcgcguc

SEQ ID NO: 28972 - RNA, 22 nt, Artificial Sequence
  Synthetic
cgcggccgucgccccgcgcguc

SEQ ID NO: 28973 - RNA, 24 nt, Artificial Sequence
  Synthetic
cgcgcggccgucgccccgcgcguc

SEQ ID NO: 28974 - RNA, 18 nt, Artificial Sequence
  Synthetic
acgcccccgcgggccacg

SEQ ID NO: 28975 - RNA, 20 nt, Artificial Sequence
  Synthetic
cgacgcccccgcgggccacg

SEQ ID NO: 28976 - RNA, 23 nt, Artificial Sequence
  Synthetic
cggcgacgcccccgcgggccacg

SEQ ID NO: 28977 - RNA, 24 nt, Artificial Sequence
  Synthetic
ccggcgacgcccccgcgggccacg

SEQ ID NO: 28978 - RNA, 21 nt, Artificial Sequence
  Synthetic
cggggggcgcgcgcaggcgcg

SEQ ID NO: 28979 - RNA, 24 nt, Artificial Sequence
  Synthetic
cggcggggggcgcgcgcaggcgcg

SEQ ID NO: 28980 - RNA, 18 nt, Artificial Sequence
  Synthetic
ccccguugcgggcggggg

SEQ ID NO: 28981 - RNA, 20 nt, Artificial Sequence
  Synthetic
cgccccguugcgggcggggg

SEQ ID NO: 28982 - RNA, 23 nt, Artificial Sequence
  Synthetic
cggcgccccguugcgggcggggg

SEQ ID NO: 28983 - RNA, 18 nt, Artificial Sequence
  Synthetic
ugcgggcgggggugggau

SEQ ID NO: 28984 - RNA, 19 nt, Artificial Sequence
  Synthetic
uugcgggcgggggugggau

SEQ ID NO: 28985 - RNA, 21 nt, Artificial Sequence
  Synthetic
cguugcgggcgggggugggau

SEQ ID NO: 28986 - RNA, 22 nt, Artificial Sequence
  Synthetic
ccguugcgggcgggggugggau

SEQ ID NO: 28987 - RNA, 23 nt, Artificial Sequence
  Synthetic
cccguugcgggcgggggugggau

SEQ ID NO: 28988 - RNA, 24 nt, Artificial Sequence
  Synthetic
ccccguugcgggcgggggugggau

SEQ ID NO: 28989 - RNA, 19 nt, Artificial Sequence
  Synthetic
cgucggaguggaacagccu

SEQ ID NO: 28990 - RNA, 21 nt, Artificial Sequence
  Synthetic
cgcgucggaguggaacagccu

SEQ ID NO: 28991 - RNA, 22 nt, Artificial Sequence
  Synthetic
ccgcgucggaguggaacagccu

SEQ ID NO: 28992 - RNA, 23 nt, Artificial Sequence
  Synthetic
cccgcgucggaguggaacagccu

SEQ ID NO: 28993 - RNA, 24 nt, Artificial Sequence
  Synthetic
ccccgcgucggaguggaacagccu

SEQ ID NO: 28994 - RNA, 18 nt, Artificial Sequence
  Synthetic
acccgacgccccccgcgu

SEQ ID NO: 28995 - RNA, 19 nt, Artificial Sequence
  Synthetic
uacccgacgccccccgcgu

SEQ ID NO: 28996 - RNA, 20 nt, Artificial Sequence
  Synthetic
cuacccgacgccccccgcgu

SEQ ID NO: 28997 - RNA, 21 nt, Artificial Sequence
  Synthetic
acuacccgacgccccccgcgu

SEQ ID NO: 28998 - RNA, 23 nt, Artificial Sequence
  Synthetic
cgacuacccgacgccccccgcgu

SEQ ID NO: 28999 - RNA, 24 nt, Artificial Sequence
  Synthetic
ccgacuacccgacgccccccgcgu

SEQ ID NO: 29000 - RNA, 18 nt, Artificial Sequence
  Synthetic
cggaggaggaggagacaa

SEQ ID NO: 29001 - RNA, 19 nt, Artificial Sequence
  Synthetic
gcggaggaggaggagacaa

SEQ ID NO: 29002 - RNA, 20 nt, Artificial Sequence
  Synthetic
ugcggaggaggaggagacaa

SEQ ID NO: 29003 - RNA, 21 nt, Artificial Sequence
  Synthetic
gugcggaggaggaggagacaa

SEQ ID NO: 29004 - RNA, 22 nt, Artificial Sequence
  Synthetic
ugugcggaggaggaggagacaa

SEQ ID NO: 29005 - RNA, 23 nt, Artificial Sequence
  Synthetic
cugugcggaggaggaggagacaa

SEQ ID NO: 29006 - RNA, 24 nt, Artificial Sequence
  Synthetic
ccugugcggaggaggaggagacaa

SEQ ID NO: 29007 - RNA, 18 nt, Artificial Sequence
  Synthetic
ucccacccccgcccgcaa

SEQ ID NO: 29008 - RNA, 19 nt, Artificial Sequence
  Synthetic
aucccacccccgcccgcaa

SEQ ID NO: 29009 - RNA, 20 nt, Artificial Sequence
  Synthetic
gaucccacccccgcccgcaa

SEQ ID NO: 29010 - RNA, 21 nt, Artificial Sequence
  Synthetic
agaucccacccccgcccgcaa

SEQ ID NO: 29011 - RNA, 22 nt, Artificial Sequence
  Synthetic
cagaucccacccccgcccgcaa

SEQ ID NO: 29012 - RNA, 23 nt, Artificial Sequence
  Synthetic
ccagaucccacccccgcccgcaa

SEQ ID NO: 29013 - RNA, 24 nt, Artificial Sequence
  Synthetic
cccagaucccacccccgcccgcaa

SEQ ID NO: 29014 - RNA, 18 nt, Artificial Sequence
  Synthetic
cgccggccgcagggggaa

SEQ ID NO: 29015 - RNA, 19 nt, Artificial Sequence
  Synthetic
ccgccggccgcagggggaa

SEQ ID NO: 29016 - RNA, 20 nt, Artificial Sequence
  Synthetic
cccgccggccgcagggggaa

SEQ ID NO: 29017 - RNA, 21 nt, Artificial Sequence
  Synthetic
ccccgccggccgcagggggaa

SEQ ID NO: 29018 - RNA, 22 nt, Artificial Sequence
  Synthetic
cccccgccggccgcagggggaa

SEQ ID NO: 29019 - RNA, 23 nt, Artificial Sequence
  Synthetic
ccccccgccggccgcagggggaa

SEQ ID NO: 29020 - RNA, 24 nt, Artificial Sequence
  Synthetic
gccccccgccggccgcagggggaa

SEQ ID NO: 29021 - RNA, 18 nt, Artificial Sequence
  Synthetic
gcggaggaggaggagaca

SEQ ID NO: 29022 - RNA, 19 nt, Artificial Sequence
  Synthetic
ugcggaggaggaggagaca

SEQ ID NO: 29023 - RNA, 20 nt, Artificial Sequence
  Synthetic
gugcggaggaggaggagaca

SEQ ID NO: 29024 - RNA, 21 nt, Artificial Sequence
  Synthetic
ugugcggaggaggaggagaca

SEQ ID NO: 29025 - RNA, 22 nt, Artificial Sequence
  Synthetic
cugugcggaggaggaggagaca

SEQ ID NO: 29026 - RNA, 23 nt, Artificial Sequence
  Synthetic
ccugugcggaggaggaggagaca

SEQ ID NO: 29027 - RNA, 24 nt, Artificial Sequence
  Synthetic
accugugcggaggaggaggagaca

SEQ ID NO: 29028 - RNA, 18 nt, Artificial Sequence
  Synthetic
uguguccccccagcgaca

SEQ ID NO: 29029 - RNA, 19 nt, Artificial Sequence
  Synthetic
guguguccccccagcgaca

SEQ ID NO: 29030 - RNA, 20 nt, Artificial Sequence
  Synthetic
cguguguccccccagcgaca

SEQ ID NO: 29031 - RNA, 21 nt, Artificial Sequence
  Synthetic
ccguguguccccccagcgaca

SEQ ID NO: 29032 - RNA, 22 nt, Artificial Sequence
  Synthetic
accguguguccccccagcgaca

SEQ ID NO: 29033 - RNA, 23 nt, Artificial Sequence
  Synthetic
gaccguguguccccccagcgaca

SEQ ID NO: 29034 - RNA, 24 nt, Artificial Sequence
  Synthetic
ggaccguguguccccccagcgaca

SEQ ID NO: 29035 - RNA, 18 nt, Artificial Sequence
  Synthetic
ccgcgcucgcagacacca

SEQ ID NO: 29036 - RNA, 19 nt, Artificial Sequence
  Synthetic
uccgcgcucgcagacacca

SEQ ID NO: 29037 - RNA, 20 nt, Artificial Sequence
  Synthetic
guccgcgcucgcagacacca

SEQ ID NO: 29038 - RNA, 21 nt, Artificial Sequence
  Synthetic
cguccgcgcucgcagacacca

SEQ ID NO: 29039 - RNA, 22 nt, Artificial Sequence
  Synthetic
gcguccgcgcucgcagacacca

SEQ ID NO: 29040 - RNA, 23 nt, Artificial Sequence
  Synthetic
cgcguccgcgcucgcagacacca

SEQ ID NO: 29041 - RNA, 24 nt, Artificial Sequence
  Synthetic
ccgcguccgcgcucgcagacacca

SEQ ID NO: 29042 - RNA, 18 nt, Artificial Sequence
  Synthetic
caaagagcauguugccca

SEQ ID NO: 29043 - RNA, 19 nt, Artificial Sequence
  Synthetic
ucaaagagcauguugccca

SEQ ID NO: 29044 - RNA, 20 nt, Artificial Sequence
  Synthetic
gucaaagagcauguugccca

SEQ ID NO: 29045 - RNA, 21 nt, Artificial Sequence
  Synthetic
ggucaaagagcauguugccca

SEQ ID NO: 29046 - RNA, 22 nt, Artificial Sequence
  Synthetic
uggucaaagagcauguugccca

SEQ ID NO: 29047 - RNA, 23 nt, Artificial Sequence
  Synthetic
cuggucaaagagcauguugccca

SEQ ID NO: 29048 - RNA, 24 nt, Artificial Sequence
  Synthetic
ccuggucaaagagcauguugccca

SEQ ID NO: 29049 - RNA, 18 nt, Artificial Sequence
  Synthetic
ccacuaucagguacgcca

SEQ ID NO: 29050 - RNA, 19 nt, Artificial Sequence
  Synthetic
cccacuaucagguacgcca

SEQ ID NO: 29051 - RNA, 20 nt, Artificial Sequence
  Synthetic
gcccacuaucagguacgcca

SEQ ID NO: 29052 - RNA, 21 nt, Artificial Sequence
  Synthetic
cgcccacuaucagguacgcca

SEQ ID NO: 29053 - RNA, 22 nt, Artificial Sequence
  Synthetic
acgcccacuaucagguacgcca

SEQ ID NO: 29054 - RNA, 23 nt, Artificial Sequence
  Synthetic
cacgcccacuaucagguacgcca

SEQ ID NO: 29055 - RNA, 24 nt, Artificial Sequence
  Synthetic
ucacgcccacuaucagguacgcca

SEQ ID NO: 29056 - RNA, 18 nt, Artificial Sequence
  Synthetic
cugcuccgcggggcgcca

SEQ ID NO: 29057 - RNA, 19 nt, Artificial Sequence
  Synthetic
gcugcuccgcggggcgcca

SEQ ID NO: 29058 - RNA, 20 nt, Artificial Sequence
  Synthetic
ugcugcuccgcggggcgcca

SEQ ID NO: 29059 - RNA, 21 nt, Artificial Sequence
  Synthetic
cugcugcuccgcggggcgcca

SEQ ID NO: 29060 - RNA, 22 nt, Artificial Sequence
  Synthetic
gcugcugcuccgcggggcgcca

SEQ ID NO: 29061 - RNA, 23 nt, Artificial Sequence
  Synthetic
ugcugcugcuccgcggggcgcca

SEQ ID NO: 29062 - RNA, 24 nt, Artificial Sequence
  Synthetic
cugcugcugcuccgcggggcgcca

SEQ ID NO: 29063 - RNA, 18 nt, Artificial Sequence
  Synthetic
gucguccgugccgggcca

SEQ ID NO: 29064 - RNA, 19 nt, Artificial Sequence
  Synthetic
cgucguccgugccgggcca

SEQ ID NO: 29065 - RNA, 20 nt, Artificial Sequence
  Synthetic
ucgucguccgugccgggcca

SEQ ID NO: 29066 - RNA, 21 nt, Artificial Sequence
  Synthetic
cucgucguccgugccgggcca

SEQ ID NO: 29067 - RNA, 22 nt, Artificial Sequence
  Synthetic
ccucgucguccgugccgggcca

SEQ ID NO: 29068 - RNA, 23 nt, Artificial Sequence
  Synthetic
uccucgucguccgugccgggcca

SEQ ID NO: 29069 - RNA, 24 nt, Artificial Sequence
  Synthetic
guccucgucguccgugccgggcca

SEQ ID NO: 29070 - RNA, 18 nt, Artificial Sequence
  Synthetic
aucccacccccgcccgca

SEQ ID NO: 29071 - RNA, 19 nt, Artificial Sequence
  Synthetic
gaucccacccccgcccgca

SEQ ID NO: 29072 - RNA, 20 nt, Artificial Sequence
  Synthetic
agaucccacccccgcccgca

SEQ ID NO: 29073 - RNA, 21 nt, Artificial Sequence
  Synthetic
cagaucccacccccgcccgca

SEQ ID NO: 29074 - RNA, 22 nt, Artificial Sequence
  Synthetic
ccagaucccacccccgcccgca

SEQ ID NO: 29075 - RNA, 23 nt, Artificial Sequence
  Synthetic
cccagaucccacccccgcccgca

SEQ ID NO: 29076 - RNA, 24 nt, Artificial Sequence
  Synthetic
acccagaucccacccccgcccgca

SEQ ID NO: 29077 - RNA, 18 nt, Artificial Sequence
  Synthetic
ccaccagccccgcccgca

SEQ ID NO: 29078 - RNA, 19 nt, Artificial Sequence
  Synthetic
cccaccagccccgcccgca

SEQ ID NO: 29079 - RNA, 20 nt, Artificial Sequence
  Synthetic
ucccaccagccccgcccgca

SEQ ID NO: 29080 - RNA, 21 nt, Artificial Sequence
  Synthetic
cucccaccagccccgcccgca

SEQ ID NO: 29081 - RNA, 22 nt, Artificial Sequence
  Synthetic
gcucccaccagccccgcccgca

SEQ ID NO: 29082 - RNA, 23 nt, Artificial Sequence
  Synthetic
cgcucccaccagccccgcccgca

SEQ ID NO: 29083 - RNA, 24 nt, Artificial Sequence
  Synthetic
acgcucccaccagccccgcccgca

SEQ ID NO: 29084 - RNA, 18 nt, Artificial Sequence
  Synthetic
cgccccccgccggccgca

SEQ ID NO: 29085 - RNA, 19 nt, Artificial Sequence
  Synthetic
gcgccccccgccggccgca

SEQ ID NO: 29086 - RNA, 20 nt, Artificial Sequence
  Synthetic
cgcgccccccgccggccgca

SEQ ID NO: 29087 - RNA, 21 nt, Artificial Sequence
  Synthetic
gcgcgccccccgccggccgca

SEQ ID NO: 29088 - RNA, 22 nt, Artificial Sequence
  Synthetic
cgcgcgccccccgccggccgca

SEQ ID NO: 29089 - RNA, 23 nt, Artificial Sequence
  Synthetic
gcgcgcgccccccgccggccgca

SEQ ID NO: 29090 - RNA, 24 nt, Artificial Sequence
  Synthetic
ugcgcgcgccccccgccggccgca

SEQ ID NO: 29091 - RNA, 18 nt, Artificial Sequence
  Synthetic
gcggcguggggggcggca

SEQ ID NO: 29092 - RNA, 19 nt, Artificial Sequence
  Synthetic
cgcggcguggggggcggca

SEQ ID NO: 29093 - RNA, 20 nt, Artificial Sequence
  Synthetic
ccgcggcguggggggcggca

SEQ ID NO: 29094 - RNA, 21 nt, Artificial Sequence
  Synthetic
uccgcggcguggggggcggca

SEQ ID NO: 29095 - RNA, 22 nt, Artificial Sequence
  Synthetic
cuccgcggcguggggggcggca

SEQ ID NO: 29096 - RNA, 23 nt, Artificial Sequence
  Synthetic
ccuccgcggcguggggggcggca

SEQ ID NO: 29097 - RNA, 24 nt, Artificial Sequence
  Synthetic
cccuccgcggcguggggggcggca

SEQ ID NO: 29098 - RNA, 18 nt, Artificial Sequence
  Synthetic
accagggugcccugguca

SEQ ID NO: 29099 - RNA, 19 nt, Artificial Sequence
  Synthetic
caccagggugcccugguca

SEQ ID NO: 29100 - RNA, 20 nt, Artificial Sequence
  Synthetic
ccaccagggugcccugguca

SEQ ID NO: 29101 - RNA, 21 nt, Artificial Sequence
  Synthetic
cccaccagggugcccugguca

SEQ ID NO: 29102 - RNA, 22 nt, Artificial Sequence
  Synthetic
gcccaccagggugcccugguca

SEQ ID NO: 29103 - RNA, 23 nt, Artificial Sequence
  Synthetic
cgcccaccagggugcccugguca

SEQ ID NO: 29104 - RNA, 24 nt, Artificial Sequence
  Synthetic
gcgcccaccagggugcccugguca

SEQ ID NO: 29105 - RNA, 18 nt, Artificial Sequence
  Synthetic
gaccgcggccugggacga

SEQ ID NO: 29106 - RNA, 19 nt, Artificial Sequence
  Synthetic
cgaccgcggccugggacga

SEQ ID NO: 29107 - RNA, 20 nt, Artificial Sequence
  Synthetic
gcgaccgcggccugggacga

SEQ ID NO: 29108 - RNA, 21 nt, Artificial Sequence
  Synthetic
ggcgaccgcggccugggacga

SEQ ID NO: 29109 - RNA, 22 nt, Artificial Sequence
  Synthetic
cggcgaccgcggccugggacga

SEQ ID NO: 29110 - RNA, 23 nt, Artificial Sequence
  Synthetic
gcggcgaccgcggccugggacga

SEQ ID NO: 29111 - RNA, 24 nt, Artificial Sequence
  Synthetic
ggcggcgaccgcggccugggacga

SEQ ID NO: 29112 - RNA, 18 nt, Artificial Sequence
  Synthetic
ggacgacggagacgccga

SEQ ID NO: 29113 - RNA, 19 nt, Artificial Sequence
  Synthetic
gggacgacggagacgccga

SEQ ID NO: 29114 - RNA, 20 nt, Artificial Sequence
  Synthetic
ugggacgacggagacgccga

SEQ ID NO: 29115 - RNA, 21 nt, Artificial Sequence
  Synthetic
cugggacgacggagacgccga

SEQ ID NO: 29116 - RNA, 22 nt, Artificial Sequence
  Synthetic
ccugggacgacggagacgccga

SEQ ID NO: 29117 - RNA, 23 nt, Artificial Sequence
  Synthetic
gccugggacgacggagacgccga

SEQ ID NO: 29118 - RNA, 24 nt, Artificial Sequence
  Synthetic
ggccugggacgacggagacgccga

SEQ ID NO: 29119 - RNA, 18 nt, Artificial Sequence
  Synthetic
cagcagcgcgggggccga

SEQ ID NO: 29120 - RNA, 19 nt, Artificial Sequence
  Synthetic
gcagcagcgcgggggccga

SEQ ID NO: 29121 - RNA, 20 nt, Artificial Sequence
  Synthetic
cgcagcagcgcgggggccga

SEQ ID NO: 29122 - RNA, 21 nt, Artificial Sequence
  Synthetic
gcgcagcagcgcgggggccga

SEQ ID NO: 29123 - RNA, 22 nt, Artificial Sequence
  Synthetic
ggcgcagcagcgcgggggccga

SEQ ID NO: 29124 - RNA, 23 nt, Artificial Sequence
  Synthetic
cggcgcagcagcgcgggggccga

SEQ ID NO: 29125 - RNA, 24 nt, Artificial Sequence
  Synthetic
gcggcgcagcagcgcgggggccga

SEQ ID NO: 29126 - RNA, 18 nt, Artificial Sequence
  Synthetic
cguguguccccccagcga

SEQ ID NO: 29127 - RNA, 19 nt, Artificial Sequence
  Synthetic
ccguguguccccccagcga

SEQ ID NO: 29128 - RNA, 20 nt, Artificial Sequence
  Synthetic
accguguguccccccagcga

SEQ ID NO: 29129 - RNA, 21 nt, Artificial Sequence
  Synthetic
gaccguguguccccccagcga

SEQ ID NO: 29130 - RNA, 22 nt, Artificial Sequence
  Synthetic
ggaccguguguccccccagcga

SEQ ID NO: 29131 - RNA, 23 nt, Artificial Sequence
  Synthetic
cggaccguguguccccccagcga

SEQ ID NO: 29132 - RNA, 24 nt, Artificial Sequence
  Synthetic
gcggaccguguguccccccagcga

SEQ ID NO: 29133 - RNA, 18 nt, Artificial Sequence
  Synthetic
agaccacggguggcgcga

SEQ ID NO: 29134 - RNA, 19 nt, Artificial Sequence
  Synthetic
gagaccacggguggcgcga

SEQ ID NO: 29135 - RNA, 20 nt, Artificial Sequence
  Synthetic
cgagaccacggguggcgcga

SEQ ID NO: 29136 - RNA, 21 nt, Artificial Sequence
  Synthetic
ccgagaccacggguggcgcga

SEQ ID NO: 29137 - RNA, 22 nt, Artificial Sequence
  Synthetic
cccgagaccacggguggcgcga

SEQ ID NO: 29138 - RNA, 23 nt, Artificial Sequence
  Synthetic
ucccgagaccacggguggcgcga

SEQ ID NO: 29139 - RNA, 24 nt, Artificial Sequence
  Synthetic
cucccgagaccacggguggcgcga

SEQ ID NO: 29140 - RNA, 18 nt, Artificial Sequence
  Synthetic
agccugggucaugcgcga

SEQ ID NO: 29141 - RNA, 19 nt, Artificial Sequence
  Synthetic
gagccugggucaugcgcga

SEQ ID NO: 29142 - RNA, 20 nt, Artificial Sequence
  Synthetic
ugagccugggucaugcgcga

SEQ ID NO: 29143 - RNA, 21 nt, Artificial Sequence
  Synthetic
cugagccugggucaugcgcga

SEQ ID NO: 29144 - RNA, 22 nt, Artificial Sequence
  Synthetic
ucugagccugggucaugcgcga

SEQ ID NO: 29145 - RNA, 23 nt, Artificial Sequence
  Synthetic
gucugagccugggucaugcgcga

SEQ ID NO: 29146 - RNA, 24 nt, Artificial Sequence
  Synthetic
ggucugagccugggucaugcgcga

SEQ ID NO: 29147 - RNA, 18 nt, Artificial Sequence
  Synthetic
ccacgggggggugggcga

SEQ ID NO: 29148 - RNA, 19 nt, Artificial Sequence
  Synthetic
gccacgggggggugggcga

SEQ ID NO: 29149 - RNA, 20 nt, Artificial Sequence
  Synthetic
ggccacgggggggugggcga

SEQ ID NO: 29150 - RNA, 21 nt, Artificial Sequence
  Synthetic
gggccacgggggggugggcga

SEQ ID NO: 29151 - RNA, 22 nt, Artificial Sequence
  Synthetic
cgggccacgggggggugggcga

SEQ ID NO: 29152 - RNA, 23 nt, Artificial Sequence
  Synthetic
ccgggccacgggggggugggcga

SEQ ID NO: 29153 - RNA, 24 nt, Artificial Sequence
  Synthetic
gccgggccacgggggggugggcga

SEQ ID NO: 29154 - RNA, 18 nt, Artificial Sequence
  Synthetic
uccgggggucguucacua

SEQ ID NO: 29155 - RNA, 19 nt, Artificial Sequence
  Synthetic
guccgggggucguucacua

SEQ ID NO: 29156 - RNA, 20 nt, Artificial Sequence
  Synthetic
gguccgggggucguucacua

SEQ ID NO: 29157 - RNA, 21 nt, Artificial Sequence
  Synthetic
ggguccgggggucguucacua

SEQ ID NO: 29158 - RNA, 22 nt, Artificial Sequence
  Synthetic
cggguccgggggucguucacua

SEQ ID NO: 29159 - RNA, 23 nt, Artificial Sequence
  Synthetic
gcggguccgggggucguucacua

SEQ ID NO: 29160 - RNA, 24 nt, Artificial Sequence
  Synthetic
cgcggguccgggggucguucacua

SEQ ID NO: 29161 - RNA, 18 nt, Artificial Sequence
  Synthetic
gagagucgcugaugacua

SEQ ID NO: 29162 - RNA, 19 nt, Artificial Sequence
  Synthetic
ggagagucgcugaugacua

SEQ ID NO: 29163 - RNA, 20 nt, Artificial Sequence
  Synthetic
gggagagucgcugaugacua

SEQ ID NO: 29164 - RNA, 21 nt, Artificial Sequence
  Synthetic
ggggagagucgcugaugacua

SEQ ID NO: 29165 - RNA, 22 nt, Artificial Sequence
  Synthetic
gggggagagucgcugaugacua

SEQ ID NO: 29166 - RNA, 23 nt, Artificial Sequence
  Synthetic
cgggggagagucgcugaugacua

SEQ ID NO: 29167 - RNA, 24 nt, Artificial Sequence
  Synthetic
gcgggggagagucgcugaugacua

SEQ ID NO: 29168 - RNA, 18 nt, Artificial Sequence
  Synthetic
cgcgcucgcagacaccac

SEQ ID NO: 29169 - RNA, 19 nt, Artificial Sequence
  Synthetic
ccgcgcucgcagacaccac

SEQ ID NO: 29170 - RNA, 20 nt, Artificial Sequence
  Synthetic
uccgcgcucgcagacaccac

SEQ ID NO: 29171 - RNA, 21 nt, Artificial Sequence
  Synthetic
guccgcgcucgcagacaccac

SEQ ID NO: 29172 - RNA, 22 nt, Artificial Sequence
  Synthetic
cguccgcgcucgcagacaccac

SEQ ID NO: 29173 - RNA, 23 nt, Artificial Sequence
  Synthetic
gcguccgcgcucgcagacaccac

SEQ ID NO: 29174 - RNA, 24 nt, Artificial Sequence
  Synthetic
cgcguccgcgcucgcagacaccac

SEQ ID NO: 29175 - RNA, 18 nt, Artificial Sequence
  Synthetic
ucguccgugccgggccac

SEQ ID NO: 29176 - RNA, 19 nt, Artificial Sequence
  Synthetic
gucguccgugccgggccac

SEQ ID NO: 29177 - RNA, 20 nt, Artificial Sequence
  Synthetic
cgucguccgugccgggccac

SEQ ID NO: 29178 - RNA, 21 nt, Artificial Sequence
  Synthetic
ucgucguccgugccgggccac

SEQ ID NO: 29179 - RNA, 22 nt, Artificial Sequence
  Synthetic
cucgucguccgugccgggccac

SEQ ID NO: 29180 - RNA, 23 nt, Artificial Sequence
  Synthetic
ccucgucguccgugccgggccac

SEQ ID NO: 29181 - RNA, 24 nt, Artificial Sequence
  Synthetic
uccucgucguccgugccgggccac

SEQ ID NO: 29182 - RNA, 18 nt, Artificial Sequence
  Synthetic
agggugcggcggcuccac

SEQ ID NO: 29183 - RNA, 19 nt, Artificial Sequence
  Synthetic
cagggugcggcggcuccac

SEQ ID NO: 29184 - RNA, 20 nt, Artificial Sequence
  Synthetic
gcagggugcggcggcuccac

SEQ ID NO: 29185 - RNA, 21 nt, Artificial Sequence
  Synthetic
agcagggugcggcggcuccac

SEQ ID NO: 29186 - RNA, 22 nt, Artificial Sequence
  Synthetic
gagcagggugcggcggcuccac

SEQ ID NO: 29187 - RNA, 23 nt, Artificial Sequence
  Synthetic
ggagcagggugcggcggcuccac

SEQ ID NO: 29188 - RNA, 24 nt, Artificial Sequence
  Synthetic
gggagcagggugcggcggcuccac

SEQ ID NO: 29189 - RNA, 18 nt, Artificial Sequence
  Synthetic
guuccccgucugguccac

SEQ ID NO: 29190 - RNA, 19 nt, Artificial Sequence
  Synthetic
cguuccccgucugguccac

SEQ ID NO: 29191 - RNA, 20 nt, Artificial Sequence
  Synthetic
acguuccccgucugguccac

SEQ ID NO: 29192 - RNA, 21 nt, Artificial Sequence
  Synthetic
cacguuccccgucugguccac

SEQ ID NO: 29193 - RNA, 22 nt, Artificial Sequence
  Synthetic
ccacguuccccgucugguccac

SEQ ID NO: 29194 - RNA, 23 nt, Artificial Sequence
  Synthetic
gccacguuccccgucugguccac

SEQ ID NO: 29195 - RNA, 24 nt, Artificial Sequence
  Synthetic
cgccacguuccccgucugguccac

SEQ ID NO: 29196 - RNA, 18 nt, Artificial Sequence
  Synthetic
cggcguggggggcggcac

SEQ ID NO: 29197 - RNA, 19 nt, Artificial Sequence
  Synthetic
gcggcguggggggcggcac

SEQ ID NO: 29198 - RNA, 20 nt, Artificial Sequence
  Synthetic
cgcggcguggggggcggcac

SEQ ID NO: 29199 - RNA, 21 nt, Artificial Sequence
  Synthetic
ccgcggcguggggggcggcac

SEQ ID NO: 29200 - RNA, 22 nt, Artificial Sequence
  Synthetic
uccgcggcguggggggcggcac

SEQ ID NO: 29201 - RNA, 23 nt, Artificial Sequence
  Synthetic
cuccgcggcguggggggcggcac

SEQ ID NO: 29202 - RNA, 24 nt, Artificial Sequence
  Synthetic
ccuccgcggcguggggggcggcac

SEQ ID NO: 29203 - RNA, 18 nt, Artificial Sequence
  Synthetic
gacgacggagacgccgac

SEQ ID NO: 29204 - RNA, 19 nt, Artificial Sequence
  Synthetic
ggacgacggagacgccgac

SEQ ID NO: 29205 - RNA, 20 nt, Artificial Sequence
  Synthetic
gggacgacggagacgccgac

SEQ ID NO: 29206 - RNA, 21 nt, Artificial Sequence
  Synthetic
ugggacgacggagacgccgac

SEQ ID NO: 29207 - RNA, 22 nt, Artificial Sequence
  Synthetic
cugggacgacggagacgccgac

SEQ ID NO: 29208 - RNA, 23 nt, Artificial Sequence
  Synthetic
ccugggacgacggagacgccgac

SEQ ID NO: 29209 - RNA, 24 nt, Artificial Sequence
  Synthetic
gccugggacgacggagacgccgac

SEQ ID NO: 29210 - RNA, 18 nt, Artificial Sequence
  Synthetic
aggcuguuccacuccgac

SEQ ID NO: 29211 - RNA, 19 nt, Artificial Sequence
  Synthetic
gaggcuguuccacuccgac

SEQ ID NO: 29212 - RNA, 20 nt, Artificial Sequence
  Synthetic
agaggcuguuccacuccgac

SEQ ID NO: 29213 - RNA, 21 nt, Artificial Sequence
  Synthetic
cagaggcuguuccacuccgac

SEQ ID NO: 29214 - RNA, 22 nt, Artificial Sequence
  Synthetic
ccagaggcuguuccacuccgac

SEQ ID NO: 29215 - RNA, 23 nt, Artificial Sequence
  Synthetic
uccagaggcuguuccacuccgac

SEQ ID NO: 29216 - RNA, 24 nt, Artificial Sequence
  Synthetic
auccagaggcuguuccacuccgac

SEQ ID NO: 29217 - RNA, 18 nt, Artificial Sequence
  Synthetic
guguguccccccagcgac

SEQ ID NO: 29218 - RNA, 19 nt, Artificial Sequence
  Synthetic
cguguguccccccagcgac

SEQ ID NO: 29219 - RNA, 20 nt, Artificial Sequence
  Synthetic
ccguguguccccccagcgac

SEQ ID NO: 29220 - RNA, 21 nt, Artificial Sequence
  Synthetic
accguguguccccccagcgac

SEQ ID NO: 29221 - RNA, 22 nt, Artificial Sequence
  Synthetic
gaccguguguccccccagcgac

SEQ ID NO: 29222 - RNA, 23 nt, Artificial Sequence
  Synthetic
ggaccguguguccccccagcgac

SEQ ID NO: 29223 - RNA, 24 nt, Artificial Sequence
  Synthetic
cggaccguguguccccccagcgac

SEQ ID NO: 29224 - RNA, 18 nt, Artificial Sequence
  Synthetic
gaccacggguggcgcgac

SEQ ID NO: 29225 - RNA, 19 nt, Artificial Sequence
  Synthetic
agaccacggguggcgcgac

SEQ ID NO: 29226 - RNA, 20 nt, Artificial Sequence
  Synthetic
gagaccacggguggcgcgac

SEQ ID NO: 29227 - RNA, 21 nt, Artificial Sequence
  Synthetic
cgagaccacggguggcgcgac

SEQ ID NO: 29228 - RNA, 22 nt, Artificial Sequence
  Synthetic
ccgagaccacggguggcgcgac

SEQ ID NO: 29229 - RNA, 23 nt, Artificial Sequence
  Synthetic
cccgagaccacggguggcgcgac

SEQ ID NO: 29230 - RNA, 24 nt, Artificial Sequence
  Synthetic
ucccgagaccacggguggcgcgac

SEQ ID NO: 29231 - RNA, 18 nt, Artificial Sequence
  Synthetic
gccugggucaugcgcgac

SEQ ID NO: 29232 - RNA, 19 nt, Artificial Sequence
  Synthetic
agccugggucaugcgcgac

SEQ ID NO: 29233 - RNA, 20 nt, Artificial Sequence
  Synthetic
gagccugggucaugcgcgac

SEQ ID NO: 29234 - RNA, 21 nt, Artificial Sequence
  Synthetic
ugagccugggucaugcgcgac

SEQ ID NO: 29235 - RNA, 22 nt, Artificial Sequence
  Synthetic
cugagccugggucaugcgcgac

SEQ ID NO: 29236 - RNA, 23 nt, Artificial Sequence
  Synthetic
ucugagccugggucaugcgcgac

SEQ ID NO: 29237 - RNA, 24 nt, Artificial Sequence
  Synthetic
gucugagccugggucaugcgcgac

SEQ ID NO: 29238 - RNA, 18 nt, Artificial Sequence
  Synthetic
cucuccccagcgccggac

SEQ ID NO: 29239 - RNA, 19 nt, Artificial Sequence
  Synthetic
ucucuccccagcgccggac

SEQ ID NO: 29240 - RNA, 20 nt, Artificial Sequence
  Synthetic
gucucuccccagcgccggac

SEQ ID NO: 29241 - RNA, 21 nt, Artificial Sequence
  Synthetic
cgucucuccccagcgccggac

SEQ ID NO: 29242 - RNA, 22 nt, Artificial Sequence
  Synthetic
ucgucucuccccagcgccggac

SEQ ID NO: 29243 - RNA, 23 nt, Artificial Sequence
  Synthetic
cucgucucuccccagcgccggac

(The sequence listing continues in the following parts.)

What is claimed is:

1. A genome editing system comprising:
a gRNA molecule comprising a targeting domain that is complementary with a target sequence of a Herpes simplex virus (HSV) viral gene selected from the group consisting of a RS1 gene, a RL2 gene, and a LAT gene, wherein the targeting domain consists of a nucleotide sequence that is identical to, or differs by no more than 3 nucleotides from, a nucleotide sequence selected from the nucleotide sequences set forth in SEQ ID NOS: 208 to 58749; and
a Cas9 molecule.

2. The genome editing system of claim 1, wherein said targeting domain is configured to form a double strand break or a single strand break within about 500 bp, about 450 bp, about 400 bp, about 350 bp, about 300 bp, about 250 bp, about 200 bp, about 150 bp, about 100 bp, about 50 bp, about 25 bp, or about 10 bp of an HSV target position, thereby altering said HSV viral gene.

3. The genome editing system of claim 2, wherein said altering said HSV viral gene comprises knockout of said HSV viral gene, knockdown of said HSV viral gene, or concomitant knockout and knockdown of said HSV viral gene.

4. The genome editing system of claim 1, wherein said targeting domain is configured to target a coding region or a non-coding region of said HSV viral gene, wherein said non-coding region comprises a promoter region, an enhancer region, an intron, the 3' UTR, the 5' UTR, or a polyadenylation signal region of said HSV viral gene; and said coding region comprises an early coding region of said HSV viral gene.

5. The genome editing system of claim 1, wherein said Cas9 molecule is an *S. pyogenes* Cas9 molecule, said genome editing system knocks out said HSV-1 RS1 gene, and said targeting domain consists of a nucleotide sequence that is identical to, or differs by no more than 3 nucleotides from, a nucleotide sequence selected from the nucleotide sequences set forth in SEQ ID NOS: 208 to 2509.

6. The genome editing system of claim 1, wherein said Cas9 molecule is an *S. pyogenes* Cas9 molecule, and
(a) said genome editing system knocks out said HSV-2 RS1 gene, and said targeting domain consists of a nucleotide sequence that is identical to, or differs by no more than 3 nucleotides from, a nucleotide sequence selected from the nucleotide sequences set forth in SEQ ID NOS: 7098 to 9292;
(b) said genome editing system knocks out said HSV-1 RL2 gene, and said targeting domain consists of a nucleotide sequence that is identical to, or differs by no more than 3 nucleotides from, a nucleotide sequence selected from the nucleotide sequences set forth in SEQ ID NOS: 21324 to 22744;
(c) said genome editing system knocks out said HSV-2 RL2 gene, and said targeting domain consists of a nucleotide sequence that is identical to, or differs by no more than 3 nucleotides from, a nucleotide sequence selected from the nucleotide sequences set forth in SEQ ID NOS: 26613 to 28037;
(d) said genome editing system knocks out said HSV-1 LAT gene, and said targeting domain consists of a nucleotide sequence that is identical to, or differs by no more than 3 nucleotides from, a nucleotide sequence selected from the nucleotide sequences set forth in SEQ ID NOS: 31730 to 32746; or
(e) said genome editing system knocks out said HSV-2 LAT gene, and said targeting domain consists of a nucleotide sequence that is identical to, or differs by no more than 3 nucleotides from, a nucleotide sequence selected from the group consisting of: SEQ ID NOS: 35617 to 36926.

7. The genome editing system of claim 1, wherein said Cas9 molecule is an *S. aureus* Cas9 molecule, and
(a) said genome editing system knocks out said HSV-1 RS1 gene, and said targeting domain consists of a nucleotide sequence that is identical to, or differs by no more than 3 nucleotides from, a nucleotide sequence selected from the nucleotide sequences set forth in SEQ ID NOS: 2510 to 7073;
(b) said genome editing system knocks out said HSV-2 RS1 gene, and said targeting domain consists of a nucleotide sequence that is identical to, or differs by no more than 3 nucleotides from, a nucleotide sequence selected from the nucleotide sequences set forth in SEQ ID NOS: 9293 to 13614;
(c) said genome editing system knocks out said HSV-1 RL2 gene, and said targeting domain consists of a nucleotide sequence that is identical to, or differs by no more than 3 nucleotides from, a nucleotide sequence selected from the nucleotide sequences set forth in SEQ ID NOS: 22745 to 26601;
(d) said genome editing system knocks out said HSV-2 RL2 gene, and said targeting domain consists of a nucleotide sequence that is identical to, or differs by no more than 3 nucleotides from, a nucleotide sequence selected from the nucleotide sequences set forth in SEQ ID NOS: 28038 to 31720;
(e) said genome editing system knocks out said HSV-1 LAT gene, and said targeting domain consists of a nucleotide sequence that is identical to, or differs by no more than 3 nucleotides from, a nucleotide sequence selected from the nucleotide sequences set forth in SEQ ID NOS: 32747 to 35600; or
(f) said genome editing system knocks out said HSV-2 LAT gene, and said targeting domain consists of a nucleotide sequence that is identical to, or differs by no more than 3 nucleotides from, a nucleotide sequence selected from the nucleotide sequences set forth in SEQ ID NOS: 36927 to 40871.

8. The genome editing system of claim 7, wherein said targeting domain consists of the nucleotide sequence set forth in SEQ ID NO: 243, SEQ ID NO: 2515, SEQ ID NO: 2522, SEQ ID NO: 3362, SEQ ID NO: 3363, SEQ ID NO: 23489, SEQ ID NO: 23519, SEQ ID NO: 23527, SEQ ID NO: 23531, SEQ ID NO: 23535, SEQ ID NO: 23569, SEQ ID NO: 23571, SEQ ID NO: 23580, SEQ ID NO: 23583, or SEQ ID NO: 23587.

9. The genome editing system of claim 1, wherein said Cas9 molecule is an *S. pyogenes* Cas9 molecule, and
   (a) said genome editing system knocks down said HSV-1 RS1 gene, and said targeting domain consists of a nucleotide sequence that is identical to, or differs by no more than 3 nucleotides from, a nucleotide sequence selected from the group consisting of: nucleotide sequences set forth in SEQ ID NOS: 13637 to 14794;
   (b) said genome editing system knocks down said HSV-2 RS1 gene, and said targeting domain consists of a nucleotide sequence that is identical to, or differs by no more than 3 nucleotides from, a nucleotide sequence selected from the nucleotide sequences set forth in SEQ ID NOS: 17753 to 18784;
   (c) said genome editing system knocks down said HSV-1 RL2 gene, and said targeting domain consists of a nucleotide sequence that is identical to, or differs by no more than 3 nucleotides from, a nucleotide sequence selected from the nucleotide sequences set forth in SEQ ID NOS: 40886 to 42078;
   (d) said genome editing system knocks down said HSV-2 RL2 gene, and said targeting domain consists of a nucleotide sequence that is identical to, or differs by no more than 3 nucleotides from, a nucleotide sequence selected from the nucleotide sequences set forth in SEQ ID NOS: 49498 to 50652;
   (e) said genome editing system knocks down said HSV-1 LAT gene, and said targeting domain consists of a nucleotide sequence that is identical to, or differs by no more than 3 nucleotides from, a nucleotide sequence selected from the nucleotide sequences set forth in SEQ ID NOS: 45340 to 46479; or
   (f) said genome editing system knocks down said HSV-2 LAT gene, and said targeting domain consists of a nucleotide sequence that is identical to, or differs by no more than 3 nucleotides from, a nucleotide sequence selected from the nucleotide sequences set forth in SEQ ID NOS: 53858 to 55056.

10. The genome editing system of claim 1, wherein said Cas9 molecule is an *S. aureus* Cas9 molecule, and
   (a) said genome editing system knocks down said HSV-1 RS1 gene, and said targeting domain consists of a nucleotide sequence that is identical to, or differs by no more than 3 nucleotides from, a nucleotide sequence selected from the nucleotide sequences set forth in SEQ ID NOS: 14795 to 17741;
   (b) said genome editing system knocks down said HSV-2 RS1 gene, and said targeting domain consists of a nucleotide sequence that is identical to, or differs by no more than 3 nucleotides from, a nucleotide sequence selected from the nucleotide sequences set forth in SEQ ID NOS: 18785 to 21311;
   (c) said genome editing system knocks down said HSV-1 RL2 gene, and said targeting domain consists of a nucleotide sequence that is identical to, or differs by no more than 3 nucleotides from, a nucleotide sequence selected from the nucleotide sequences set forth in SEQ ID NOS: 42079 to 45315;
   (d) said genome editing system knocks down said HSV-2 RL2 gene, and said targeting domain consists of a nucleotide sequence that is identical to, or differs by no more than 3 nucleotides from, a nucleotide sequence selected from the nucleotide sequences set forth in SEQ ID NOS: 50653 to 53824;
   (e) said genome editing system knocks down said HSV-1 LAT gene, and said targeting domain consists of a nucleotide sequence that is identical to, or differs by no more than 3 nucleotides from, a nucleotide sequence selected from the nucleotide sequences set forth in SEQ ID NOS: 46480 to 49479; or
   (f) said genome editing system knocks down said HSV-2 LAT gene, and said targeting domain consists of a nucleotide sequence that is identical to, or differs by no more than 3 nucleotides from, a nucleotide sequence selected from the nucleotide sequences set forth in SEQ ID NOS: 55057 to 58731.

11. The genome editing system of claim 6, wherein said *S. pyogenes* Cas9 molecule recognizes a Protospacer Adjacent Motif (PAM) of NGG.

12. The genome editing system of claim 9, wherein said *S. pyogenes* Cas9 molecule recognizes a PAM of NGG.

13. The genome editing system of claim 7, wherein said *S. aureus* Cas9 molecule recognizes a PAM of NNGRRT (SEQ ID NO: 204) or NNGRRV (SEQ ID NO: 205).

14. The genome editing system of claim 10, wherein said *S. aureus* Cas9 molecule recognizes a PAM of NNGRRT (SEQ ID NO: 204) or NNGRRV (SEQ ID NO: 205).

15. The genome editing system of claim 1, wherein said Cas9 molecule is selected from the group consisting of an enzymatically active Cas9 (eaCas9) molecule, an enzymatically inactive Cas9 (eiCas9) molecule, and an eiCas9 fusion protein.

16. The genome editing system of claim 1, wherein said Cas9 molecule comprises a wild-type Cas9 molecule, a mutant Cas9 molecule, or a combination thereof.

17. The genome editing system of claim 16, wherein said mutant Cas9 molecule comprises a mutation selected from the group consisting of D10, E762, D986, H840, N854, N863, and N580.

18. The genome editing system of claim 1, wherein said Cas9 molecule is an *S. aureus* Cas9 molecule or an *S. pyogenes* Cas9 molecule.

19. The genome editing system of claim 1, wherein said gRNA is a modular gRNA molecule or a chimeric gRNA molecule.

20. The genome editing system of claim 1, wherein said targeting domain has a length of 16, 17, 18, 19, 20, 21, 22, 23, 24, 25, or 26 nucleotides.

21. The genome editing system of claim 1, wherein said gRNA molecule comprises from 5' to 3':
   a targeting domain;
   a first complementarity domain;
   a linking domain;
   a second complementarity domain;
   a proximal domain; and
   a tail domain.

22. The genome editing system of claim 21, wherein said linking domain is no more than 25 nucleotides in length.

23. The genome editing system of claim 21, wherein said proximal and tail domain, taken together, are at least 20, at least 25, at least 30, or at least 40 nucleotides in length.

24. The genome editing system of claim 1, comprising a second gRNA molecule.

25. The genome editing system of claim 24, wherein said second gRNA molecule comprises a second targeting domain that is complementary with a target sequence of a HSV viral gene selected from the group consisting of a RS1 gene, a RL2 gene, and a LAT gene.

26. A cell comprising the genome editing system of claim 1.

\* \* \* \* \*